US011926839B2

(12) United States Patent
Chen et al.

(10) Patent No.: US 11,926,839 B2
(45) Date of Patent: Mar. 12, 2024

(54) PLATFORM FOR T LYMPHOCYTE GENOME ENGINEERING AND IN VIVO HIGH-THROUGHPUT SCREENING THEREOF

(71) Applicant: YALE UNIVERSITY, New Haven, CT (US)

(72) Inventors: Sidi Chen, Milford, CT (US); Matthew Dong, San Francisco, CA (US)

(73) Assignee: YALE UNIVERSITY, New Haven, CT (US)

( * ) Notice: Subject to any disclaimer, the term of this patent is extended or adjusted under 35 U.S.C. 154(b) by 1096 days.

(21) Appl. No.: 16/605,715

(22) PCT Filed: Apr. 17, 2018

(86) PCT No.: PCT/US2018/027967

§ 371 (c)(1),
(2) Date: Oct. 16, 2019

(87) PCT Pub. No.: WO2018/195073

PCT Pub. Date: Oct. 25, 2018

(65) Prior Publication Data

US 2022/0259616 A1 Aug. 18, 2022

Related U.S. Application Data

(60) Provisional application No. 62/602,290, filed on Apr. 18, 2017.

(51) Int. Cl.
*C12N 15/00* (2006.01)
*C12N 5/0783* (2010.01)
(Continued)

(52) U.S. Cl.
CPC .......... *C12N 15/85* (2013.01); *C12N 5/0638* (2013.01); *C12N 15/111* (2013.01); *G01N 15/14* (2013.01);
(Continued)

(58) Field of Classification Search
None
See application file for complete search history.

(56) References Cited

U.S. PATENT DOCUMENTS

2005/0214823 A1 9/2005 Blume et al.
2009/0187997 A1 7/2009 Stern et al.
(Continued)

FOREIGN PATENT DOCUMENTS

CN 106591366 A * 4/2017
CN 110114461 A * 8/2019 .......... A61K 9/1271
(Continued)

OTHER PUBLICATIONS

WIPO English translation of CN110114461 (Year: 2019).*
(Continued)

*Primary Examiner* — M Franco G Salvoza
(74) *Attorney, Agent, or Firm* — Saul Ewing LLP; Kathryn Doyle; Domingos J. Silva

(57) ABSTRACT

The present invention includes compositions and methods for T cell genome editing and screening in vivo. In certain aspects, the invention includes an sgRNA library for genome-scale mutagenesis.

3 Claims, 112 Drawing Sheets

Specification includes a Sequence Listing.

(51) Int. Cl.
*C12N 15/11* (2006.01)
*C12N 15/85* (2006.01)
*G01N 15/14* (2006.01)

(52) U.S. Cl.
CPC .... *A01K 2217/15* (2013.01); *A01K 2227/101* (2013.01); *A01K 2227/105* (2013.01); *A01K 2267/03* (2013.01); *C12N 2310/20* (2017.05); *C12N 2510/00* (2013.01); *C12N 2740/16043* (2013.01)

(56) References Cited

U.S. PATENT DOCUMENTS

| | | | | |
|---|---|---|---|---|
| 2016/0168594 | A1* | 6/2016 | Zhang ................ | A01K 67/0275 435/320.1 |
| 2016/0311908 | A1 | 10/2016 | Arena et al. | |

FOREIGN PATENT DOCUMENTS

| | | | |
|---|---|---|---|
| WO | 2016011080 | A2 | 1/2016 |
| WO | 2017004153 | A1 | 1/2017 |
| WO | 2017075451 | A1 | 5/2017 |
| WO | 2017081097 | A1 | 5/2017 |
| WO | 2017083722 | A1 | 5/2017 |
| WO | 2017152015 | A1 | 9/2017 |
| WO | 2017192924 | A1 | 11/2017 |
| WO | 2018161009 | A1 | 9/2018 |

OTHER PUBLICATIONS

WIPO English translation of CN106591366 (Year: 2017).*
Extended European Search Report dated May 3, 2022 for European patent application No. 19788924.9.
International Search Report and Written Opinion dated Aug. 29, 2019 for Intl. Appl. No. PCT/US2019/027956.
International Search Report dated Oct. 24, 2018 in International Patent Application No. PCT/US18/27967.
Braun, Christian et al., "Versatile in vivo regulation of tumor phenotypes by dCas9-mediated transcriptional perturbation", PNAS, 113(27) E3892-E3900 (Jun. 2016).
Supporting information, 68 pages (2010), for Braun, Christian et al., "Versatile in vivo regulation of tumor phenotypes by dCas9-mediated transcriptional perturbation", PNAS, 113(27) E3892-E3900 (Jun. 2016).
Chavez, Alejandro et al., "Comparison of Cas9 activators in multiple species", Nature Methods, 13(7):563-567 (May 2016).
Supplementary information, 14 pages (2016), for Chavez, Alejandro et al., "Comparison of Cas9 activators in multiple species", Nature Methods, 13(7):563-567 (May 2016).
Chavez, Alejandro et al., "Highly efficient Cas9-mediated transcriptional programming", Nature Methods, 12(4):326-328 (Apr. 2015).
Chen, Runqiang et al., "In vivo RNA interference screens identify regulators of antiviral CD4+ and CD8+ T cell differentiation", Immunity, 41(2):325-338 (Aug. 2014).
Chow, Ryan et al., "AAV-mediated direct in vivo CRISPR screen identifies functional suppressors in glioblastoma", Nature Neuroscience, 20:1329-1341 (Oct. 2017).
De Charette, Marie et al., "Turning tumour cells into antigen presenting cells: The next step to improve cancer immunotherapy?", European Journal of Cancer, Elsevier, Amsterdam NL, 68:134-147 (Oct. 2016).
Gaujoux, Renaud et al., "A flexible R package for nonnegative matrix factorization", BMC Bioinformatics, 11(367,):1-9 (2010).
Germano, Giovanni et al., "Inactivation of DNA repair triggers neoantigen generation and impairs tumour growth", Nature, 552(7683):116-120 (Nov. 2017).
Gilbert, Luke A. et al., "CRISPR-mediated modular RNA-guided regulation of transcription in eukaryotes", Cell, 154(2):442-451 (Jul. 2013).
Gilbert, Luke A. et al., "Genome-Scale CRISPR-Mediated Control of Gene Repression and Activation", Cell, 159(3):647-661 (Oct. 2014).
Hu, Zhuting et al., "Towards personalized, tumour-specific, therapeutic vaccines for cancer", Nature Reviews Immunology, 18(3):168-182 (Dec. 2017).
Huang, Dai Wei et al., "Bioinformatics enrichment tools: paths toward the comprehensive functional analysis of large gene lists", Nucleic Acids Research, 37(1):1-13 (Nov. 2008).
Kampmann, Martin, "CRISPRi and CRISPRa Screens in Mammalian Cells for Precision Biology and Medicine", Biology and Medicine, ACS Chem. Bio., 13(2):406-416 (2017).
Konermann, Silvana et al., "Genome-scale transcriptional activation by an engineered CRISPR-Cas9 complex", Nature, 517(7536):583-588 (Jan. 2015).
Langmead, Ben et al., "Ultrafast and memory-efficient alignment of short DNA sequences to the human genome", Genome Biology, 10(R25):1-10 (Mar. 2009).
Liao, Hsin-Kai et al., "In Vivo Target Gene Activation via CRISPR/Cas9-Mediated Trans-epigenetic Modulation", Cell, 171(7):1495-1507 (Dec. 2017).
Lun, Aaron et al., "A step-by-step workflow for low-level analysis of single-cell RNA-seq data with Bioconductor", F1000 Research 5(2122):1-64 (Aug. 2016).
Mi, Huaiyu et al., "Large-scale function analysis with the PANTHER classification system", Nature Protocols 8:1551-1566 (2013).
Qi, Lei et al., "Repurposing CRISPR as an RNA-Guided Platform for SequenceSpecific Control of Gene Expression", Cell, 152(5):1173-1183 (2013).
Robinson, Mark et al., "edgeR: a Bioconductor package for differential expression analysis of digital gene expression data", Bioinformatics, Gene Expression 26(1):139-140 (2009).
Sanjana, Neville et al., "Improved vectors and genome-wide libraries for CRISPR screening", National Methods, 11(8):783-784 (2014).
Sau, Samaresh et al., "Multifunctional Nanoparticles for Cancer Immunotherapy: A Groundbreaking Approach for Reprogramming Malfunctioned Tumor Environment", Journal of Controlled Release, 274:24-34 (Jan. 2018).
Siebenkas, Cornelia et al., "Inhibiting DNA methylation activates cancer testis antigens and expression of the antigen processing and presentation machinery in colon and ovarian cancer cells", PLOS ONE, 12(6):e0179501, pp. 1-15 (Jun. 2017).
Tanenbaum, Marvin E., et al., "A protein-tagging system for signal amplification in gene expression and fluorescence imaging", Cell, 159(3):635-646 (Oct. 2014).
Wang, Guangchuan et al., "Multiplexed activation of endogenous genes by CRISPRa elicits potent antitumor immunity", Nature Immunology, 20(11):1494-1505 (Oct. 2019).
Zheng, Chunhong et al., "Landscape of Infiltrating T Cells in Liver Cancer Revealed by Single-Cell Sequencing", Cell, 169:1342-1356 (Jun. 2017).
Zhou, Penghui , et al., "In vivo Discovery of Immunotherapy Targets in the Tumor Microenvironment", Nature, 506(7486):52-57 (2014).

* cited by examiner

FIG. 5C

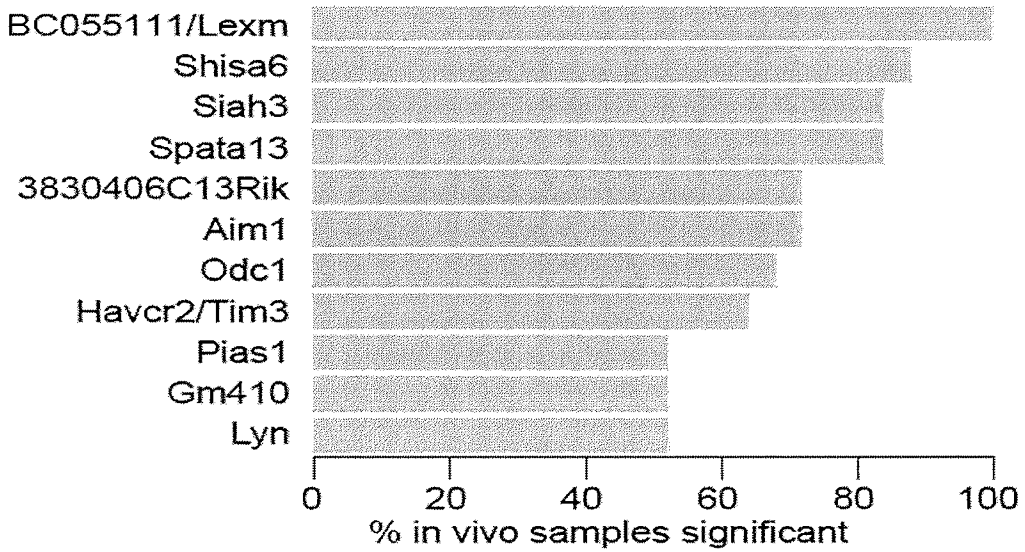

FIG. 5D

| Enriched GO term | n | p value |
|---|---|---|
| Antibacterial humoral response | 8 | 7.83E-05 |
| Defense response to Gram-positive bacterium | 12 | 2.23E-04 |
| Positive regulation of ERK1 and ERK2 cascade | 17 | 4.66E-04 |
| Innate immune response in mucosa | 6 | 4.83E-04 |
| Regulation of synaptic transmission, GABAergic | 5 | 6.38E-04 |
| NF-kappa B signaling pathway | 12 | 1.00E-03 |
| CCR chemokine receptor binding | 6 | 1.97E-03 |
| Chemokine receptor binding | 5 | 2.44E-03 |
| Ras guanine nucleotide exchange factor, domain | 7 | 2.84E-03 |
| Extrinsic component of cytoplasmic side of plasma membrane | 10 | 3.25E-04 |
| Nuclear nucleosome | 7 | 2.75E-03 |
| Perikaryon | 13 | 3.49E-03 |
| Plasma membrane | 184 | 1.05E-02 |
| Immunological synapse | 5 | 2.32E-02 |

FIG. 6C
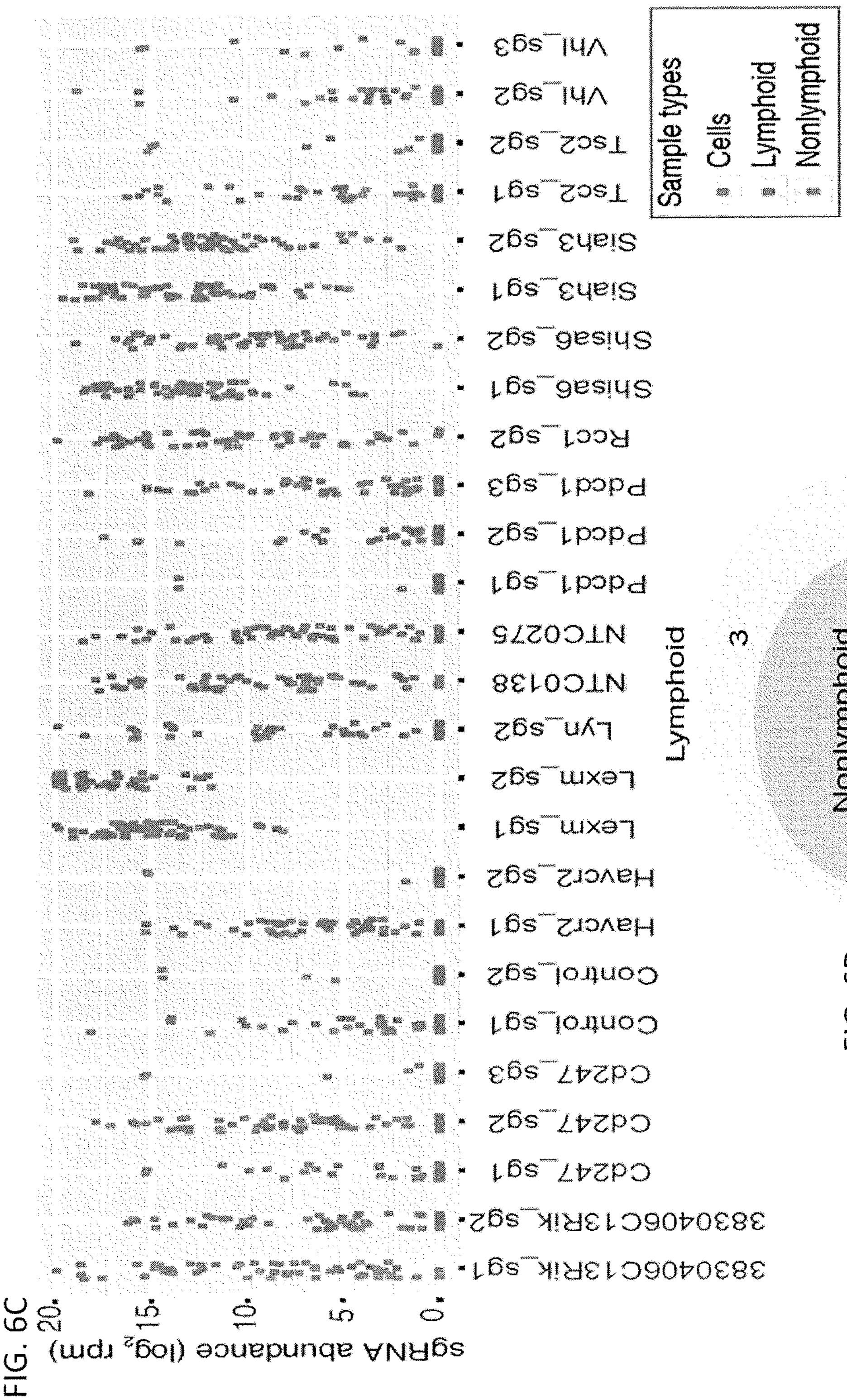
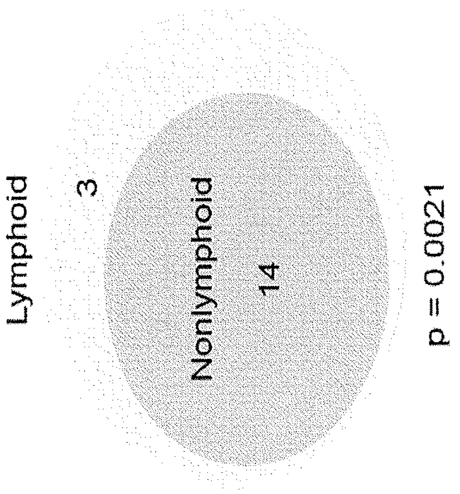
FIG. 6D

FIG. 8E
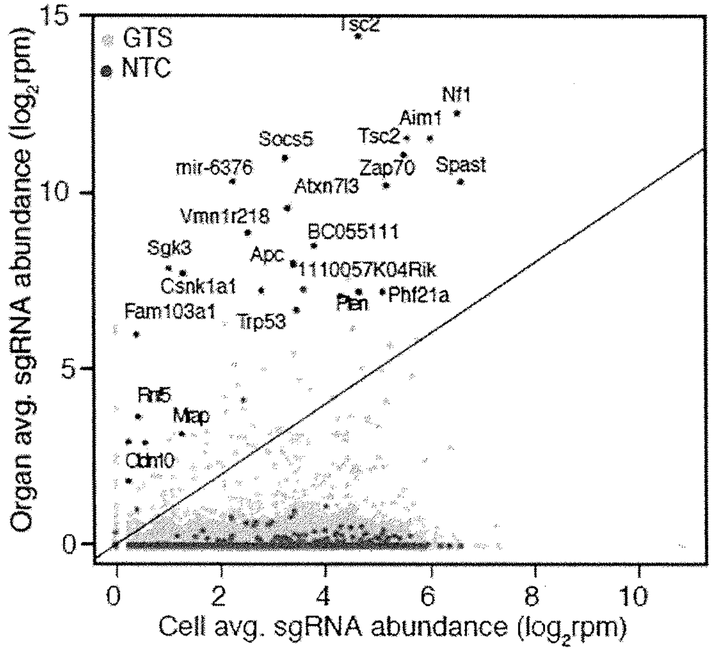
FIG. 8F
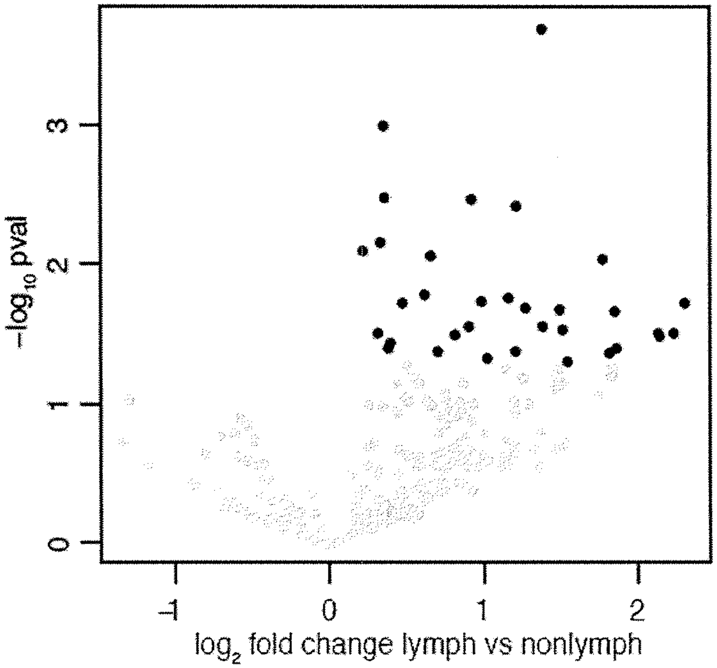
FIG. 8G
| GO term | n | Enrichment p value |
|---|---|---|
| Differentiation | 82 | 7.73E-05 |
| Alternative splicing | 469 | 4.46E-06 |
| Cell membrane | 359 | 6.99E-04 |
| Cell adhesion | 63 | 1.18E-03 |
| Receptor | 256 | 1.26E-03 |

| sgRNA | foldChng_vs_NTCavg | t-test_vs_NTCavg |
|---|---|---|
| Lexm_sg2 | 4.039740667 | 1.68E-57 |
| Lexm_sg1 | 3.297240882 | 1.68E-40 |
| Shisa6_sg1 | 2.906492389 | 6.41E-29 |
| Siah3_sg1 | 2.942100616 | 9.73E-28 |
| Siah3_sg2 | 2.613933621 | 1.37E-21 |
| Havcr2_sg2 | 0.006495433 | 6.32E-20 |
| Pdcd1_sg1 | 0.007311084 | 6.34E-20 |
| Cd247_sg3 | 0.0318748 | 7.89E-20 |
| Tsc2_sg2 | 0.118302181 | 3.04E-15 |
| Vhl_sg3_duplex | 0.14566173 | 4.02E-15 |
| Shisa6_sg2 | 2.181069602 | 3.07E-13 |
| Rcc1_sg2 | 2.211589617 | 1.92E-10 |
| Cd247_sg1 | 0.324099608 | 1.31E-08 |
| Vhl_sg2_duplex | 0.357798703 | 4.81E-07 |
| Pdcd1_sg2 | 0.366709515 | 1.07E-06 |
| 3830406C13Rik_sg1 | 1.876787973 | 2.74E-06 |
| Cd247_sg2 | 1.693861488 | 3.32E-05 |
| Tsc2_sg1 | 0.770257006 | 0.132053653 |
| 3830406C13Rik_sg2 | 1.139354263 | 0.387359469 |
| Havcr2_sg1 | 1.104986069 | 0.440164842 |
| Pdcd1_sg3 | 1.069296326 | 0.658715105 |
| Lyn_sg2 | 1.033384757 | 0.854463638 |

FIG. 13

```
LOCUS           pSC017             9335 bp    DNA      circular
COMMENT     SIDI CHEN| MATTHEW DONG|
COMMENT     VNTREPLTYPE|Plasmid
FEATURES             Location/Qualifiers
     misc_feature    4792..5598
                     /dnas_title="AmpR"
                     /vntifkey="21"
                     /label=AmpR
     rep_origin      complement(5724..6339)
                     /dnas_title="pUC ori"
                     /vntifkey="33"
                     /label=pUC ori
     rep_origin      3991..4421
                     /dnas_title="f1 ori"
                     /vntifkey="33"
                     /label=f1 ori
     LTR             3202..3437
                     /dnas_title="3' LTR SIN"
                     /vntifkey="19"
                     /label=3' LTR SIN
     polyA_signal    3514..3644
                     /dnas_title="SV40 polyA"
                     /vntifkey="25"
                     /label=SV40 polyA
     source          1..6686
                     /dnas_title="pSC017_pLKO-U6-sgBsmBI-EFS-Thy11CO-spA"
     promoter        2301..2556
                     /note="EFS-NS"
     misc_feature    2301..2327
                     /note="pCM111_R2, readout PCR2 priming site"
     misc_feature    2289..2310
                     /note="pCM111_R1"
     LTR             1..413
                     /dnas_title="RSV/5'LTR"
                     /vntifkey="19"
                     /label="RSV/5'LTR"
     misc_feature    568..932
                     /dnas_title="gag"
                     /vntifkey="21"
                     /label=gag
     misc_feature    464..601
                     /dnas_title="psi"
                     /vntifkey="21"
                     /label=psi
     misc_feature    1078..1319
                     /dnas_title="RRE"
                     /vntifkey="21"
                     /label=RRE
     promoter        1717..1966
                     /dnas_title="hU6 (-250)"
                     /vntifkey="29"
                     /label=hU6 (-250)
     promoter        1896..1961
                     /dnas_title="Human U6 Promoter"
                     /vntifkey="29"
                     /label=Human U6 Promoter
     primer_bind     1717..1736
                     /note="HK0035"
     misc_feature    2113..2230
                     /dnas_title="cPPT"
                     /vntifkey="21"
                     /label=cPPT
     misc_feature    1966..2063
                     /note="chimeric RNA backbone 1 (BsmBI)"
     primer_bind     2029..2048
                     /note="HK0036 (Rv)"
     primer_bind     1971..1991
                     /note="HK0037"
     source          1..2282
                     /dnas_title="pLKO_TRC005"
     misc_feature    2581..3069
                     /note="Thy1.1 mouse"
     misc_feature    3076..3123
                     /note="Short polyA"
     misc_feature    2463..3201
                     /note="gB_pSC017"
     misc_feature    2307..2326
                     /note="EFS-F1"
     misc_feature    3124..3143
                     /note="pSC008_R1"
     misc_feature    1884..1924
                     /note="array_F1"
     misc_feature    2152..2195
                     /note="array_R1"
     misc_feature    1884..1924
                     /note="HK0157"
     misc_feature    2151..2195
                     /note="HK0158"
     misc_feature    1701..1719
                     /note="pHK025-F3"
     misc_feature    1943..1966
                     /note="PCR2 BC priming site F"
     misc_feature    2142..2166
                     /note="PCR2 BC priming site R"
     misc_feature    1717..1736
                     /note="pSC008PCR1_F1"
     misc_feature    2497..2516
                     /note="pSC008PCR1_R2"
     misc_feature    1390..1411
                     /note="pSC008PCR1_F2"
     misc_feature    2304..2325
                     /note="pSC008PCR1_R1"
     misc_feature    2823..2844
                     /note="pSC008PCR1_R3"
     misc_feature    1653..1674
                     /note="pSC008PCR1_F3"
     misc_feature    1932..1966
                     /note="pCM111PCR2primingSite"
     misc_feature    1907..1966
                     /note="array_F"
     misc_feature    2904..2910
                     /note="Codon optimized remove BsmbI"
```

FIG. 14A

```
LOCUS       pSC008            9335 bp    DNA     circular

COMMENT     SIDI CHEN| MATTHEW DONG|
COMMENT     VNTREPLTYPE|Plasmid
FEATURES             Location/Qualifiers
     misc_feature    4802..5608
                     /dnas_title="AmpR"
                     /vntifkey="21"
                     /label=AmpR
     rep_origin      complement(5734..6349)
                     /dnas_title="pUC ori"
                     /vntifkey="33"
                     /label=pUC ori
     rep_origin      4001..4431
                     /dnas_title="f1 ori"
                     /vntifkey="33"
                     /label=f1 ori
     LTR             3212..3447
                     /dnas_title="3' LTR SIN"
                     /vntifkey="19"
                     /label=3' LTR SIN
     polyA_signal    3524..3654
                     /dnas_title="SV40 polyA"
                     /vntifkey="25"
                     /label=SV40 polyA
     source          1..6696
                     /dnas_title="pSC008_pLKO-U6-BsmBI-chRNA(+85)-EFS-Thy11"
     promoter        2301..2556
                     /note="EFS-NS"
     misc_feature    2301..2327
                     /note="pCM111_R2, readout PCR2 priming site"
     misc_feature    2289..2310
                     /note="pCM111_R1"
     LTR             1..413
                     /dnas_title="RSV/5'LTR"
                     /vntifkey="19"
                     /label="RSV/5'LTR"
     misc_feature    568..932
                     /dnas_title="gag"
                     /vntifkey="21"
                     /label=gag
     misc_feature    464..601
                     /dnas_title="psi"
                     /vntifkey="21"
                     /label=psi
     misc_feature    1078..1319
                     /dnas_title="RRE"
                     /vntifkey="21"
                     /label=RRE
     promoter        1717..1876
                     /dnas_title="hU6 (-250)"
                     /vntifkey="29"
                     /label=hU6 (-250)
     promoter        1896..1961
                     /dnas_title="Human U6 Promoter"
                     /vntifkey="29"
                     /label=Human U6 Promoter
     misc_feature    1877..2076
                     /note="PCR from pU6"|
     promoter        1877..1895
                     /dnas_title="hU6 (-250)"
                     /vntifkey="29"
                     /label=hU6 (-250)
     primer_bind     1717..1736
                     /note="HK0035"
     misc_feature    2113..2230
                     /dnas_title="cPPT"
                     /vntifkey="21"
                     /label=cPPT
     misc_feature    1966..2063
                     /note="chimeric RNA backbone 1 (BsmBI)"
     primer_bind     2029..2048
                     /note="HK0036 (Rv)"
     primer_bind     1971..1991
                     /note="HK0037"
     source          1..2282
                     /dnas_title="pLKO_TRC005"
     misc_feature    2581..3069
                     /note="Thy1.1 mouse"
     misc_feature    3076..3123
                     /note="Short polyA"
     misc_feature    2463..3211
                     /note="gB_Thy1.1_shortpolyA"
     misc_feature    2307..2326
                     /note="EFS-F1"
     misc_feature    3134..3153
                     /note="pSC008_R1"
```

FIG. 14B

```
LOCUS           pSC021              9335 bp     DNA      circular

COMMENT      SIDI CHEN| MATTHEW DONG|
COMMENT      VNTREPLTYPE|Plasmid
FEATURES             Location/Qualifiers
     misc_feature    5127..5933
                     /dnas_title="AmpR"
                     /vntifkey="21"
                     /label=AmpR
     rep_origin      complement(6059..6674)
                     /dnas_title="pUC ori"
                     /vntifkey="33"
                     /label=pUC ori
     rep_origin      4326..4756
                     /dnas_title="f1 ori"
                     /vntifkey="33"
                     /label=f1 ori
     LTR             3537..3772
                     /dnas_title="3' LTR SIN"
                     /vntifkey="19"
                     /label=3' LTR SIN
     polyA_signal    3849..3979
                     /dnas_title="SV40 polyA"
                     /vntifkey="25"
                     /label=SV40 polyA
     source          1..7021
                     /dnas_title="pLKO_TRC005"
     misc_feature    2289..2300
                     /note="pCM111_R1"
     LTR             1..413
                     /dnas_title="RSV/5'LTR"
                     /vntifkey="19"
                     /label="RSV/5'LTR"
     misc_feature    568..932
                     /dnas_title="gag"
                     /vntifkey="21"
                     /label=gag
     misc_feature    464..601
                     /dnas_title="psi"
                     /vntifkey="21"
                     /label=psi
     misc_feature    1078..1319
                     /dnas_title="RRE"
                     /vntifkey="21"
                     /label=RRE
     promoter        1717..1966
                     /dnas_title="hU6 (-250)"
                     /vntifkey="29"
                     /label=hU6 (-250)
     promoter        1896..1961
                     /dnas_title="Human U6 Promoter"
                     /vntifkey="29"
                     /label=Human U6 Promoter
     misc_feature    2113..2230
                     /dnas_title="cPPT"
                     /vntifkey="21"
                     /label=cPPT
     misc_feature    1966..2063
                     /note="chimeric RNA backbone 1 (BsmBI)"
     misc_feature    2916..3404
                     /note="Thy1.1 mouse"
```

FIG. 14C

```
LOCUS       pMD002              9335 bp     DNA     circular
COMMENT     SIDI CHEN| MATTHEW DONG|
COMMENT     VNTOAUTHORNAME|UNKNOWN|
COMMENT     VNTREPLTYPE|Plasmid
FEATURES            Location/Qualifiers
     misc_feature    7377..8183
                     /dnas_title="AmpR"
                     /vntifkey="21"
                     /label=AmpR
     rep_origin      complement(8309..8924)
                     /dnas_title="pUC ori"
                     /vntifkey="33"
                     /label=pUC ori
     rep_origin      6576..7006
                     /dnas_title="f1 ori"
                     /vntifkey="33"
                     /label=f1 ori
     LTR             5787..6022
                     /dnas_title="3' LTR SIN"
                     /vntifkey="19"
                     /label=3' LTR SIN
     misc_RNA        5128..5716
                     /dnas_title="WPRE"
                     /vntifkey="53"
                     /label=WPRE
     polyA_signal    6099..6229
                     /dnas_title="SV40 polyA"
                     /vntifkey="25"
                     /label=SV40 polyA
     source          2283..9271
                     /dnas_title="pMD002-pHKO_09-pLKO-U6-BsmBI-chRNA(+85)
                     -EF1a-mCherry-2A-cOVA"
     promoter        2289..3546
                     /dnas_title="EF-1a"
                     /vntifkey="29"
                     /label=EF-1a
     PCR_primer      complement(2429..2446)
                     /dnas_title="TCAATTGCCGACCCCTCC"
                     /pair=""
                     /primer="TCAATTGCCGACCCCTCC"
                     /current=0
     PCR_primer      complement(2436..2453)
                     /note="XRP008 partial binding site"
                     /current=0
     variation       2677..2677
                     /note="C in all sequences"
     PCR_primer      3388..3411
                     /note="EF1A-F seq primer"
                     /current=0
     PCR_primer      2289..2319
                     /dnas_title="TGCAAAGATGGATAAAGTTTTAAACAGAGAG"
                     /pair=""
                     /primer="TGCAAAGATGGATAAAGTTTTAAACAGAGAG"
                     /current=0
     primer_bind     5485..5504
                     /note="HKO034 (Rv)"
     primer_bind     2488..2507
                     /note="HKO038 (Rv)"
     gene            3562..4266
                     /dnas_title="mcherry"
                     /gene="mCherry"
     PCR_primer      3562..3585
                     /dnas_title="GTGAGCAAGGGCGAGGAGGATAAC"
                     /pair=""
                     /primer="GTGAGCAAGGGCGAGGAGGATAAC"
                     /current=0
     PCR_primer      3562..3585
                     /dnas_title="GTGAGCAAGGGCGAGGAGGATAAC"
                     /pair=""
                     /primer="GTGAGCAAGGGCGAGGAGGATAAC"
                     /current=0
     PCR_primer      complement(4245..4266)
                     /dnas_title="CTTGTACAGCTCGTCCATGCCG"
                     /pair=""
                     /primer="CTTGTACAGCTCGTCCATGCCG"
                     /current=0
```

FIG. 14D

```
PCR_primer      3553..3572
                /dnas_title="GCCACCATGGTGAGCAAGGG"
                /pair=""
                /primer="GCCACCATGGTGAGCAAGGG"
                /current=0
LTR             1..413
                /dnas_title="RSV/5'LTR"
                /vntifkey="19"
                /label="RSV/5'LTR"
misc_feature    568..932
                /dnas_title="gag"
                /vntifkey="21"
                /label=gag
misc_feature    464..601
                /dnas_title="psi"
                /vntifkey="21"
                /label=psi
misc_feature    1078..1319
                /dnas_title="RRE"
                /vntifkey="21"
                /label=RRE
promoter        1717..1876
                /dnas_title="hU6 (-250)"
                /vntifkey="29"
                /label=hU6 (-250)
primer_bind     1717..1736
                /note="HKO035"
misc_feature    2113..2230
                /dnas_title="cPPT"
                /vntifkey="21"
                /label=cPPT
promoter        1896..1961
                /dnas_title="Human U6 Promoter"
                /vntifkey="29"
                /label=Human U6 Promoter
misc_feature    1877..2076
                /note="PCR from pU6"
misc_feature    1966..2063
                /note="chimeric RNA backbone 1 (BsmBI)"
promoter        1877..1895
                /dnas_title="hU6 (-250)"
                /vntifkey="29"
                /label=hU6 (-250)
primer_bind     2029..2048
                /note="HKO036 (Rv)"
primer_bind     1971..1991
                /note="HKO037"
source          1..2282
                /dnas_title="pLKO_TRC005"
misc_feature    4267..4329
                /note="2A"
CDS             4330..5112
                /label=ORF frame 1
                /translation="MGSIGAASMEFCFDVFKELINSWVESQTNGIIRNVLQPSSVDSQ
                TAMVLVNAIVFKGLWEKTFKDEDTQAMPFRVTEQESKPVQMMYQIGLFRVASMASEKM
                KILELPFASGTMSMLVLLPDEVSGLEQLESIINFEKLTEWTSSNVMEERKIKVYLPRM
                KMEEKYNLTSVLMAMGITDVFSSSANLSGISSAESLKISQAVHAAHAEINEAGREVVG
                SAEAGVDAASVSEEFRADHPFLFCIKHIATNAVLFFGRCVSP*"
misc_feature    4453..4453
                /note=""
misc_feature    4330..5109
                /note="cOVA"
misc_feature    4267..4285
                /note="Fw anneal"
misc_feature    4232..4285
                /note="pMD002-F1"
misc_feature    5084..5112
                /note="Rv anneal"
misc_feature    5084..5152
                /note="pMD002/3-R1"
PCR_primer      4139..4154
                /dnas_title="TGCCCGGCGCCTACAA"
                /pair="mCherry-int-F1"
                /primer="TGCCCGGCGCCTACAA"
                /current=0
PCR_primer      complement(5153..5190)
                /dnas_title="AGGAGCAACATAGTTAAGAATACCAGTCAATCTTTCAC"
                /pair="pMD2/3-con-R1"
                /primer="AGGAGCAACATAGTTAAGAATACCAGTCAATCTTTCAC"
                /current=1
```

FIG. 14E

DHX37

Domains: DEXDc — P-loop_NTPase — HrpA — HELICc — HA2

Positions: 1 ... 1157

| Species | DEXDc region | HELICc region |
|---|---|---|
| Macropus | EIQEARLRLPILSEEQVIMEAVAEHPTVIICGETGSGKTTQVPQFLNEAGYSSEHGLIGI | VTRPPFEGRLCVAINVAERSLIIPGKVVDCGKVKKFYIDKVTGVSSFRVTWVSQAS |
| Sus | EMQERLKLPILAEEQVIMEAVAEHPTVIVCGETGSGKTTQVPQFLNEAGYSREGGWGP | LWRRPPG--ICCAGCSGGALPGLSLAGLQESV-CTFPGSRTRGVWKEISIAKPGAS |
| Tursiops | EMQAERLRLPILSEEQVIMEAVAEHPTVIVCGETGSGKTTQVPQFLNEAGTAGRDSLGI | VFQPPPEGTRLCVAINVAERSLIIPGIKVVDCGKVKKFYIDKVTGVSSFRITWVSQAS |
| Ornithorhynchus | EIQEARLRLPILSEEQVIMEAVAEHPTVIXCGETGSGKTTQVPQFINEAGTAGRDSLGI | VFKPPPEGRLCVAINVAEHSLHTPNIKVVDCGKVKKFFIDKVTGVSSFKVSWVSQAS |
| Monodelphis | EVQEARLRLPILSEEQVIMEAVSENPTVIXCGETGSGKTTQVPQFINEAGYSSD-GLIGI | VFRPPPEGTRLCVAINVAETSLIIPGIKVVDCGKVKKFFIDKVTGVSSFRVTWVSQAS |
| Microcebus | EMQXXXXXXXXXXXXXXXXXXXXXXXXXXXXXXXXXXXXXXXXXXXXXXXXXXXXXXX | VFRP-GSEGARLCVAINVAETSLIIPGIKVVDCGKVKKFFIDKVTGVSSFRITWVSQAS |
| Ochotona | EMQAERLRLPILSEEQVIMEAVAEHPTVIVCGETGSGKTTQVPQFLNEAGYSSNNSLIGV | VFRPPPEGTRLCVAINVAETSLIIPGIKVVDCGKVKKFYIDKVTGVSSFRVTWVSQAS |
| Cavia | EMQAERQLPILSEEQVIMEAVAEHPWG--SCAETGSEKTTQVPQFLNEAGYGGENSGIGV | VFRPPPEGTRLCVAINVAETSLIIPGIKVVDCGKVKKFYIDNSHTIQLSHN------- |
| Dasypus | EMQEERLKLPILSEEQVIMEAVAEHPTVIVCGETGSGKTTQVPQFLNEAGYSSDQSLIGV | VFRPPEGARLCVAINVAETSLIIPGIKVVDCGKVKKFYIDKVTGVSSFRVTWVSQAS |
| Dipodomys | EMQEERLKLPILAEEQVIMEAVAEHPTVIVCGETGSGKTTQVPQFLNEAGYSSEDSLIGV | VFQPPPEGTRLCVAINVAETSLIIPGIKVVDCGKVKKFYIDKVTGVSSFRVTWVSQAS |
| Rattus | EMQEERLKLPILSEEQVIMEAVAEHPTVIVCGETGSGKTTQVPQFLNEAGYSSEDSIIGV | VFQPPPEGTRLCVAINVAETSLIIPGIKVVDCGKVKKFYIDKVTGVSSFRVTWVSQAS |
| Mus | EMQEERLKLPILSEEQAIMEAVAEHPTVIVCGETGSGKTTQVPQFLNEAGYSSEDSIIGV | VFQPPPEGTRLCVAINVAETSLIIPGIKVVDCGKVKKFYIDKVTGVSSFRVTWVSQAS |
| Procavia | EMQEERLKLPILAEEQVIMEAVAEHPTVIVCGETGSGKTTQVPQFLNEAGYSSEDSIIGV | VFAPPPEGTRLCVAINVAETSLIIPGIKVVDCGKVKKFYIDKVTGVSSFRVTWVSQAS |
| Bos | EQMEERLKLPILAEEQIMEAVAEHPTVIVCGETGSGKTTQVPQFLNEAGYSSEDSIIGV | VFQPPPEGTRLCVAINVAETSLIIPGIKVVDCGKVKKFYIDKVTGVSSFRVTWVSQAS |
| Pteropus | EMQEERLRLPILSEEQVIMEAVAEHPTVIVCGETGSGKTTQVPQFLNEAGYSSEDSIIGV | VFQPPPEGTRLCVAINVAETSLIIPGIKVVDCGKVKKFYIDKVTGVSSFRVTWVSQAS |
| Felis | EMQEERLRLPILAEEQVIMEAVAEHPTVIVCGETGSGKTTQVPQFLNEAGYSSEDSIIGV | VFQPPPEGTRLCVAINVAETSLIIPGIKVVDCGKVKKFYIDKVTGVSSFRVTWVSQAS |
| Mustela | EMQEERLKLPILAEEQAIMEAVAEHPTVIVCGETGSGKTTQVPQFLNEAGYSSEDSNIGV | VEKPPPEGTRLCVAINVAETSLIIPGIKVVDCGKVKKFYIDKVTGVSSFRVTWVSQAS |
| Canis | EMQEERLKLPILAEEQVIMEAVAEHPTVIVCGETGSGKTTQVPQFLNEAGYSSEDSNIGI | VFKPPPEGTRLCVAINVAETSLIIPGIKVVDCGKVKKFYIDKVTGVSSFRVTWVSQAS |
| Ailuropoda | EMQEERLKLPILAEEQVIMEAVAEHPTVIVCGETGSGKTTQVPQFLNEAGYSSDNSLIGI | VFKPPPEGTRLCVAINVAETSLIIPGIKVVDCGKVKKFYIDKVTGVSSFRVTWVSQAS |
| Equus | EMQEERLKLPILAEEQVIMEAVAEHPTVIVCGETGSGKTTQVPQFLNEAGYSSDNSLIGV | VFKPPPEGTRLCVAINVAETSLIIPGIKVVDCGKVKKFYIDKVTGVSSFRVTWVSQAS |
| Ictidomys | EMQEERLKLPILAEEQVIMEAVADNPTVIVCGETGSGKTTQVPQFLNEAGYSSEDDSLIGV | VFKPPPEGTRLCVAINVAETSLIIPGIKVVDCGKVKKFYIDKVTGVSSFRVTWVSQAS |
| Oryctolagus | EMQEERLKLPILAEEQVIMEAVAEHPTVIICGETGSGKTTQVPQFLNEAGYSSDDGIGV | VTPPPEGTRLCVAINVAETSLIIPGIKVVDCGKVKKFYIDKVTGVSSFRVTWIQAS |
| Loxodonta | EMQEERLKLPILAEEQVIMEAVAENPTIIVCGETGSGKTTQVPQFLNEAGYSSEDSIIGV | VEKPPPEGTRLCVAINVAETSLIIPGIKVVDCGKVKKFYIDKVTGVSSFRVTWVSQAS |
| Otolemur | EIQEERLKLPILSEEQVIMEAVAEHPTVIVCGETGSGKTTQVPQFLNEAGYSSDNSIGH | VEKPPPEGTRLCVAINVAETSLIIPGIKVVDCGKVKKFYIDKVTGVSSFRVTWVSQAS |
| Nomascus | EMQEERLKLPILSEEQVIMEAVAEHPTVIVCGETGSGKTTQVPQFLNEAGYSSEDSIIGV | VEKPPPEGTRLCVAINVAETSLIIPGIKVVDCGKVKKFYIDKVTGVSSFRVTWVSQAS |
| Callithrix | EMQEERLKLPILSEEQVIMEAVAEHPTVIVCGETGSGKTTQVPQFLNEAGYSSEGSIGV | VEKPPPEGTRLCVAINVAETSLIIPGIKVVDCGKVKKFYIDKVTGVSSFRVTWVSQAS |
| Macaca | EMQEERLKLPILSEEQVIMEATVEERPIVIVCGETGSGKTTQVPQFLNEAGYSSESGSIGV | VEKPPPEGTRLCVAINVAETSLIIPGIKVVDCGKVKKFYIDKVTGVSSFRVTWVSQAS |
| Papio | EMQEERLKLPILSEEQVIMEAVAEHPTVIVCGETGSGKTTQVPQFLNEAGYSSEGSIGV | VEKPPPEGTRLCVAINVAETSLIIPGIKVVDCGKVKKFYIDKVTGVSSFRVTWVSQAS |
| Chlorocebus | EMQEERLKLPILSEEQVIMEAVAEHPTVIVCGETGSGKTTQVPQFLNEAGYSSEGSIGV | VEKPPPEGTRLCVAINVAETSLIIPGIKVVDCGKVKKRDIDKVTGVSSFCVTWVSQAS |
| Pongo | EMQEERLKLPILSEEQVIMEAVAEHPTVIVCGETGSGKTTQVPQFLNEAGYS------- | VEKPPPSGTRLCVAINVAETSLIIPGIKVVDCGKVKKFYIDKVTGVSSFRVTWVSQAS |
| Gorilla | EMQEERLKLPILSEEQVIMEAVAEHPTVIVCGETGSGKTTQVPQFLNEAGFSSEDSIIGV | VEKPPPEGTRLCVAINVAETSLIIPGIKVVDCGKVKKFYIDKVTGVSSFRVTWVSQAS |
| Homo | EMQEERLKLPILSEEQVIMEAVAEHPTVIVCGETGSGKTTQVPQFLNEAGFSSEDSIIGV | VEKPPPEGTRLCVAINVAETSLIIPGIKVVDCGKVKKFYIDKVTGVSSFRVTWVSQAS |

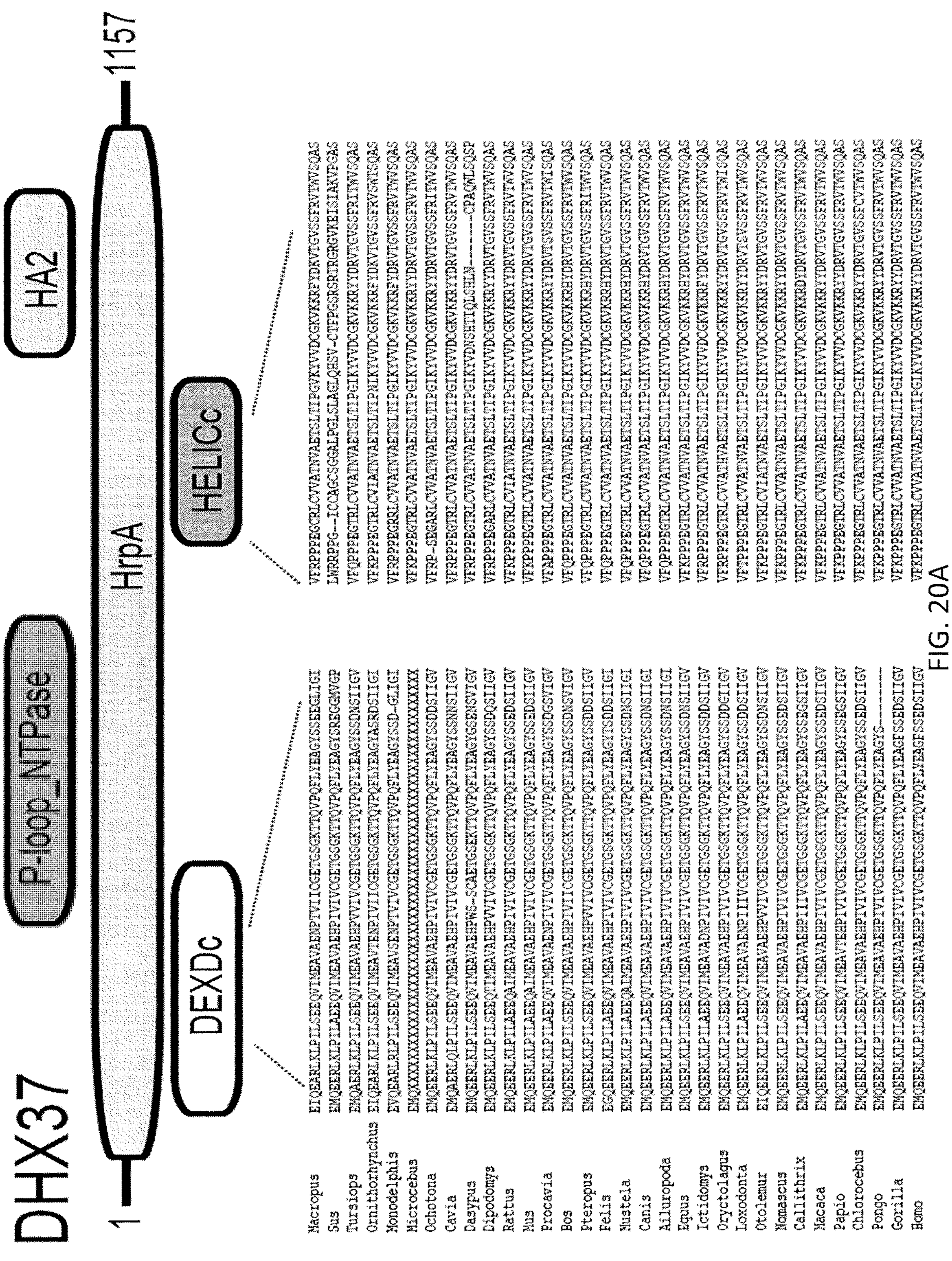

FIG. 20A

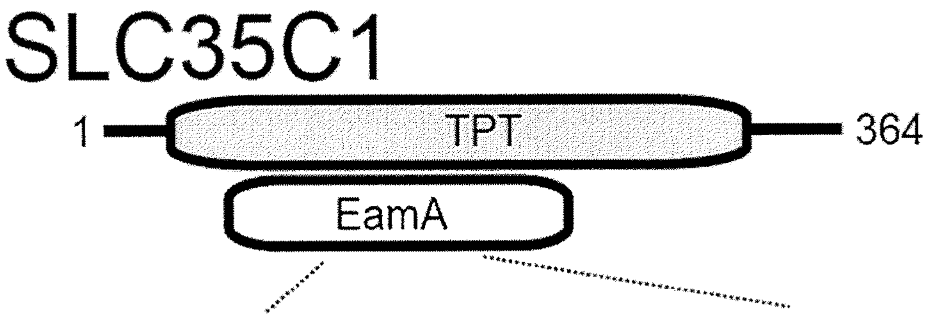

| | |
|---|---|
| Erinaceus | TAKACAQTVLAVLHYEEAKSFLWWASNLMVLGGSFAYTWVRGWEMKRVQEEPGPREDQKS |
| Monodelphis | TAKACAQTVLAVLYFNETKSFLWWTSNLMVLGGSSAYTWVKGLEMKKAQGEPSPKEGEKD |
| Sarcophilus | TAKACAQTVLAVLYFEETKSFLWWTSNLMVLGGSSAYTWVKGLEMKKAQEELAPREGEKG |
| Tursiops | TAKACAQTVLAVLYYEETKSFLWWMSNMMVLGGSSAYTWVRGWEMKKIQEEPRPKEDEKS |
| Echinops | TAKACAQTVLAVXXXXXXXXXXXXXXXMMVLGGSWAYTCVRGWEMKKVQEEPSPKEDEKS |
| Ornithorhynchus | TAKACAQTVLAVLGYEETKSFLWWTSNMMVLGGSSAYTWVKGLEMKKAQEEPGPKAGEKG |
| Rattus | TAKACAQTVLAVLYYEEIKSFLWWTSNLMVLGGSSAYTWVRGWEMQKTQEDPSSKEGEKS |
| Mus | TAKACAQTVLAVLYYEEIKSFLWWTSNLMVLGGSSAYTWVRGWEMQKTQEDPSSKDGEKS |
| Dasypus | TAKACAQTVLAVLYFEETKSLLWWTSNMMVLGGSSTYTWVRGWEMKKVQEEPSPREDEKN |
| Ovis | TAKACAQTVLAVLYYEEAKSFLWWTSNMMVLGGSSAYTWVRGREMKKTQEEPHPRENEKS |
| Bos | TAKACAQTVLAVLYYEEAKSFLWWTSNMMVLGGSSAYTWVRGREMKKTQEEPHPRENEKS |
| Otolemur | TAKACAQTVLAVLYYEETKSFLWWTSNMMVLGGSSAYTWVRGWEMKKTQEEPSPKEDEKS |
| Microcebus | TAKACAQTVLAVLYYEETKSFLWWTSNMMVLGGSSAYTWVRGWEMKKTQEEPSPKEGEKS |
| Loxodonta | TAKACAQTVLAVLYYEETKSFLWWTSNMMVLGGSSAYTWVRGWEMKKVQEEPSPKEGEKS |
| Procavia | TAKACAQTVLAVLYYEETKSFLWWTSNMMVLGGSSAYTWVRGWEMKKLQEEPSPRESEKI |
| Dipodomys | TAKACAQTVLAVLYYEETKSFLWWTSNLMVLGGSSAYTWVRGWEMKKTPEDPSPKEGEKS |
| Ictidomys | TAKACAQTVLAVLYFEETKSFLWWTSNAMVLGGSSAYTWVRGWEMK-SQEDPGPREGEKS |
| Ochotona | TAKACAQTVLAVLYYEETKSFLWWTSNLMVLGGSSAYTWVRGWEMQKVQHDPSPKENEKS |
| Oryctolagus | TAKACAQTVLAVLYYEEAKSFLWWTSNLMVLGGSSAYTWVRGWEMKKEQEDPSPKEGDKS |
| Cavia | TAKACFQTVLAVLYYEETKSFLWWTSNLMVLGGSSAYTWVRGWEMKKVQEDPSPREDEKS |
| Pteropus | TAKACAQTVLAVLYYEETKSFLWWTSNMMVLGGSSAYTWVRGWEMKKIQEDPSPKEDEKS |
| Canis | TAKACAQTVLAVLYYEETKSFLWWTSNMMVLGGSSAYTWVRGWEMKKIQEDPSPKEDEKS |
| Felis | TTKACAQTVLAVLYYEETKSFLWWTSNMMVLGGSSAYTWVRGWEMKKIQEEPSPKEDEKS |
| Mustela | TAKACAQTVLAVLYYEETKSFLWWTSNMMVLGGSSAYTWVRGWEMKKIQEEPSPKEEEKS |
| Ailuropoda | TAKACAQTVLAVLYYEETKSFLWWTSNMMVLGGSSAYTWVRGWEMKKIQEEPSPKEEEKS |
| Myotis | TAKACAQTVLAVLYYEETKSFLWWTSNMMVLGGSSAYTWVRGWEMKKVQEEPSPKDNEKS |
| Equus | TAKACAQTVLAVLYYEDTKSFLWWTSNMMVLGGSSAYTWVRGWEMKKVQEEPSPKEEEKS |
| Tarsius | TAKACAQTVLAVLYYEETKSFFWWMSNMMVLGGSSAYTWVRGWEMKKTQEEPSPKEDEKS |
| Chlorocebus | TAKACAQTVLAVLYYEEAKSFLWWTSNMMVLGGSSAYTWVRGWEMKKIPEEPSPKEGEKS |
| Macaca | TAKACAQTVLAVLYYEEAKSFLWWTSNMMVLGGSSAYTWVRGWEMKKIPEEPSPKEGEKS |
| Papio | TAKACAQTVLAVLYYEEAKSFLWWTSNMMVLGGSSAYTWVRGWEMKKIPEEPSPKEGEKS |
| Callithrix | TAKACAQTVLAVLYYEETKSFLWWTSNMMVLGGSSAYTWVRGREMKKTPEELSPKEGEKS |
| Gorilla | TAKACAQTVLAVLYYEETKSFLWWTSNMMVLGGSSAYTWVRGWEMKKTPEEPSPKDSEKS |
| Pan | TAKACAQTVLAVLYYEETKSFLWWTSNMMVLGGSSAYTWVRGWEMKKSPEEPSPKDSEKS |
| Homo | TAKACAQTVLAVLYYEETKSFLWWTSNMMVLGGSSAYTWVRGWEMKKTPEEPSPKDSEKS |
| Pongo | TAKACAQTVLAVLYYEETKSFLWWTSNMMVLGGSSAYTWVRGWEMKKTPEEPSPKEGEKS |
| Nomascus | TAKACAQTVLAVLYYEETKSFLWWTSNMMVLGGSSAYTWVRGWEMKKTQEEPSPKEGEKS |

FIG. 20C

FIG. 27A
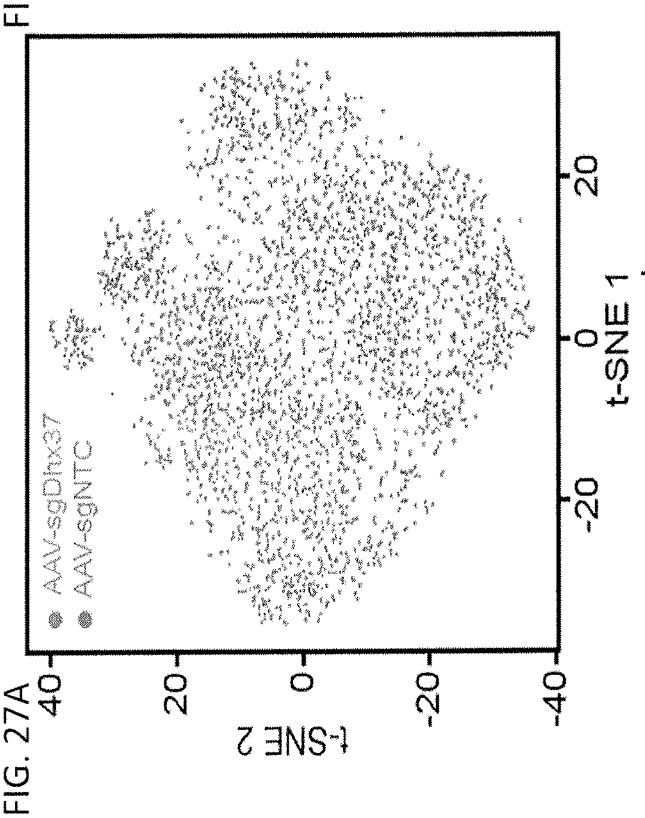
FIG. 27B
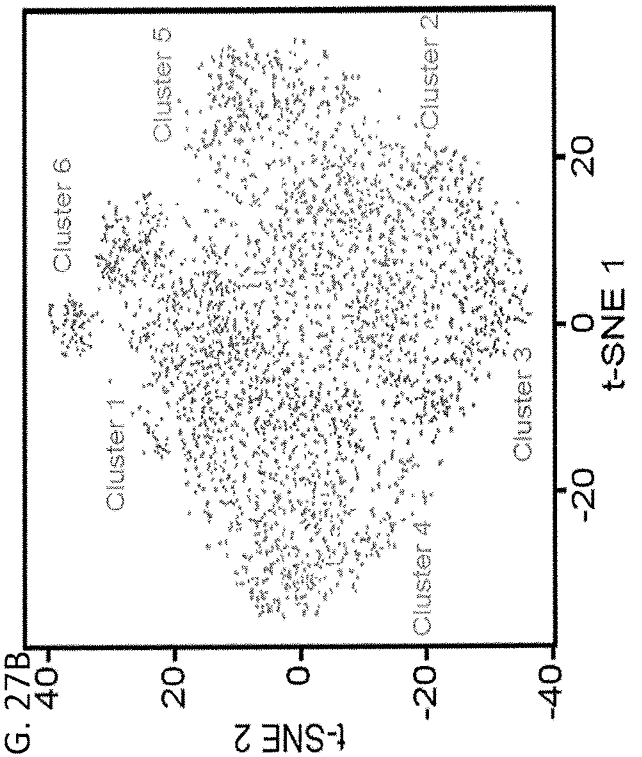
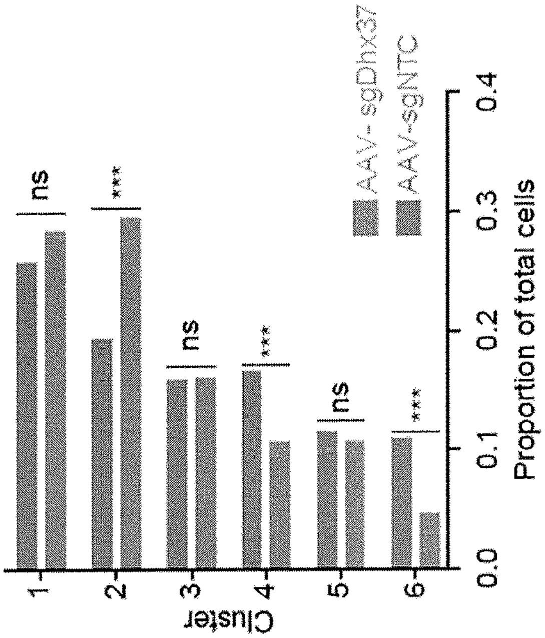
FIG. 27C

| Term | P Value |
|---|---|
| GO:0006954~inflammatory response | 3.53E-04 |
| GO:0006955~immune response | 4.52E-04 |
| GO:0043066~negative regulation of apoptotic process | 1.02E-03 |
| GO:0010951~negative regulation of endopeptidase activity | 2.20E-03 |
| GO:0048305~immunoglobulin secretion | 2.80E-03 |
| GO:0071333~cellular response to glucose stimulus | 3.11E-03 |
| GO:0031295~T cell costimulation | 4.90E-03 |

PLATFORM FOR T LYMPHOCYTE GENOME ENGINEERING AND IN VIVO HIGH-THROUGHPUT SCREENING THEREOF

CROSS-REFERENCE TO RELATED APPLICATION

The present application is a 35 U.S.C. § 371 national phase application from, and claims priority to, International Application No. PCT/US2018/027967, filed Apr. 17, 2018, and published under PCT Article 21(2) in English, which is entitled to priority under 35 U.S.C. § 119(e) to U.S. Provisional Patent Application No. 62/602,290 filed Apr. 18, 2017, each of which is incorporated herein by reference in its entirety.

STATEMENT REGARDING FEDERALLY SPONSORED RESEARCH OR DEVELOPMENT

This invention was made with government support under CA209992, CA121974, CA196530, and GM007205 awarded by the National Institutes of Health. The government has certain rights in the invention.

REFERENCE TO AN ELECTRONIC SEQUENCE LISTING

The Sequence Listing submitted herewith as an ASCII txt file named "047162-7121US1," created on Apr. 22, 2023 and having a size of 30,645 bytes, is herein incorporated by reference in its entirety.

SEQUENCE LISTING

The instant application contains a Sequence Listing which has been submitted in ASCII format via EFS-Web and is hereby incorporated by reference in its entirety. Said ASCII copy, created on Mar. 20, 2020, is named 047162-7121US1_SequenceListing_ST25.txt and is 29,900 kilobytes in size.

BACKGROUND OF THE INVENTION $CD8^+$ T cells play a central role in maintaining the cellular integrity of the body by mounting cell-mediated adaptive immune responses against intracellular pathogens and tumors. Selective activation of pathogen-specific $CD8^+$ T cells is mediated by the recognition of cognate antigen on surface major histocompatibility complex (MHC) class I (MHC-I), which results in T cell proliferation, cytokine secretion, and the selective killing of target cells. Defects in this cell population can lead to recurrent infections or cancer, while dysregulated activation of $CD8^+$ T cells can cause autoimmunity and severe immunopathology.

$CD8^+$ T cells have become the focus of many new cancer therapeutics due to their specificity for intracellular antigens and their role in cell-mediated immune responses. The most potent drugs recently developed are immune checkpoint inhibitors. This new class of drugs enhances the anti-tumor response of $CD8^+$ T cells by neutralizing the activity of CTLA-4 or PD-1. Blocking the activity of CTLA-4 permits the activation of naive $CD8^+$ T cells in the absence of sufficient antigen. Inhibiting PD-1 activity reinvigorates exhausted $CD8^+$ T cells to proliferate and kill malignant cells. These drugs have been shown to be effective in treating multiple cancer types including melanoma and lung cancer. Ongoing studies are being conducted looking at the efficacy of these drugs used either as monotherapy or in combinations. Further studies have identified 4-1BB, CD27, CD28, ICOS, LAG3, OX-40, TIM3, and VISTA for potential checkpoint modulation. Newer therapeutics have adapted $CD8^+$ T cell machinery to activate under the control of a transgenically expressed chimeric antigen receptor (CAR-T). This method has proven to be effective at treating hematopoietic malignancies. Although checkpoint blockade and CAR-T immunotherapies have been shown to be effective when conventional therapies have failed, these modes of therapy are still in early stage of development, as a large fraction of patients do not respond or have undesired side effects. More systematic approaches shall be used to identify new regulators of T cell functions to better enhance the body's anti-tumor response.

Studies using gene-set specific RNAi/shRNA libraries have been used to identify novel T cell genes that enhance $CD8^+$ T cell function and cytokine production. These molecular tools operate by suppressing the translation of targeted mRNA through complementary binding, but the effects of RNAi are limited by the expression levels of the targeted mRNA as well as the introduced small interfering RNA.

The development and application of CRISPR technologies have dramatically enhanced the ability to perform genome editing. High-throughput genetic screens have been developed and utilized for discovery of novel genes in multiple applications. Application of CRISPR targeting in T cell is a first step to manipulate its genome, which, together with the screening technology, leads to the hypothesis that high-throughput genetic screening will open the door for unbiased discovery of key factors in T cell biology in a massively parallel manner. However large-scale genome editing of T cells have not been reported, possibly due to multiple technological obstacles, the complexity of lymphocyte repertoires, the tissue architecture of lymphoid or non-lymphoid organs, or the tumor microenvironment.

There is a need in the art for compositions and methods that can be used for large-scale genome editing in T cells. The present invention satisfies this need.

SUMMARY OF THE INVENTION

As described herein, the present invention relates to compositions and methods for T cell genome editing and screening in vitro and in vivo.

One aspect of the invention includes a vector comprising a 5' long terminal repeat (LTR) sequence, a U6 promoter sequence, a BsmB1 restriction site, an EFS sequence, an sgRNA expression cassette, a Thy1.1 cassette, a 3' LTR sequence and an ampicillin resistance gene sequence (AmpR).

Another aspect of the invention includes an sgRNA library comprising a plurality of vectors, wherein each vector comprises an expression cassette for an sgRNA comprising a nucleotide sequence selected from the group consisting of SEQ ID NOs: 1-129,209.

Yet another aspect of the invention includes an sgRNA library comprising a plurality of vectors, wherein each vector comprises an expression cassette for an sgRNA comprising a nucleotide sequence selected from the group consisting of SEQ ID NOs: 129,222-140,680.

Another aspect of the invention includes a method of performing genome editing and screening of a T cell in vitro. The method comprises contacting the T cell with Cas9 and an sgRNA library. The sgRNA library comprises a plurality of vectors, wherein each vector comprises an expression cassette for an sgRNA comprising a nucleotide sequence selected from the group consisting of SEQ ID NOs: 1-129,209. The T cell undergoes genome editing and the T cell is screened in vitro.

Still another aspect of the invention includes a method of performing genome editing and screening of a T cell in vitro. The method comprises contacting the T cell with Cas9 and an sgRNA library. The sgRNA library comprises a plurality of vectors, wherein each vector comprises an expression cassette for an sgRNA comprising a nucleotide sequence selected from the group consisting of SEQ ID NOs: 129,222-140,680. The T cell undergoes genome editing and the T cell is screened in vitro.

Yet another aspect of the invention includes a method of performing genome editing and screening of a T cell in vivo. The method comprises contacting an isolated T cell with Cas9 and an sgRNA library. The sgRNA library comprises a plurality of vectors, wherein each vector comprises an expression cassette for an sgRNA comprising a nucleotide sequence selected from the group consisting of SEQ ID NOs: 1-129,209. The T cell undergoes genome editing to generate a modified T cell. The modified T cell is administered to an animal and the T cell is screened in vivo.

Another aspect of the invention includes a method of performing genome editing and screening of a T cell in vivo. The method comprises contacting an isolated T cell with Cas9 and an sgRNA library. The sgRNA library comprises a plurality of vectors, wherein each vector comprises an expression cassette for an sgRNA comprising a nucleotide sequence selected from the group consisting of SEQ ID NOs: 129,222-140,680. The T cell undergoes genome editing to generate a modified T cell. The modified T cell is administered to an animal and the T cell is screened in vivo.

In some embodiments, Cas9 is encoded in a vector. In some embodiments, Cas9 is a protein.

Still another aspect of the invention includes a kit comprising an sgRNA library comprising a plurality of vectors, wherein each vector comprises an expression cassette for an sgRNA comprising a nucleotide sequence selected from the group consisting of SEQ ID NOs: 1-129,209, and instructional material for use thereof.

Yet another aspect of the invention includes a kit comprising an sgRNA library comprising a plurality of vectors, wherein each vector comprises an expression cassette for an sgRNA comprising a nucleotide sequence selected from the group consisting of SEQ ID NOs: 129,222-140,680, and instructional material for use thereof.

Another aspect of the invention includes a vector comprising a 5' long terminal repeat (LTR) sequence, a U6 promoter sequence, a BsmB1 restriction site, an EFS sequence, an sgRNA expression cassette, an mCherry sequence, a 2A peptide, a cOVA sequence, a 3' LTR sequence and an ampicillin resistance gene sequence (AmpR).

Still another aspect of the invention includes a vector comprising a 5' inverted terminal repeat (ITR) sequence, a U6 promoter sequence, a BbsI restriction site, an sgRNA expression cassette, an EFS sequence, a SB100x cassette, a 3' ITR sequence and an ampicillin resistance gene sequence (AmpR).

Yet another aspect of the invention includes a vector comprising a 5' inverted terminal repeat (ITR) sequence, a U6 promoter sequence, a BbsI restriction site, an sgRNA expression cassette, an EFS sequence, a SB100x cassette, a Thy1.1 cassette, a 3' ITR sequence and an ampicillin resistance gene sequence (AmpR).

Another aspect of the invention includes a vector comprising a 5' inverted terminal repeat (ITR) sequence, a U6 promoter sequence, a BbsI restriction site, an sgRNA expression cassette, a 3' ITR sequence and an ampicillin resistance gene sequence (AmpR).

Still another aspect of the invention includes a vector comprising a 5' inverted terminal repeat (ITR) sequence, a U6 promoter sequence, a BbsI restriction site, an sgRNA expression cassette, an EFS sequence, a Thy1.1 cassette, a 3' ITR sequence and an ampicillin resistance gene sequence (AmpR).

Yet another aspect of the invention includes a vector comprising a 5' inverted terminal repeat (ITR) sequence, a U6 promoter sequence, a BbsI restriction site, an sgRNA expression cassette, an EFS sequence, a SB100x cassette, a GFP-NLS fusion cassette, a 3' ITR sequence and an ampicillin resistance gene sequence (AmpR).

In various embodiments of the above aspects or any other aspect of the invention delineated herein, the vector comprises the nucleic acid sequence selected from the group consisting of SEQ ID NO: 129,213, SEQ ID NO: 129,214, and SEQ ID NO: 129,215.

In one embodiment, the sgRNA expression cassette expresses an sgRNA comprising a nucleotide sequence selected from the group consisting of SEQ ID NOs: 1-129,209. In another embodiment, the sgRNA expression cassette expresses an sgRNA comprising a nucleotide sequence selected from the group consisting of SEQ ID NOs: 129,222-140,680. In yet another embodiment, the sgRNA expression cassette expresses an sgRNA consisting of a nucleotide sequence selected from the group consisting of SEQ ID NOs: 1-129,209. In still another embodiment, the sgRNA expression cassette expresses an sgRNA consisting of a nucleotide sequence selected from the group consisting of SEQ ID NOs: 129,222-140,680.

In one embodiment, each vector comprises an expression cassette for an sgRNA consisting of a nucleotide sequence selected from the group consisting of SEQ ID NOs: 1-129,209. In another embodiment, each vector comprises an expression cassette for an sgRNA consisting of a nucleotide sequence selected from the group consisting of SEQ ID NOs: 129,222-140,680.

In one embodiment, the plurality of vectors comprise a 5' long terminal repeat (LTR) sequence, a U6 promoter sequence, a BsmB1 restriction site, an EFS sequence, an sgRNA expression cassette, a Thy1.1 cassette, a 3' LTR sequence and an ampicillin resistance gene sequence (AmpR).

In one embodiment, the T cell is selected from the group consisting of: a CD8+ cell, a CD4+ cell, or a T regulatory (Treg) cell, a Th1 cell, a Th2 cell, a Th17 cell, a follicular helper T cell (Tfh), a T memory cell, a T effector cell, a T effector memory cell, an engineered T cell, and a CART cell.

In one embodiment, the method further comprises isolating and/or enriching a modified T cell.

In one embodiment, the animal is a human. In one embodiment, the condition is cancer.

In one embodiment, the screening provides information about a gene involved in a condition afflicting the animal. In another embodiment, screening comprises at least one method selected from the group consisting of nucleotide sequencing, sgRNA PCR, and flow cytometry.

In one embodiment, the kit further comprises Cas9. In some embodiments, Cas9 is encoded in a vector. In some embodiments, Cas9 is a protein.

In one embodiment, the vector comprises the nucleic acid sequence of SEQ ID NO: 129,216. In another embodiment, the vector comprises the nucleic acid sequence of SEQ ID NO: 129,217. In yet another embodiment, the vector comprises the nucleic acid sequence of SEQ ID NO: 129,218. In still another embodiment, the vector comprises the nucleic acid sequence of SEQ ID NO: 129,219. In one embodiment, the vector comprises the nucleic acid sequence of SEQ ID NO: 129,220. In another embodiment, the vector comprises the nucleic acid sequence of SEQ ID NO: 129,221.

BRIEF DESCRIPTION OF THE DRAWINGS

The following detailed description of specific embodiments of the invention will be better understood when read in conjunction with the appended drawings. For the purpose of illustrating the invention, there are shown in the drawings exemplary embodiments. It should be understood, however, that the invention is not limited to the precise arrangements and instrumentalities of the embodiments shown in the drawings.

FIG. 1A is a schematic of the design of a T cell CRISPR knockout vector, which contains an sgRNA expression cassette and a Thy1.1 expression cassette. FIG. 1B shows the schematics of an experiment described herein involving: library cloning, virus production, naive $CD8^+$ T cell isolation and infection, adoptive transfer, and CRISPR-targeted $CD8^+$ $T_{eff}$ cell survival analysis in organs by high-throughput sgRNA sequencing. Organs collected include the liver, pancreas, lung, muscle and brain as representative non-lymphoid organs, and the spleen and several types of lymph nodes (LNs) as lymphoid organs. The LNs collected include three groups: LN1—skin draining lymph nodes (sLNs) that are comprised of inguinal, axillary, and brachial lymph nodes; LN2—cervical lymph nodes (cLNs) that entail the 6 superficial lymph nodes; and LN3—abdominal lymph nodes (aLNs) include the mesenteric and the pancreatic lymph nodes. FIG. 1C is a set of FACS plots showing naive Cas9 $CD8^+$ T cell infectivity with lentivirus encoding the genome-scale CRISPR library (MKO). Thy1.1 surface staining shows a population of transduced T cells with a significantly elevated Thy1.1 expression compared to untransduced. FIG. 1D is a dot plot of the number of detected sgRNAs for all organ samples, grouped by organ type. Number of samples for each type are: LN (n=20 total, 3 per mouse, 7 mice total. LN3 is not available for m4), spleen, brain, liver, lung, muscle and pancreas (n=7 each, one per mouse, 7 mice total). Data are shown as mean±s.e.m. FIGS. 1E-1F are pie charts of sgRNA compositions in representative organs. SgRNAs that comprised ≥2% of total reads for each sample are shown, with the remaining reads classified as “Other.” For clarity, only the gene names associated with each sgRNA are shown. Monoclonal (one major clones with >=90% of total reads), oligoclonal (3 to 10 major clones each with >=2% of total reads) and polyclonal (more than 10 clones with 2% or more reads) compositions of T cell variants exist in various organs such as LN, spleen, liver, pancreas, lung, brain and muscle. FIG. 1G is a box-dot plot of overall sgRNA library representation in all samples, including plasmid library (blue, n=1), cellular libraries of pre-injection library-infected naive $CD8^+$ T cells (green, n=3), and various organs containing $CD8^+$ $T_{eff}$ cells from multiple mice 7 days post-injection (orange, n=7 mice, 62 total samples). SgRNA representation is depicted in terms of $\log_2$ reads per million (rpm). Analyzed tissues include the lymph node (LN), spleen, brain, liver, lung, muscle, and pancreas. FIG. 1H shows correlation analysis of sgRNA library representation in all samples from the genome-scale screen for trafficking and survival in $CD8^+$ T cells with diverse TCR. Heatmap of pairwise Pearson correlations of sgRNA library representation across all samples in the first WT screen using Cas9 $CD8^+$ T cells that have a diverse TCR repertoire. Samples included plasmid library (n=1), cellular libraries of pre-injection library-infected naive $CD8^+$ T cells (n=3), and various organs containing CD8+ $T_{eff}$ cells from multiple mice 7 days post-injection (n=7 mice, 62 total samples). Correlations were calculated based on $\log_2$ rpm values. Cell and plasmid samples were highly correlated with each other, while organ samples were mostly correlated with other organ samples. FIG. 1I is a waterfall plot of the top sgRNAs across all organs ranked by number of organs being enriched in (FDR<0.5%). Inset shows all sgRNAs significantly enriched in ≥20% of organ samples. FIG. 1J is a barplot of the number of genes with 0, 1, 2 or 3 independent sgRNAs that were significantly enriched in at least one organ sample (FDR<0.5%). A total of 115 genes were found to have at least 2 independent sgRNAs enriched. Cd247, Bpifb3, and Tsc2 were found to have 3 independent enriched sgRNAs. FIG. 1K is a Venn diagram of the three enrichment criteria to identify the top gene hits (≥2% read abundance in one sample (n=227), significant in ≥20% of samples (considering all associated sgRNAs) (n=118), and ≥2 independent enriched sgRNAs (n=115)). A total of 11 genes satisfied all three criteria (Apc, Cd247, Csnk1a1, Fam103a1, Fam134b, Nf1, Pdcd1, Phf21a, Prkar1a, Rab11b, and Tsc2).

FIG. 2A is a dot plot of the number of significantly enriched sgRNAs for all organ samples, grouped by organ type. Statistical significance of sgRNA enrichment was determined by comparison to NTCs, with a threshold of FDR<0.2%. The number of significantly enriched sgRNAs varied between samples, ranging from 10 to 392. Data are shown as mean±s.e.m. FIG. 2B is a heatmap of the most highly enriched sgRNAs across all lymph node samples (average log2 rpm>=1); rows correspond to sgRNAs and columns correspond to different organ samples. SgRNA abundances are depicted in terms of log2 rpm. FIG. 2C is a waterfall plot of the top-ranked sgRNAs across all organs (FDR<0.2%). Inset shows 36 sgRNAs significantly enriched in ≥50% of organ samples. FIG. 2D is a bar plot of the number of genes with 0, 1, 2 or 3 independent sgRNAs that were significantly enriched in at least one organ sample (FDR<0.2%). A total of 80 genes were found to have 2 independent sgRNAs enriched. Pdcd1, Slc35c1, and Tsc2 were found to have 3 independent enriched sgRNAs. FIG. 2E is a set of Venn diagrams of the three enrichment criteria to identify the top gene hits (≥2% read abundance in one sample (n=253), significant in ≥25% of samples (n=79), and ≥2 independent enriched sgRNAs (n=83)). A total of 9 genes satisfied all three criteria. These genes included Aim1, Apc, Csnk1a1, Fam103a1, Nf1, Pdcd1, Prkar1a, Spast, and Tsc2. FIG. 2F: Top panel: Venn diagram comparing the significantly enriched sgRNAs (FDR<0.2%) in lymphoid vs. non-lymphoid organs. A total of 1,566 sgRNAs were enriched in at least one lymphoid sample, while 1,332 sgRNAs were enriched in at least one non-lymphoid sample. Of these, 761 sgRNAs were enriched in both lymphoid and non-lymphoid samples (significance of overlap, p≈0 by hypergeometric test); bottom panel: Venn diagram comparing the significantly enriched sgRNAs in lymph node vs. spleen. A total of 1,426 sgRNAs were found to be enriched in at least one lymph node, while 360 sgRNAs were enriched in at least one spleen sample. Of these, 220 sgRNAs were enriched in both lymph node and spleen samples (significance of overlap, p≈0 by hypergeometric test). FIG. 2G is a 5-way Venn diagram of enriched sgRNAs in non-lymphoid tissues (brain, liver, lung, muscle, pancreas). A total of 83 sgRNAs were enriched in all 5 non-lymphoid organs.

FIG. 3A is a schematic of an experiment described herein involving: crossing an OT-I mouse to a Cas9 mouse, naïve $CD8^+$ T cell isolation from OT-I; Cas9 mice, $CD8^+$ T cell transduction, adoptive transfer into E0771-mCh-cOVA tumor-bearing $Rag1^{-/-}$ mice, $CD8^+$ $T_{eff}$ cell survival and infiltration analysis in draining lymph nodes, non-draining lymph node, spleen, and tumor of E0771-mCh-cOVA tumor-bearing $Rag1^{-/-}$ mice by FACS. FIG. 3B shows titration of SIINFEKL (SEQ ID NO: 129,210) peptide for MHC-I presentation in E0771 cells. E0771 cells were pulsed with different concentrations of SIINFEKL peptide, and the MHC-I—peptide complex (SIINFEKL:H-K2b) was measured by mean fluorescent intensity (MFI) of surface staining using FACS. FIG. 3C shows measurement of antigen presentation in E0771-mCh-cOVA cell lines. E0771 cells were transduced with a lentiviral vector encoding mCherry-2A-cOVA transgene, and multiple clonal lines were generated by single cell cloning. MHC-I—peptide complex (SIINFEKL: H-K2b) was measured by mean fluorescent intensity (MFI) of surface staining using FACS. FIG. 3D is a growth curve of mammary fatpad transplanted E0771-mCh-cOVA tumors in $Rag1^{-/-}$ mice following different treatments. PBS control (n=3), adoptive transfer of OT-I; Cas9 $CD8^+$ $T_{eff}$ cells infected with vector (n=3), and adoptive transfer of OT-I; Cas9 $CD8^+$ $T_{eff}$ cells infected with MKO (n=8). Arrow indicates the time of adoptive transfer of MKO or vector transduced OT-I; Cas9 $CD8^+$ $T_{eff}$ cells. Data are shown as mean±s.e.m. FIG. 3E shows representative FACS plots of adoptively transferred $T_{eff}$ cells in draining and non-draining LNs (dLN and ndLN, respectively), spleen, lung, and tumor (TILs) from E0771-mCh-cOVA tumor-bearing $Rag1^{-/-}$ mice. FIG. 3F shows quantitative analysis of FACS data of adoptively transferred OT-I; Cas9 $CD8^+$ $T_{eff}$ cells in dLN, ndLN, spleen, lung, and tumor from E0771-mCh-cOVA tumor-bearing $Rag1^{-/-}$ mice. Data are shown as mean±standard deviation.

FIG. 4A is a schematic of an experiment described herein involving: crossing an OT-I mouse to a Cas9 mouse to generate OT-I; Cas9 mice, T cell isolation from spleen and LNs of OT-I; Cas9 mice, T cell transduction with MKO library, adoptive transfer into E0771-mCh-cOVA tumor-bearing $Rag1^{-/-}$ mice, and T cell library representation analysis in organs by sgRNA library sequencing. FIG. 4B is a box-dot plot of overall sgRNA library representation in all samples, including cellular libraries of infected OT-I; Cas9 $CD8^+$ $T_{eff}$ cells before infection (n=3), and various tissues from multiple mice (n=5 mice, 25 total samples). SgRNA representation is depicted in terms of $\log_2$ rpm. Analyzed tissues include draining lymph nodes (dLN), non-draining lymph nodes (ndLN), spleen, lung, and tumor. FIG. 4C is a bar plot of number of detected sgRNAs for all in vivo samples, grouped by sample type. Number of samples for each type are: dLN, ndLN, spleen, lung, and tumor (n=5 each, one per mouse, 5 mice total). FIG. 4D shows pie charts of sgRNA compositions in representative organs. SgRNAs that comprised ≥2% of total reads for each sample are shown, with the remaining reads classified as "Other. " FIG. 4E is a heatmap of the most highly enriched sgRNAs across all tissues (average $\log_2$ rpm≥1), where rows correspond to sgRNAs and columns correspond to different organ or tumor samples. The tissue type of each sample is annotated at the top of the heatmap. Each sample was further classified as lymphoid, nonlymphoid, or tumor to facilitate downstream analyses. SgRNA abundances are depicted in terms of $\log_2$ rpm. FIG. 4F is a bar plot of the number of significantly enriched sgRNAs for all in vivo samples, grouped by sample type as in FIG. 4C. Statistical significance of sgRNA enrichment was determined by comparison to NTCs, with a threshold of FDR<0.2%. The number of significantly enriched sgRNAs varied between samples, ranging from 7 to 179. FIG. 4G is a box-dot plot of overall sgRNA library representation in all samples, including cellular libraries of infected OT-I; Cas9 $CD8^+$ $T_{eff}$ cells before injection (n=3), and tumors from multiple mice (n=10 mice, 10 total tumors). sgRNA representation is depicted in terms of $\log_2$ rpm. FIG. 4H is a waterfall plot of the top-ranked sgRNAs across all tumors (21 sgRNAs significantly enriched in ≥50% of tumors, FDR<0.5%). Inset, waterfall plot of all sgRNAs that were significantly enriched in ≥20% of tumors. FIG. 4I is a barplot of the number of genes with 0-4 independent sgRNAs that were significantly enriched in at least one organ sample (FDR<0.5%). A total of 26 genes were found to have at least 2 independent sgRNAs enriched. Pdcd1 and Stradb were each found to have 4 independent enriched sgRNAs. FIG. 4J is a Venn diagram of the three enrichment criteria to identify the top gene hits (≥2% read abundance in one sample (n=36), significant in ≥20% of samples (n=220), and ≥2 independent enriched sgRNAs (n=26)). A total of 6 genes satisfied all three criteria (Cd247, Fam103a1, Hacvr2, Pdcd1, Prkar1a, and Stradb).

FIGS. 5A-5G are a series of plots and images illustrating significantly enriched sgRNAs and genes of MKO mutagenized OT-I; Cas9 $CD8^+$ $T_{eff}$ cells in $Rag1^{-/-}$ mice with transplanted tumors expressing cOVA antigen. FIG. 5A is a scatter plot of sgRNA abundance average across all organ samples (n=20) compared to cell samples (n=3). SgRNA abundance is depicted in terms of $\log_2$ rpm. SgRNAs that were found to be statistically significantly (Sig., compared to distribution of NTC, FDR<0.1%) have their target gene names labeled. FIG. 5B is a scatter plot of sgRNA abundance in tumor (average across all tumor samples, n=5) compared to in vitro (average across all cell samples, n=5). SgRNA abundance is depicted in terms of $\log_2$ rpm. SgRNAs that were found to be statistically significantly higher in organ samples compared to cell samples (Benjamini-Hochberg adjusted p-value<0.05, t-test) are colored in pink, with gene names labeled. FIG. 5C is a waterfall plot of the top-ranked sgRNAs across all organs (11 sgRNAs. significantly enriched in ≥50% of samples, FDR<0.2%). FIG. 5D shows DAVID gene ontology analysis of all genes found to be enriched in organ or tumor samples (showing enriched GO terms, the number of enriched genes corresponding to each GO term, and the associated p-value of enrichment). FIG. 5E is a 3-way Venn diagram comparing the significantly enriched sgRNAs (FDR<0.2%) in lymphoid, non-lymphoid, and tumor samples. A total of 392 sgRNAs were found to be enriched in at least one lymphoid sample, 320 sgRNAs were enriched in at least one non-lymphoid sample, and 395 sgRNAs were enriched in at least one tumor sample. The sgRNAs associated with each of the three groups were found to significantly overlap (lymphoid vs. non-lymphoid, $p=2.11\times10^{-159}$; lymphoid vs. tumor, $p=3.02\times10^{-88}$; non-lymphoid vs. tumor, $p=1.97\times10^{-137}$, hypergeometric test). FIG. 5F is a 3-way Venn diagram comparing the significantly enriched sgRNAs in draining lymph node (dLN), non-draining lymph node (ndLN), and spleen samples. A total of 90 sgRNAs were found to be enriched in at least one dLN sample, 148 sgRNAs were enriched in at least one ndLN sample, and 278 sgRNAs were enriched in at least one spleen sample. The sgRNAs associated with each of the three groups were found to significantly overlap (dLN vs. ndLN, $p=6.07\times10^{-317}$; dLN vs. spleen, $p=2.58\times10\times10$; ndLN vs. spleen, $p=2.01\times10^{-263}$, hypergeometric test). FIG. 5G is a 2-way Venn diagram comparing the hits from the second screen (OT-I; Cas9 $CD8^+$ $T_{eff}$ cells in $Rag1^{-/-}$ host bearing tumors with cOVA antigen) to the first screen (Cas9 $CD8^+$ T cells in WT host), showing a highly significant overlap (hypergeometric test, $p=1\times10^{-23}$). Shared genes including multiple immune genes (such as Tim3/Havcr2, Lexm/BC055111, Zap70, Cd247 and PD-1/Pdcd1), a couple tumor suppressor genes (Aim1 and Nf1), as well as many genes with undocumented function in $CD8^+$ T cells or completely unknown genes (such as Shisa6, Siah3, Ccdc105, Ccdc81 and 3830406C13Rik).

FIGS. 6A-6D are a series of plots and images illustrating the validation of a selected set of significantly enriched genes using minipools mutagenized OT-I; Cas9 $CD8^+$ T cells intravenously injected into WT mice. FIG. 6A is a schematic of an experiment described herein involving: minipool library cloning, virus production, T cell infection, adoptive transfer, $CD8^+$ $T_{eff}$ cell survival analysis in organs by sgRNA library sequencing. FIG. 6B is an overall heatmap of the abundances of each sgRNA represented in the minipool library; rows correspond to sgRNAs and columns correspond to different cell or organ samples. The tissue type of each sample and host mouse genotype is annotated at the top of the heatmap. Each sample was further classified as cells, lymphoid, or non-lymphoid to facilitate downstream analyses. SgRNA abundances are depicted in terms of $\log_2$ rpm. FIG. 6C is a dot plot of all minipool sgRNAs across all cell and organ samples. Cells are denoted in pink, lymphoid samples in green, and non-lymphoid samples in blue. SgRNA abundances are depicted in terms of $\log_2$ rpm. FIG. 6D is a Venn diagram comparing the significantly enriched sgRNAs (compared to NTC, Welch t-test, $p<0.05$) in lymphoid vs. non-lymphoid organs. A total of 14 sgRNAs were enriched in non-lymphoid samples, all contained within the 17 sgRNAs enriched in lymphoid sample (significance of overlap, $p=0.0021$ by hypergeometric test).

FIG. 7A shows schematics of an experiment described herein involving: virus production, $CD8^+$ T cell isolation and infection with a genome-scale CRISPR library (MKO), Thy1.1 surface staining, and FACS analysis. FIG. 7B shows FACS plots of naive OT-I; Cas9 $CD8^+$ T cells infection with multiple dilution of MKO lentivirus (Thy1.1 gating) using two batches of viruses collected at different time points. FIG. 7C shows overlaid histograms of Thy1.1 expression of Cas9 $CD8^+$ T cells infected T cells with comparable viral titers from two batches of viruses. Shaded histogram represents uninfected control. Black histogram represents MKO library virus isolated 48 hours post-transfection. Red histogram represents MKO library virus isolated 72 hours post-transfection. FIG. 7D shows quantification of MKO lentivirus from two batches of virus by surface staining of Thy1.1-infected $CD8^+$ T cells. Data were shown as geometric mean of MFI. FIG. 7E shows quantification of MKO lentivirus from two batches of virus by surface staining of Thy1.1-infected $CD8^+$ T cells. Data were shown as % $Thy1.1^+$ $CD8^+$ T cells.

FIGS. 8A-8G are a series of plots and images illustrating overall sgRNA quantification for the analysis of genome-scale CRISPR perturbation of Cas9 $CD8^+$ T cell survival in WT mice. FIG. 8A is a heatmap of pairwise Pearson correlations of sgRNA library representation across all samples in the first screen. Correlations were calculated based on $\log_2$ rpm values. Cell and plasmid samples were highly correlated with each other, while organ samples were most correlated with other organ samples. FIG. 8B is a bar plot of the number of detected sgRNAs for all plasmid (red, n=1), cell (orange, n=3), and organ (blue, n=62) samples. The number of detected sgRNAs is depicted on a $\log_{10}$ scale. While the plasmid library and the cell pool had comparable numbers of detected sgRNAs (average $\log_{10}$ sgRNA count=5.04 and 4.93, respectively), organ samples had fewer detected sgRNAs by several orders of magnitude (average $\log_{10}$ sgRNA count=2.44). FIG. 8C is a bar plot of the number of significantly enriched sgRNAs for all organ samples, grouped by organ type. Statistical significance of sgRNA enrichment was determined by comparison to NTCs, with a threshold of FDR<0.2%. The number of significantly enriched sgRNAs varied between samples, ranging from 10 to 392. FIG. 8D is a heatmap of the most highly enriched sgRNAs across all organs (average $\log_2$ rpm≥1), where rows correspond to sgRNAs and columns correspond to different organ samples. The tissue type of each sample is annotated at the top of the heatmap. Each sample was further classified as lymphoid or nonlymphoid to facilitate downstream analyses. SgRNA abundances are depicted in terms of $\log_2$ rpm. FIG. 8E is a scatter plot of sgRNA abundance in vivo (average across all organ samples, n=62) compared to in vitro (average across all cell samples, n=3). SgRNA abundance is depicted in terms of $\log_2$ rpm. SgRNAs that were found to be statistically significantly higher in organ samples compared to cell samples are colored red (Benjamini-Hochberg adjusted p-value<0.05, t-test), with representative genes labeled. NTCs are colored dark gray, while all other gene-targeting sgRNAs (GTSs) are light gray. FIG. 8F is a volcano plot of sgRNA abundance, comparing lymphoid vs non-lymphoid organs. Only sgRNAs with an average $\log_2$ pm abundance≥1 are shown. The x-axis denotes the average $\log_2$ fold change of lymphoid vs non-lymphoid samples, while the y-axis denotes the $-\log_{10}$ p-value of the comparison (t-test). SgRNAs that were significantly enriched in lymphoid samples relative to non-lymphoid samples are colored red ($p<0.05$). FIG. 8G shows results from gene ontology analysis of all genes found to be enriched in organs (showing enriched GO terms, the number of enriched genes corresponding to each GO term, and the associated p-value of enrichment). A representative set of terms were shown.

" FIG. 9A shows LN1 pie charts. FIG. 9B shows LN2 pie charts. FIG. 9C shows LN3 pie charts. FIG. 9D shows spleen pie charts. FIG. 9E shows liver pie charts. FIG. 9F shows pancreas pie charts. FIG. 9G shows lung pie charts. FIG. 9H shows brain pie charts. FIG. 9I shows muscle pie charts.

FIG. 10A is a schematic of an experiment described herein involving: $CD8^+$ T cell isolation from OT-I; Cas9 mice, $CD8^+$ $T_{eff}$ cell, transduction, adoptive transfer into E0771-mCh-cOVA tumor-bearing $Rag1^{-/-}$ mice, $CD8^+$ $T_{eff}$ cell survival and infiltration analysis in draining lymph nodes, non-draining lymph node, spleen, and tumor of E0771-mCh-cOVA tumor-bearing $Rag1^{-/-}$ mice by FACS. FIGS. 10B-10E are a series of FACS plots showing data from adoptively transferred $T_{eff}$ cells in draining LNs (dLN) (FIG. 10B), non-draining LNs (ndLN) (FIG. 10C), spleen (FIG. 10D), and tumors (TILs) from E0771-mCh-cOVA tumor-bearing $Rag1^{-/-}$ mice (FIG. 10E). MKO is the genome-scale T cell knockout CRISPR library and the empty vector; numbers indicate percentage of total. Top rows are FACS plots from PBS-treated mice. Middle rows are FACS plots from mice treated with vector-infected OT-I; Cas9 $CD8^+$ T cells. Bottom rows are FACS plots from mice treated with MKO-infected OT-I; Cas9 $CD8^+$ T cells. FIG. 10F is a growth curve of subcutaneously transplanted E0771-mCh-cOVA tumors in $Rag1^{-/-}$ mice following different treatments. PBS control (n=1), adoptive transfer of OT-I; Cas9 $CD8^+$ $T_{eff}$ cells infected with vector (n=3), and adoptive transfer of OT-I; Cas9 $CD8^+$ $T_{eff}$ cells infected with MKO (n=5). Read arrow indicates the time of adoptive transfer of MKO or vector transduced OT-I; Cas9 $CD8^+$ $T_{eff}$ cells. Data are shown as mean±s.e.m.

FIG. 11A is a heatmap of pairwise Pearson correlations of sgRNA library representation across all samples. Correlations were calculated based on $\log_2$ rpm values. Cell and plasmid samples were most correlated with each other, while organ and tumor samples were most correlated with other organ or tumor samples. FIG. 11B is a bar plot of the number of detected sgRNAs for all cell (orange, n=3) and organ/tumor (blue, n=25) samples. The number of detected sgRNAs is depicted on a $\log_{10}$ scale. The number of detected sgRNAs in cell samples was several magnitudes higher than in organ/tumor (average $\log_{10}$ sgRNA count=4.91 and 2.73, respectively). FIG. 11C is a bar plot of number of significantly enriched sgRNAs for all organ samples, grouped by sample type (tumor, dLN, ndLN, spleen or lung). Statistical significance of sgRNA enrichment was determined by comparison to NTCs, with a threshold of FDR<0.2%. FIG. 11D is a bar plot of the number of genes with 0, 1, or 2 independent sgRNAs that were significantly enriched in at least one organ sample (FDR<0.2%). 13 genes were found to have 2 independent enriched sgRNAs (yellow box). No genes in this experiment were found to have 3 enriched sgRNAs.

" FIG. 12A shows dLN pie charts. FIG. 12B shows ndLN pie charts. FIG. 12C shows spleen pie charts. FIG. 12D shows tumor pie charts. FIG. 12E shows lung pie charts.

FIG. 13 is a table showing results from a t-test of GTC vs NTC in OT-I; Cas9 $CD8^+$ $T_{eff}$ cell minipool assay for in vivo survival in wildtype mice.

FIGS. 14A-14E show gene identifiers of vectors used in the present study. 14A shows gene identifiers for vector pSC017_pLKO-U6-sgBsmBI-EFS-Thy11CO-spA (SEQ ID NO:129,213). FIG. 14B shows gene identifiers for vector pSC008_pLKO-U6-BsmBI-chRNA(+85)-EFS-Thy11 (SEQ ID NO: 129,214). FIG. 14C shows gene identifiers for vector pSC021_pLKO-U6-sgBsmBI-PGK-Thy11CO-spA.sbd (SEQ ID NO:129,215). FIGS. 14D-14E show gene identifiers for vector pMD02: lenti-pLKO-U6-sgBsmBI-EFS-mCherry-2A-cOVA (SEQ ID NO:129,216).

FIG. 15A is a histogram of initial plasmid library sequencing as library QC. The library was sequenced to ensure high coverage. For at least 94.1% of the whole library (121,608/129,209), unique sgRNAs were cloned into the plasmid, covering 98% of all the annotated genes (22,786) designed in the library. The representation showed a tight log-normal distribution, with 97.6% of sgRNAs within 2 orders of magnitude (O.M.), and 99.9% within 3 O.M. FIG. 15B shows the distribution of cloned sgRNA per gene in the MKO plasmid library. Most (17,330) genes were still covered by 6/6 sgRNAs; 20,653 genes have 4 or more sgRNAs; 393 genes have no sgRNAs (loss in cloning, thus not screenable with this plasmid library). FIG. 15C is a schematic of an experiment comprising: virus production, $CD8^+$ T cell isolation and infection with a genome-scale CRISPR library (MKO), Thy1.1 surface staining, and FACS analysis. FIG. 15D show FACS plots of naive OT-I; Cas9 $CD8^+$ T cell infection with multiple dilutions of MKO lentivirus (Thy1.1 gating) using two batches of viruses collected at different time points. FIG. 15E shows quantification of MKO lentivirus from two batches of virus by surface staining of Thy1.1-infected $CD8^+$ T cells. Data were shown as the geometric mean of MFI. FIG. 15F shows quantification of MKO lentivirus from two batches of virus by surface staining of Thy1.1-infected $CD8^+$ T cells. Data were shown as % Thy1.1$^+$ $CD8^+$ T cells.

FIG. 16A is a box-dot plot of overall sgRNA library representation in all samples, including plasmid library (n=1), cellular libraries of pre-injection library-infected naive $CD8^+$ T cells (n=3), and various organs containing $CD8^+$ $T_{eff}$ cells from multiple mice 7 days post-injection (n=7 mice, 62 total samples). SgRNA representation is depicted in terms of $\log_2$ reads per million (rpm). Analyzed tissues include the lymph node (LN), spleen, brain, liver, lung, muscle, and pancreas. FIG. 16B shows correlation analyses between two replicate mice. Average sgRNA representation across all organs for each mouse was plotted against another mouse. Pearson correlation value were noted on the plots. Full correlation plot was in FIG. 1. FIG. 16C shows a correlation analysis between two types of host as recipient mice. Average sgRNA representation across all mice for the B6 recipient group was plotted that of Cas9 host. Pearson correlation value was noted on the plot. FIG. 16D is a Venn diagram showing overlap of sgRNA hits between the $CD8^+$ $T_{eff}$ cells survival and trafficking screens using B6 and Cas9 recipients. Hypergeometric test, p<1e-5.

FIG. 17A, left panel is a Venn diagram comparing the significantly enriched sgRNAs (FDR<0.2%) in lymphoid vs. non-lymphoid organs. A total of 1,566 sgRNAs were enriched in at least one lymphoid sample, while 1,332 sgRNAs were enriched in at least one non-lymphoid sample. Of these, 761 sgRNAs were enriched in both lymphoid and non-lymphoid samples (significance of overlap, p≈0 by hypergeometric test). Right panel: Venn diagram comparing the significantly enriched sgRNAs in lymph node vs. spleen. A total of 1,426 sgRNAs were found to be enriched in at least one lymph node, while 360 sgRNAs were enriched in at least one spleen sample. Of these, 220 sgRNAs were enriched in both lymph node and spleen samples (significance of overlap, p≈0 by hypergeometric test). FIG. 17B is a 5-way Venn diagram of enriched sgRNAs in non-lymphoid tissues (brain, liver, lung, muscle, pancreas). A total of 83 sgRNAs were enriched in all 5 non-lymphoid organs. FIG. 17C shows minipool validation of highly enriched sgRNAs in T cell survival and trafficking in vivo. SgRNA abundance across all organs were plotted. Statistical comparisons were made against control sgRNA group co-injected in the same minipool. *=$p<0.05$, two sided t-test.

FIG. 18A is a schematic of an experiment: cross OT-I mouse to Cas9 mouse, naive $CD8^+$ T cell isolation from OT-I; Cas9 mice, $CD8^+$ T cell transduction, adoptive transfer into mice, and MKO-transduced OT-I; Cas9 $CD8^+$ $T_{eff}$ cell survival analysis in organs by high-throughput sgRNA sequencing. Organs collected include the liver, pancreas, lung, muscle and brain as representative non-lymphoid organs, and the spleen and several types of lymph nodes (sLNs, cLNs and aLNs). FIG. 18B is a waterfall plot of the top sgRNAs across all organs ranked by number of organs being enriched in (FDR<0.5%). A total of 27 sgRNAs were found to be significant in ≥20% of samples. FIG. 18C is a barplot of the number of genes with 0, 1, or 2 independent sgRNAs that were significantly enriched in at least one organ sample (FDR<0.5%). A total of 4 genes were found to have 2 independent sgRNAs enriched. Cd247, Bpifb3, and Tsc2 were found to have 3 independent enriched sgRNAs. FIG. 18D is a Venn diagram of the three enrichment criteria to identify the top gene hits (≥2% read abundance in one sample (n=99), significant in ≥20% of samples (considering all associated sgRNAs) (n=27), and ≥2 independent enriched sgRNAs (n=4)). Noted that the sets of ≥20% of samples and ≥2 independent enriched sgRNAs were contained in the set of ≥2% read abundance in one sample. A total of 3 genes satisfied all three criteria. These genes were Pdcd1, Slc35c1, and Stradb. FIG. 18E is a Venn diagram comparing the hits from the diverse TCR screen and from the clonal TCR screen. 17 genes were found to be significant in ≥2 samples from both datasets. These included 3830406C13Rik, BC055111, Cd247, Gm6927, Hacvr2, Lrp6, Nf1, Olfr1158, Opn3, Pdcd1, Serping1, Slc2a7, Slc35c1, Son, Tsc2, Tspan4, and 4.82. FIG. 18F illustrates donor T cell and recipient host effect analysis. Heatmap of pairwise Pearson correlations of sgRNA library representation in all mice, with all organs averaged, from the genome-scale screen for trafficking and survival in $CD8^+$ T cells with either diverse or clonal TCR (Cas9 vs. OT-I; Cas9), and with wildtype (B6) or syngeneic host (Cas9). FIG. 18G shows organ patterns of genome-scale CRISPR T cell screen. Dimensional reduction plot with t-SNE method showing the clustering patterns based on MKO library screening. Each dot is the sgRNA library representation in an organ color coded according to the legend (brain, liver, LN, lung, muscle, pancreas and spleen). There is a large cluster containing virtually all organ types (k0), while there are 8 smaller clusters (k1-k8) that each consist of 4 to 6 organ types, with several organs as outliers.

FIG. 19A is a Heatmap of pairwise Pearson correlations of sgRNA library representation across all samples in the second WT screen using OT-I; Cas9 $CD8^+$ T cells. Samples were from various organs containing $CD8^+$ $T_{eff}$ cells from multiple mice 7 days post-injection (n=10 mice, 70 total samples). Correlations were calculated based on $\log_2$ rpm values. FIG. 19B is a box-dot plot overall sgRNA library representation in all samples from various organs containing $CD8^+$ $T_{eff}$ cells from multiple mice 7 days post-injection (n=10 mice, 70 total samples). sgRNA representation is depicted in terms of $\log_2$ reads per million (rpm). Analyzed tissues include various lymph nodes (LN), spleen, liver, pancreas, and lung.

FIGS. 20A-20C are a series of images illustrating protein domain and conservation analysis of representative hits. FIG. 20A shows domain structure prediction of human DHX37 protein, which contains an HrpA domain that can be subdivided into 4 subdomains (DEXDc, P-loop NTPase, HELICc and HA2). Representative alignments of regions in DEXDc and HELICc domains that are conserved between multiple mammalian species are shown below (SEQ ID NOs: 140,683-140,746). FIG. 20B shows domain structure prediction of human LRP6 protein, which contains 5 predicted domains (NHL, overlapping LDLRb, LY, FXaI and LDLa). Representative alignments of regions in NHL and LY domains that are conserved between multiple mammalian species are shown below (SEQ ID NOs: 140,747-140,826). FIG. 20C shows domain structure prediction of human SLC35C1 protein, which contains 2 predicted domains (TPT, and overlapping EamA). Representative alignments of a region in EamA/TPT domain that is conserved between multiple mammalian species were shown below (SEQ ID NOs: 140,827-140,863).

FIG. 21A is a growth curve of subcutaneous tumors from transplanted E0771-mCh-cOVA cells in $Rag1^{-/-}$ mice following different treatments. PBS control (n=1), adoptive transfer of OT-I; Cas9 $CD8^+$ $T_{eff}$ cells infected with vector (n=3), and adoptive transfer of OT-I; Cas9 $CD8^+$ $T_{eff}$ cells infected with MKO (n=5). Arrow indicates the time of adoptive transfer of MKO or vector transduced OT-I; Cas9 $CD8^+$ $T_{eff}$ cells. Error bars for certain data points were invisible because the errors were small. Data are shown as mean±s.e.m. FIG. 21B shows full-slide and high-power histology sections stained by hematoxylin and eosin of tumors derived from E0771 cells expressing cOVA antigen in $Rag1^{-/-}$ mice after different treatment conditions. Top group: tumors in mice that were injected with PBS. Middle group: tumors in mice after adoptive transfer of vector-treated activated OT-I; Cas9 $CD8^+$ $T_{eff}$ cells. Bottom group: tumors in mice after adoptive transfer of MKO mutagenized activated OT-I; Cas9 $CD8^+$ $T_{eff}$ cells. In PBS group, tumors were devoid of lymphocytes and showed signatures of rapid proliferation and little cell death. In adoptive transfer groups, tumors were infiltrated by lymphocytes and showed signatures of cell death in large areas. Low magnification image scale bar: 1 mm; high magnification image scale bar: 200 μm. FIG. 21C shows representative FACS plots of adoptively transferred $T_{eff}$ cells in draining and non-draining LNs (dLN and ndLN, respectively), spleen, lung, and tumor (TILs) from E0771-mCh-cOVA tumor-bearing $Rag1^{-/-}$ mice. MKO is the genome-scale T cell CRISPR library. Numbers indicate percentage of total cells. Top row: FACS plots from PBS-treated mice. Middle row: FACS plots from mice treated with vector-infected OT-I; Cas9 $CD8^+$ T cells. Bottom row: FACS plots from mice treated with MKO-infected OT-I; Cas9 $CD8^+$ T cells. FIG. 21D shows correlation analysis of genome-scale CRISPR perturbation of OT-I; Cas9 $CD8^+$ tumor-infiltrating lymphocytes into $Rag1^{-/-}$ mice with E0771-cOVA tumors. Heatmap of pairwise Pearson correlations of sgRNA library representation across 3 cell libraries prior to injection, and all samples in the tumor infiltration screen (n=10 mice, 10 tumors). Correlations were calculated based on $\log_2$ rpm values. E0771-cOVA cells were transplanted subcutaneously for mice 1-5, and into the mammary fat pad for mice 6-10. FIG. 21E shows clonal consistency analysis of adoptive transfer screen. A minipool screen is analyzed between two clones expressing different levels of cOVA (E0771-mChOva cl.3 and cl.5). The sgRNA representation for one clone was plotted against another. Pearson correlation value was noted on the plot. FIG. 21F shows clonal consistency analysis of adoptive transfer screen. A minipool screen is analyzed between two cell lines from different cancer types (breast and lung) expressing the same cOVA construct (E0771-mChOva and LCC-mChOva). The sgRNA representation for one clone was plotted against another. Pearson correlation value was noted on the plot.

FIG. 22A is a schematic of an experiment: Naive OT-I; Cas9 $CD8^+$ T cells were isolated and transduced with MKO lentiviral library, co-cultured with SIINFEKL peptide pulsed E0771 cells (0 or 1 ng/ml), and stained for CD8 and CD107a for $CD8^+$ $T_{eff}$ undergoing active degranulation. Stained cells were analyzed, and the top 5% $CD107a^+$ cells were sorted, and subjected to genomic DNA extraction, CRISPR library readout, and screen data analysis. FIG. 22B shows titration of SIINFEKL peptide for MHC-I presentation in E0771 cells. E0771 cells were pulsed with different concentrations of SIINFEKL peptide, and the MHC-I—peptide complex (SIINFEKL:H-$K2^b$) was measured by mean fluorescent intensity (MFI) of surface staining using FACS. FIG. 22C is a histogram showing $CD107a^+$ T cells analyzed from the co-culture of OT-I; Cas9 $CD8^+$ T cells and E0771 cancer cells. The top 5% $CD107a^+$ cells were sorted. A total of three biological replicates were performed. FIG. 22D is a waterfall plot of the top-ranked sgRNAs across all sorted cell samples (17 sgRNAs significantly enriched in ≥66% of samples, FDR<0.5%). FIG. 22E is a Venn diagram comparing the hits from the in vitro kill assay screen and from the in vivo tumor infiltration study. 3 genes were found to be significant in ≥2 samples from both datasets. These included Dhx37, Lyn, and Odc1. FIG. 22F shows growth curves of mammary fatpad E0771-mCh-cOVA tumors in $Rag1^{-/-}$ mice following different treatments. PBS control (n=4), adoptive transfer of OT-I; Cas9 $CD8^+$ $T_{eff}$ cells infected with vector (n=4), and adoptive transfer of OT-I; Cas9 $CD8^+$ $T_{eff}$ cells infected with sgDhx37 (n=5). Data are shown as mean±s.e.m. PBS and sgDhx37 groups were tested against vector group. PBS group has significantly larger tumors compared to vector indicating the effect of adoptive transfer of OT-I; Cas9 $CD8^+$ $T_{eff}$ cells. The sgDhx37 group significantly reduced tumor burden as compared to vector indicating a gene-specific effect. FIG. 22G illustrates testing the anti-tumor effect of OT-I; Cas9 $CD8^+$ $T_{eff}$ cells with sgPD-1. Tumor growth curves from individual mice were shown. Similar to above, PBS, vector, and sgPdcd1 mice were shown. Data are shown as individual points/curves. 2/5 sgPdcd1 mice have significantly smaller tumors compared to vector, 1/5 is marginal significant, while the remaining 2/5 are not significant. FIG. 22H illustrates testing the anti-tumor effect of OT-I; Cas9 $CD8^+$ $T_{eff}$ cells with sgOdc1. Tumor growth curves from individual mice were shown. Similar to above, PBS, vector, and sgOdc1 mice were shown. Data are shown as individual points/curves. 3/5 sgOdc1 mice have significantly smaller tumors compared to vector, while the remaining 2/5 are not significant. Note: Arrow indicates the time of adoptive transfer of MKO or vector transduced OT-I; Cas9 $CD8^+$ $T_{eff}$ cells. Data from FIGS. 22F-22H were collected together, tumor curves PBS and vector groups from the 3 panels are identical, which were plotted in separation for each gene for comparison and visibility. Statistical comparisons were made against vector group. *=p<0.05, =p<0.01, *=p<0.001, by paired t-test.

FIG. 23A is a schematic of an experiment: adoptive transfer of vector or sgDhx37-infected OT-I; Cas9 $CD8^+$ $T_{eff}$ cells into $Rag1^{-/-}$ mice bearing E0771-mCh-cOVA tumors, tumor harvesting after 50 days of growth, FACS for $CD3^+$ $CD8^+$ T cells, microfluidic-based approach of reverse-transcription and multi-step barcoding library preparation to produce single-cell barcoded DNA droplets, followed by high-throughput sequencing and computational analysis. FIG. 23B shows t-SNE dimensional reduction and visualization of individual tumor-infiltrating $CD8^+$ cells from the mouse TIL scRNAseq. Left panel: visualization by clusters (4 distinct clusters identified); Right panel visualization by experiment groups, i.e. OT-I; Cas9 $CD8^+$ $T_{eff}$ cells treated with either sgDhx37 (n=191 cells) or vector (n=361). FIG. 23C shows differentially expressed genes in sgDhx37-treated $CD8^+$ tumor infiltrating lymphocytes compared to vector-treated. Heatmap of top differentially expressed genes (absolute $\log_2$ fold change≥1) in single $CD8^+$ tumor infiltrating lymphocytes treated with sgDhx37 or vector control. Values shown are in terms of z-scores (scaled by row/gene). FIG. 23D is a Volcano plot of differentially expressed genes in tumor-infiltrating $CD8^+$ cells treated with sgDhx37 compared to vector control. A total of 137 genes were significantly upregulated in sgDhx37 treated cells (Benjamini-Hochberg adjusted p<0.05), while 215 genes were significantly downregulated in sgDhx37 treated cells (adjusted p<0.05). Top upregulated genes included Rgs16, Nr4a2, Tox, Lag3, Rbm3 and Ccl4. Top downregulated genes included Uba52, Hist1h1c, Gm9844, Emp3 and Rps28. FIG. 23E shows gene ontology analysis of significantly upregulated genes in sgDhx37-treated tumor-infiltrating $CD8^+$ cells. Several gene ontology categories were significantly enriched (Bonferroni adjusted p<0.05). These included lymphocyte activation, positive regulation of cytokine production, regulation of cell-cell adhesion, regulation of immune effector process, and positive regulation of interferon-gamma production. FIG. 23F shows gene ontology analysis of significantly downregulated genes in sgDhx37-treated tumor-infiltrating $CD8^+$ cells. Several gene ontology categories were significantly enriched (Bonferroni adjusted p<0.05). These included ribosomal small subunit assembly, ribosomal large subunit biogenesis, regulation of reactive oxygen species metabolic process, regulation of cell migration, positive regulation of leukocyte migration, and apoptotic signaling pathway. FIG. 23G shows differential expression analysis by cluster (sub-population of T cells). mRNA level in individual cells were plotted for NTC and sgDhx37 groups in each of the 4 major clusters (see top panel of b). Violin plots with individual data points were shown. The top up-regulated (Rgs16) and down-regulated (Uba52) genes were shown as examples. For all comparisons between sgDhx37 and control group, FDR adjusted p value<0.05, in all clusters.

FIG. 24A shows Western blot analysis of DHX37 protein in human cells. From left to right, HEK293FT cells with Dhx37 overexpression as a positive control; peripheral blood $CD4^+$ T cells from a healthy donor; peripheral blood $CD8^+$ T cells from a healthy donor; TILs from a tumor biopsy freshly isolated from an NSCLC patient. FIG. 24B shows FACS analysis of intracellular protein level of DHX37 in peripheral blood $CD8^+$ T cells and NSCLC patient TILs. FIG. 24C shows tissue microarray analysis of DHX37 expression across multiple patient samples. Summary level dot plots of $DHX37^+$ cell staining. Each dot represents the total number of $DHX37^+$ cells in one slice of a core biopsy of a patient sample (0.7 mm in diameter, 0.385 $mm^2$ in surface area). Numbers were capped at 1000. Normal brain and glioma samples were on the same array. Breast cancer and melanoma tumor samples were on separate arrays. Normal brain tissues have significantly less $DHX37^+$ cells as compared to glioma tissues (*=p<0.001, by unpaired two-tailed t-test). Matched normal tissues are not available for breast cancer and melanoma for these TMAs. FIG. 24D shows representative images of two patient biopsy samples from tissue microarray analysis. DHX37 staining was found primarily in the nucleus (heavy staining on nuclear membrane). Arrowheads point to representative $DHX37^+$ TILs in glioma, breast cancer and melanoma biopsies. H&E staining was shown for companion samples. FIG. 24**E shows DHX37 in patient prognosis. Top left: Higher DHX37 predicts poorer prognosis in lower grade glioma (LGG). Kaplan-Meier curves of overall survival in High DHX37-high (n=221) vs. DHX37-low (n=223) patients (p=0.0011, hazard ratio=1.899). Bottom left: Higher DHX37 predicts poorer prognosis in hepatocellular carcinoma (LIHC). Kaplan-Meier curves of overall survival in High DHX37-high (n=161) vs. DHX37-low (n=162) patients (p=0.031, hazard ratio=1.522). Top right: Higher DHX37 predicts poorer prognosis in lung adenocarcinoma (LUAD). Kaplan-Meier curves of overall survival in High DHX37-high (n=222) vs. DHX37-low (n=222) patients (p=0.0077, hazard ratio=1.526). Bottom right: Higher DHX37 predicts poorer prognosis in kidney renal cell carcinoma (KIRC). Kaplan-Meier curves of overall survival in High DHX37-high (n=228) vs. DHX37-low (n=228) patients (p=0.047, hazard ratio=1.373).

FIG. 25A shows distribution of DHX37 expression in human peripheral blood T cells, tissue-resident T cells, tumor-normal junction T cells, and tumor-infiltrating T cells in $CD3^+/CD4^+/CD25^-$ helper T cells, $CD3^+/CD8^+$ cytotoxic T cells, and $CD3^+/CD4^+/CD25^+$ regulatory T cells. The number and total percentage of $DHX37^+$ cells is noted on each plot. FIG. 25B is a series of scatter-boxplots of IL12A, ITM2A, RGS16, and STAT1 expression in $DHX37^+$ and $DHX37^-$ $CD3^+/CD8^+$ T cells. Expression of IL12A ($p=7.10*10^{-9}$), ITM2A (p=0.0033), RGS16 ($p=1.23*10^{-7}$), and STAT1 (p=0.0033) was significantly lower in $DHX37^+$ cells. FIG. 25C is a series of scatter-boxplots of PPA1, CISH, TRAP1, and SLC7A6 expression in $DHX37^+$ and $DHX37^-$ $CD3^+/CD8^+$ T cells. Expression of PPA1 (p=0.0002), CISH (p=0.0074), TRAP1 ($p=9.34*10^{-5}$), and SLC7A6 ($p=9.64*10^{-5}$) was significantly higher in $DHX37^+$ cells. FIG. 25D is a set of scatter-boxplots of IKBKE and CPT2 expression in $DHX37^+$ and $DHX37^-$ $CD3^+/CD4^+/CD25^-$ T cells. Expression of IKBKE (p=0.0062) and CPT2 ($p=1.30*10^{-5}$) was significantly lower in $DHX37^+$ cells. FIG. 25E is a set of scatter-boxplots of SLC35E2B and NDFIP 1 expression in $DHX37^+$ and $DHX37^-$ $CD3^+/CD4^+/CD25^-$ T cells. Expression of SLC35E2B ($p=4.75*10^{-5}$) and NDFIP 1 (p=0.0004) was significantly higher in $DHX37^+$ cells. Two-sided Welch's t tests were used in B-E to evaluate statistical significance. Tukey boxplots are shown.

FIG. 26A is a schematics of the design of an AAV-CRISPR T cell knockout vector, which contains an sgRNA expression cassette and a Thy1.1 expression cassette within the two ITR of AAV base vector. FIG. 26B is a schematic of an experiment: Naive OT-I; Cas9 $CD8^+$ T cells were isolated and transduced with AAV-sgRNA-Thy1.1 vector, activated by CD3/CD28, followed by multiple analyses after infection, including indel sequencing, FACS, single cell RNAseq for acute transcriptional regulation, and adoptive transfer for testing anti-tumor activity. FIG. 26C is a plot showing significant downregulation of intracellular Dhx37 level 7 days after AAV-sgDhx37 transduction. Geometric means were shown for each data point. (*, p<0.05, unpaired two sided t test). FIG. 26D shows confirmation of acute knockout of genes by AAV-CRISPR system. Three genes were tested (Mll3, B2m and Dhx37). Representative Illumina targeted amplicon sequencing of the sgRNA target site 5 days after infection with AAV-sgRNA targeting the gene of interest. The top 10 most frequent variants were shown, with the associated variant frequencies in the box to the right (SEQ ID NOs: 140,864-140,896). FIG. 26E shows FACS analysis of Dhx37 knockout. Top, CD107a degranulation assay, where $CD8^+$ $T_{eff}$ cells with AAV-sgDhx37 transduction as compared to vector control showed significant upregulation of surface CD107a (p=0.001). Bottom, $CD8^+$ $T_{eff}$ cells with AAV-sgDhx37 showed significant downregulation of surface CD62L level. Data are shown as mean±s.e.m. Geometric means were shown for each individual data point. Data are also shown as group mean±s.e.m. FIG. 26F shows anti-tumor activity of AAV-CRISPR mediated Dhx37 knockout in $CD8^+$ $T_{eff}$ cells. Growth curves of mammary fatpad E0771-mCh-cOVA tumors in $Rag1^{-/-}$ mice following different treatments. PBS control (n=2), adoptive transfer of OT-I; Cas9 $CD8^+$ $T_{eff}$ cells infected with AAV-vector (n=4), and adoptive transfer of OT-I; Cas9 $CD8^+$ $T_{eff}$ cells infected with AAV-sgDhx37 (n=5). Data are shown as mean±s.e.m. Purple arrow indicates the time of adoptive transfer of viral transduced OT-I; Cas9 $CD8^+$ $T_{eff}$ cells. PBS group mice were not treated and have large tumors early. The AAV-sgDhx37 group significantly reduced tumor burden as compared to AAV-vector indicating a Dhx37 knockout specific effect.

FIGS. 27A-27F are a series of plots and images illustrating molecular interrogation of gene regulation upon acute Dhx37 loss in $CD8^+$ $T_{eff}$ cells. FIG. 27A shows t-SNE dimensional reduction and visualization of single cell transcriptomics of individual OT-I; Cas9 $CD8^+$ $T_{eff}$ cells 6 days after transduction with AAV, colored by experiment groups, i.e. AAV-sgDhx37 or AAV-sgNTC. FIG. 27B shows t-SNE dimensional reduction and visualization of single cell transcriptomics of individual OT-I; Cas9 $CD8^+$ $T_{eff}$ cells 6 days after transduction with AAV, colored by clusters. A total of 6 major clusters were identified as subpopulation of these T cells. FIG. 27C shows cluster-specific population differences between AAV-sgDhx37 or AAV-sgNTC. AAV-sgDhx37 group has more cells in cluster 2, but fewer cells grouped to clusters 4 and 6. FIG. 27D shows gene expression signature of all cells across all 6 major clusters, showing cluster-specific markers for these individual OT-I; Cas9 $CD8^+$ $T_{eff}$ cells. FIG. 27E shows cluster-specific gene regulation between AAV-sgDhx37 or AAV-sgNTC. Top upregulated and downregulated genes upon acute Dhx37 loss by AAV-sgDhx37 transduction were shown for each cluster (k1 to k6). Ccl5 was found to be upregulated across all clusters, while certain genes were found to be differentially upregulated only in specific clusters (e.g. Rgs2 in k1, k2 and k4; Lag3 in k5 and k6, Ifng in k3 only). Rpl35 was found to be downregulated across most clusters (except k4), while certain genes were found to be differentially downregulated only in specific clusters (e.g. Rps29 in k2, k3, k5 and k6; Npm3 in k5 and k6, Ly6c2 in k6 only). FIG. 27F shows violin plots with all data points for mRNA level in individual cells for the most-prevalently differentially up-regulated (Ccl5) and down-regulated (Rpl35) genes upon acute Dhx37 loss by AAV-CRISPR transduction, in each of the 6 major clusters (k1 to k6). For all comparisons between Dhx37 and control group, FDR adjusted p value$<$0.05, in all clusters for Ccl5, and in all clusters except k4 for Rpl35.

FIG. 28A shows cluster-specific differentially expressed genes upon acute Dhx37 loss by AAV-CRISPR transduction. Violin plots with all data points of representative genes in each of the 6 major clusters (k1 to k6) were shown. For all comparisons between Dhx37 and control group, FDR adjusted p value$<$0.05, in all clusters. FIG. 28B shows gene ontology analysis of significantly upregulated genes upon acute Dhx37 loss by AAV-sgDhx37 mediated knockout in $CD8^+$ T cells. Top biological processes were found to be immune related, including inflammatory response, immune response, negative regulation of apoptosis, endopeptidase, immunoglobulin secretion, response to glucose stimulus and T cell co-stimulation. FIG. 28C is a Venn diagram showing the overlap of differentially regulated genes upon Dhx37 loss by three different kinds of mechanisms, lenti-CRISPR mediated perturbation in mouse TILs, AAV-CRISPR mediated acute loss in culture, and naturally low-expression population in human T cells. A total of 24 genes (shown) were found to be significant across all three mechanisms.

DETAILED DESCRIPTION

Definitions

Figure 1A:
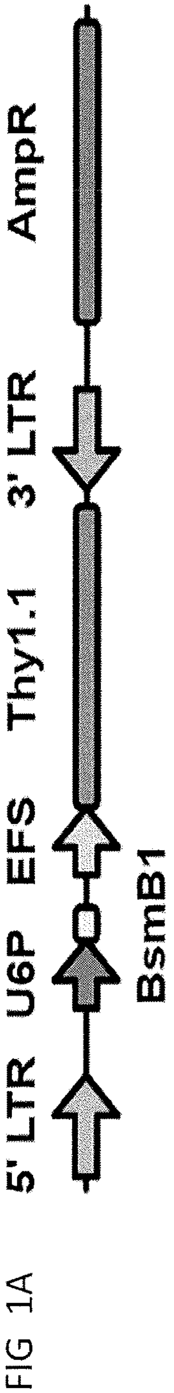
FIGS. 1A-1K are a series of plots and images depicting in vivo analysis of genome-scale CRISPR library mutagenized $CD8^+$ T cells after adoptive transfer into wildtype mice.

Unless defined otherwise, all technical and scientific terms used herein have the same meaning as commonly understood by one of ordinary skill in the art to which the invention pertains. Although any methods and materials similar or equivalent to those described herein can be used in the practice for testing of the present invention, the preferred materials and methods are described herein. In describing and claiming the present invention, the following terminology will be used.

It is also to be understood that the terminology used herein is for the purpose of describing particular embodiments only, and is not intended to be limiting.

The articles "a" and "an" are used herein to refer to one or to more than one (i.e., to at least one) of the grammatical object of the article. By way of example, "an element" means one element or more than one element.

"About" as used herein when referring to a measurable value such as an amount, a temporal duration, and the like, is meant to encompass variations of ±20% or ±10%, more preferably ±5%, even more preferably ±1%, and still more preferably ±0.1% from the specified value, as such variations are appropriate to perform the disclosed methods.

An "adeno-associated virus" or "AAV" as used herein refers to a small non-enveloped virus which infects humans and other primates but does not cause disease. AAV can infect dividing and quiescent cells and exists in an extrachromosomal state without integrating into the host genome. AAVs can be used as vectors for gene delivery to host cells.

As used herein the term "amount" refers to the abundance or quantity of a constituent in a mixture.

As used herein, the term "bp" refers to base pair.

The term "complementary" refers to the degree of anti-parallel alignment between two nucleic acid strands. Complete complementarity requires that each nucleotide be across from its opposite. No complementarity requires that each nucleotide is not across from its opposite. The degree of complementarity determines the stability of the sequences to be together or anneal/hybridize. Furthermore various DNA repair functions as well as regulatory functions are based on base pair complementarity.

The term "CRISPR/Cas" or "clustered regularly interspaced short palindromic repeats" or "CRISPR" refers to DNA loci containing short repetitions of base sequences followed by short segments of spacer DNA from previous exposures to a virus or plasmid. Bacteria and archaea have evolved adaptive immune defenses termed CRISPR/CRISPR—associated (Cas) systems that use short RNA to direct degradation of foreign nucleic acids. In bacteria, the CRISPR system provides acquired immunity against invading foreign DNA via. RNA-guided DNA cleavage.

The "CRISPR/Cas9" system or "CRISPR/Cas9-mediated gene editing" refers to a type II CRISPR/Cas system that has been modified for genome editing/engineering. It is typically comprised of a "guide" RNA (gRNA) and a non-specific CRISPR-associated endonuclease (Cas9). "Guide RNA (gRNA)" is used interchangeably herein with "short guide RNA (sgRNA)" or "single guide RNA" (sgRNA). The sgRNA is a short synthetic RNA composed of a "scaffold" sequence necessary for Cas9-binding and a user-defined ~20 nucleotide "spacer" or "targeting" sequence which defines the genomic target to be modified. The genomic target of Cas9 can be changed by changing the targeting sequence present in the sgRNA.

The term "cleavage" refers to the breakage of covalent bonds, such as in the backbone of a nucleic acid molecule or the hydrolysis of peptide bonds. Cleavage can be initiated by a variety of methods, including, but not limited to, enzymatic or chemical hydrolysis of a phosphodiester bond. Both single-stranded cleavage and double-stranded. cleavage are possible. Double-stranded cleavage can occur as a result of two distinct single-stranded cleavage events. DNA cleavage can result in the production of either blunt ends or staggered ends. In certain embodiments, fusion polypeptides can be used for targeting cleaved double-stranded DNA.

A "disease" is a state of health of an animal wherein the animal cannot maintain homeostasis, and wherein if the disease is not ameliorated then the animal's health continues to deteriorate. In contrast, a "disorder" in an animal is a state of health in which the animal is able to maintain homeostasis, but in which the animal's state of health is less favorable than it would be in the absence of the disorder. Left untreated, a disorder does not necessarily cause a further decrease in the animal's state of health.

"Effective amount" or "therapeutically effective amount" are used interchangeably herein, and refer to an amount of a compound, formulation, material, or composition, as described herein effective to achieve a particular biological result or provides a therapeutic or prophylactic benefit. Such results may include, but are not limited to, anti-tumor activity as determined by any means suitable in the art.

"Encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (i.e., rRNA, tRNA and mRNA) or a defined sequence of amino acids and the biological properties resulting therefrom. Thus, a gene encodes a protein if transcription and translation of mRNA corresponding to that gene produces the protein in a cell or other biological system. Both the coding strand, the nucleotide sequence of which is identical to the mRNA sequence and is usually provided in sequence listings, and the non-coding strand, used as the template for transcription of a gene or cDNA, can be referred to as encoding the protein or other product of that gene or cDNA.

As used herein "endogenous" refers to any material from or produced inside an organism, cell, tissue or system.

The term "expression" as used herein is defined as the transcription and/or translation of a particular nucleotide sequence driven by its promoter.

"Expression vector" refers to a vector comprising a recombinant polynucleotide comprising expression control sequences operatively linked to a nucleotide sequence to be expressed. An expression vector comprises sufficient cis-acting elements for expression; other elements for expression can be supplied by the host cell or in an in vitro expression system. Expression vectors include all those known in the art, such as cosmids, plasmids (e.g., naked or contained in liposomes) and viruses (e.g., Sendai viruses, lentiviruses, retroviruses, adenoviruses, and adeno-associated viruses) that incorporate the recombinant polynucleotide.

"Homologous" as used herein, refers to the subunit sequence identity between two polymeric molecules, e.g., between two nucleic acid molecules, such as, two DNA molecules or two RNA molecules, or between two polypeptide molecules. When a subunit position in both of the two molecules is occupied by the same monomeric subunit; e.g., if a position in each of two DNA molecules is occupied by adenine, then they are homologous at that position. The homology between two sequences is a direct function of the number of matching or homologous positions; e.g., if half (e.g., five positions in a polymer ten subunits in length) of the positions in two sequences are homologous, the two sequences are 50% homologous; if 90% of the positions (e.g., 9 of 10), are matched or homologous, the two sequences are 90% homologous.

"Identity" as used herein refers to the subunit sequence identity between two polymeric molecules particularly between two amino acid molecules, such as, between two polypeptide molecules. When two amino acid sequences have the same residues at the same positions; e.g., if a position in each of two polypeptide molecules is occupied by an Arginine, then they are identical at that position. The identity or extent to which two amino acid sequences have the same residues at the same positions in an alignment is often expressed as a percentage. The identity between two amino acid sequences is a direct function of the number of matching or identical positions; e.g., if half (e.g., five positions in a polymer ten amino acids in length) of the positions in two sequences are identical, the two sequences are 50% identical; if 90% of the positions (e.g., 9 of 10), are matched or identical, the two amino acids sequences are 90% identical.

As used herein, an "instructional material" includes a publication, a recording, a diagram, or any other medium of expression which can be used to communicate the usefulness of the compositions and methods of the invention. The instructional material of the kit of the invention may, for example, be affixed to a container which contains the nucleic acid, peptide, and/or composition of the invention or be shipped together with a container which contains the nucleic acid, peptide, and/or composition. Alternatively, the instructional material may be shipped separately from the container with the intention that the instructional material and the compound be used cooperatively by the recipient.

"Isolated" means altered or removed from the natural state. For example, a nucleic acid or a peptide naturally present in a living animal is not "isolated," but the same nucleic acid or peptide partially or completely separated from the coexisting materials of its natural state is "isolated." An isolated nucleic acid or protein can exist in substantially purified form, or can exist in a non-native environment such as, for example, a host cell.

The term "knockdown" as used herein refers to a decrease in gene expression of one or more genes.

The term "knockout" as used herein refers to the ablation of gene expression of one or more genes.

A "lentivirus" as used herein refers to a genus of the Retroviridae family. Lentiviruses are unique among the retroviruses in being able to infect non-dividing cells; they can deliver a significant amount of genetic information into the DNA of the host cell, so they are one of the most efficient methods of a gene delivery vector. HIV, SIV, and FIV are all examples of lentiviruses. Vectors derived from lentiviruses offer the means to achieve significant levels of gene transfer in vivo.

By the term "modified" as used herein, is meant a changed state or structure of a molecule or cell of the invention. Molecules may be modified in many ways, including chemically, structurally, and functionally. Cells may be modified through the introduction of nucleic acids.

By the term "modulating," as used herein, is meant mediating a detectable increase or decrease in the level of a response in a subject compared with the level of a response in the subject in the absence of a treatment or compound, and/or compared with the level of a response in an otherwise identical but untreated subject. The term encompasses perturbing and/or affecting a native signal or response thereby mediating a beneficial therapeutic response in a subject, preferably, a human.

A "mutation" as used herein is a change in a DNA sequence resulting in an alteration from a given reference sequence (which may be, for example, an earlier collected DNA sample from the same subject). The mutation can comprise deletion and/or insertion and/or duplication and/or substitution of at least one deoxyribonucleic acid base such as a purine (adenine and/or thymine) and/or a pyrimidine (guanine and/or cytosine). Mutations may or may not produce discernible changes in the observable characteristics (phenotype) of an organism (subject).

By "nucleic acid" is meant any nucleic acid, whether composed of deoxyribonucleosides or ribonucleosides, and whether composed of phosphodiester linkages or modified linkages such as phosphotriester, phosphoramidate, siloxane, carbonate, carboxymethylester, acetamidate, carbamate, thioether, bridged phosphoramidate, bridged methylene phosphonate, phosphorothioate, methylphosphonate, phosphorodithioate, bridged phosphorothioate or sulfone linkages, and combinations of such linkages. The term nucleic acid also specifically includes nucleic acids composed of bases other than the five biologically occurring bases (adenine, guanine, thymine, cytosine and uracil).

In the context of the present invention, the following abbreviations for the commonly occurring nucleic acid bases are used. "A" refers to adenosine, "C" refers to cytosine, "G" refers to guanosine, "T" refers to thymidine, and "U" refers to uridine.

Unless otherwise specified, a "nucleotide sequence encoding an amino acid sequence" includes all nucleotide sequences that are degenerate versions of each other and that encode the same amino acid sequence. The phrase nucleotide sequence that encodes a protein or an RNA may also include introns to the extent that the nucleotide sequence encoding the protein may in some version contain an intron(s).

The term "oligonucleotide" typically refers to short polynucleotides, generally no greater than about 60 nucleotides. It will be understood that when a nucleotide sequence is represented by a DNA sequence (i.e., A, T, G, C), this also includes an RNA sequence (i.e., A, U, G, C) in which "U" replaces "T".

"Parenteral" administration of an immunogenic composition includes, e.g., subcutaneous (s.c.), intravenous (i.v.), intramuscular (i.m.), or intrasternal injection, or infusion techniques.

The term "polynucleotide" as used herein is defined as a chain of nucleotides. Furthermore, nucleic acids are polymers of nucleotides. Thus, nucleic acids and polynucleotides as used herein are interchangeable. One skilled in the art has the general knowledge that nucleic acids are polynucleotides, which can be hydrolyzed into the monomeric "nucleotides." The monomeric nucleotides can be hydrolyzed into nucleosides. As used herein polynucleotides include, but are not limited to, all nucleic acid sequences which are obtained by any means available in the art, including, without limitation, recombinant means, i.e., the cloning of nucleic acid sequences from a recombinant library or a cell genome, using ordinary cloning technology and PCR™, and the like, and by synthetic means. Conventional notation is used herein to describe polynucleotide sequences: the left-hand end of a single-stranded polynucleotide sequence is the 5'-end; the left-hand direction of a double-stranded polynucleotide sequence is referred to as the 5'-direction.

As used herein, the terms "peptide," "polypeptide," and "protein" are used interchangeably, and refer to a compound comprised of amino acid residues covalently linked by peptide bonds. A protein or peptide must contain at least two amino acids, and no limitation is placed on the maximum number of amino acids that can comprise a protein's or peptide's sequence. Polypeptides include any peptide or protein comprising two or more amino acids joined to each other by peptide bonds. As used herein, the term refers to both short chains, which also commonly are referred to in the art as peptides, oligopeptides and oligomers, for example, and to longer chains, which generally are referred to in the art as proteins, of which there are many types. "Polypeptides" include, for example, biologically active fragments, substantially homologous polypeptides, oligopeptides, homodimers, heterodimers, variants of polypeptides, modified polypeptides, derivatives, analogs, fusion proteins, among others. The polypeptides include natural peptides, recombinant peptides, synthetic peptides, or a combination thereof.

The term "promoter" as used herein is defined as a DNA sequence recognized by the synthetic machinery of the cell, or introduced synthetic machinery, required to initiate the specific transcription of a polynucleotide sequence.

A "sample" or "biological sample" as used herein means a biological material from a subject, including but is not limited to organ, tissue, exosome, blood, plasma, saliva, urine and other body fluid. A sample can be any source of material obtained from a subject.

As used herein, the terms "sequencing" or "nucleotide sequencing" refer to determining the order of nucleotides (base sequences) in a nucleic acid sample, e.g. DNA or RNA. Many techniques are available such as Sanger sequencing and high-throughput sequencing technologies (also known as next-generation sequencing technologies) such as Illumina's HiSeq and MiSeq platforms or the GS FLX platform offered by Roche Applied Science.

The term "subject" is intended to include living organisms in which an immune response can be elicited (e.g., mammals). A "subject" or "patient," as used therein, may be a human or non-human mammal. Non-human mammals include, for example, livestock and pets, such as ovine, bovine, porcine, canine, feline and murine mammals. Preferably, the subject is human.

A "target site" or "target sequence" refers to a genomic nucleic acid sequence that defines a portion of a nucleic acid to which a binding molecule may specifically bind under conditions sufficient for binding to occur.

As used herein, the term "T cell receptor" or "TCR" refers to a complex of membrane proteins that participate in the activation of T cells in response to the presentation of antigen. The TCR is responsible for recognizing antigens bound to major histocompatibility complex molecules. TCR is composed of a heterodimer of an alpha (α) and beta (β) chain, although in some cells the TCR consists of gamma and delta (γ/δ) chains, TCRs may exist in α/β and γ/δ forms, which are structurally similar but have distinct anatomical locations and functions. Each chain is composed of two extracellular domains, a variable and constant domain. In some embodiments, the TCR can be modified on any cell comprising a TCR, including, for example, a helper T cell, a cytotoxic cell, a memory T cell, regulatory cell, natural killer T cell, and/or gamma delta T cell.

The term "therapeutic" as used herein means a treatment and/or prophylaxis. A therapeutic effect is obtained by suppression, remission, or eradication of a disease state.

The term "transfected" or "transformed" or "transduced" as used herein refers to a process by which exogenous nucleic acid is transferred or introduced into the host cell. A "transfected" or "transformed" or "transduced" cell is one which has been transfected, transformed or transduced with exogenous nucleic acid. The cell includes the primary subject cell and its progeny.

To "treat" a disease as the term is used herein, means to reduce the frequency or severity of at least one sign or symptom of a disease or disorder experienced by a subject.

A "vector" is a composition of matter which comprises an isolated nucleic acid and which can be used to deliver the isolated nucleic acid to the interior of a cell. Numerous vectors are known in the art including, but not limited to, linear polynucleotides, polynucleotides associated with ionic or amphiphilic compounds, plasmids, and viruses.

Thus, the term "vector" includes an autonomously replicating plasmid or a virus. The term should also be construed to include non-plasmid and non-viral compounds which facilitate transfer of nucleic acid into cells, such as, for example, polylysine compounds, liposomes, and the like. Examples of viral vectors include, but are not limited to, Sendai viral vectors, adenoviral vectors, adeno-associated virus vectors, retroviral vectors, lentiviral vectors, and the like.

Ranges: throughout this disclosure, various aspects of the invention can be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 2.7, 3, 4, 5, 5.3, and 6. This applies regardless of the breadth of the range.

Description

The present invention provides in one aspect compositions and methods for genome-scale editing and screening of T cells. In certain embodiments, the invention provides an sgRNA library for genome-scale mutagenesis of T cells in vitro and/or in vivo. In other embodiments, the invention provides a vector system (comprising a multitude of vectors) enabling multiplexed genome editing in T lymphocytes (T cells), and simultaneously isolate or enrich edited T cells using a surrogate/affinity marker. In yet other embodiments, the invention provides a vector system (comprising a multitude of vectors) enabling expression of model antigens in cancer cells as immunotherapy models. In yet other embodiments, the invention provides a method for high-throughput genetic interrogation of CD8+ T cells in vitro and/or in vivo.

$CD8^+$ T cells are fundamental to the adaptive immune response against intracellular pathogens and tumors. Recent clinical advancements have converged on the theme that $CD8^+$ T cells play a central role in the cancer-immune cycle. Identification of genes modulating T cell function, such as the discovery of the PD-1 gene based on differential gene expression, the anti-tumor effect mediated by CTLA-4 inhibition in mouse model, and many subsequent studies, led to the immunotherapeutic paradigm of checkpoint blockade. Immunotherapy has revolutionized cancer treatments, making late-stage metastatic cancer no longer a death sentence for a fraction of patients suffering from certain cancer types, most pronounced in melanoma and lung cancer. Thus, discovering novel genes in T cells is key to the development of new and more effective cancer therapeutics. Classical genetic studies have further identified individual genes such as 4-1BB, CD27, CD28, ICOS, LAG3, OX-40, TIM3, and VISTA as potential targets for checkpoint modulation. However, an unbiased, global view of genes modulating T cell phenotypes in cancer immunity is lacking, partly due to the technological challenges in performing high-throughput screens in T cells in vivo. Therapeutic targets with the potential to enhance $CD8^+$ T cell function are actively being pursued in pharmaceutical development and the clinic, leading to a new boom of clinical trials testing new checkpoint blockade antibodies and compounds either as monotherapy or in various combinations. Of note, the first-in-human genome editing clinical trials have debut with CRISPR-edited $CD8^+$ T cells infused into cancer patients by adoptive transfer.

The present study uncovered certain genes for T cell trafficking and survival in vivo after adoptive transfer. These new insights can directly influence the conceptualization of new targets for enhancement of chimeric antigen receptor (CAR-T), checkpoint blockade, or combinatorial immunotherapy.

In the present study described herein, a T cell CRISPR knockout vector was generated and a genome-scale knockout library was cloned. The system was utilized to perform two high-throughput genetic screens in $CD8^+$ cytotoxic T cells isolated from both wildtype and TCR-transgenic mice. By adoptively transferring the mutagenized cells into host mice, these screens yielded a global quantitative measurement of the relative abundance of mutant T cells within several lymphoid and non-lymphoid organs in mice. SgRNA enrichment analysis identified various previously undocumented targets that directly influence $CD8^+$ T cell function in vivo upon CRISPR perturbation.

Compositions

In one aspect, the invention includes a vector comprising a 5' long terminal repeat (LTR) sequence, a U6 promoter sequence, a BsmBI restriction site, an EFS sequence or PGK constitutive promoter, an sgRNA expression cassette, a Thy1.1 cassette, a 3' LTR sequence and an ampicillin resistance gene sequence (AmpR). In one embodiment, the vector comprises SEQ ID NO:129,213 (pSC017pLKO-U6-sgBsmBI-EFS-Thy11CO-spA). In another embodiment, the vector comprises SEQ ID NO:129,214. In yet another embodiment, the vector comprises SEQ ID NO:129,215. In certain embodiments, the vector can comprise additional components, such as but not limited to artificial selection markers, fluorescent proteins or a second U6-sgRNA cassette. In certain embodiments, vectors of the present invention enable robust genome editing in T cells.

In another aspect, the invention includes a vector comprising a 5' long terminal repeat (LTR) sequence, a U6 promoter sequence, a BsmB1 restriction site, an EFS sequence, an sgRNA expression cassette, an mCherry sequence, a 2A peptide, a cOVA sequence, a 3' LTR sequence and an ampicillin resistance gene sequence (AmpR). In certain embodiments, this vector enables expression of a model antigen (cOVA) for TCR recognition with transgenic OT-I (CD8+) and OT-II (CD4+) T cells. In one embodiment, this vector comprises SEQ ID NO: 129,216 (pMD02: lenti-pLKO-U6-sgBsmBI-EFS-mCherry-2A-cOVA).

In another aspect, the invention includes an sgRNA library. The library comprises a plurality of vectors, wherein each vector comprises an expression cassette for an sgRNA comprising a nucleotide sequence selected from the group consisting of SEQ ID NOs: 1-129,209. In certain embodiments, each of the plurality of vectors in the sgRNA library comprise a 5' long terminal repeat (LTR) sequence, a U6 promoter sequence, a BsmB1 restriction site, an EFS sequence, an sgRNA expression cassette, a Thy1.1 cassette, a 3' LTR sequence and an ampicillin resistance gene sequence (AmpR).

The invention also provides a kit comprising an sgRNA library. The sgRNA library comprises a plurality of vectors, wherein each vector comprises an expression cassette for an sgRNA comprising a nucleotide sequence selected from the group consisting of SEQ ID NOs: 1-129,209. In certain embodiments, the plurality of vectors comprise a 5' long terminal repeat (LTR) sequence, a U6 promoter sequence, a BsmB1 restriction site, an EFS sequence, an sgRNA expression cassette, a Thy1.1 cassette, a 3' LTR sequence and an ampicillin resistance gene sequence (AmpR). Included in the kits are instructional materials for use thereof. Instructional material can include directions for using the components of the kit as well as instructions or guidance for interpreting the results.

The invention also provides a vector comprising a 5' inverted terminal repeat (ITR) sequence, a U6 promoter sequence, a BbsI restriction site, an sgRNA expression cassette, an EFS sequence, a SB100x cassette, a 3' ITR sequence and an ampicillin resistance gene sequence (AmpR). In one embodiment, the vector comprises SEQ ID NO: 129,217.

```
pLY005SB_pAAV-U6sg(BbsI)-EFS-SB100X
                                                    (SEQ ID NO: 129,217)
   1 cctgcaggca gctgcgcgct cgctcgctca ctgaggccgc ccgggcaaag cccgggcgtc

  61 gggcgacctt tggtcgcccg gcctcagtga gcgagcgagc gcgcagagag ggagtggcca

 121 actccatcac taggggttcc tgcggccgca cgcgttctag actatacagt tgaagtcgga

 181 agtttacata cacttaagtt ggagtcatta aaactcgttt ttcaactact ccacaaattt

 241 cttgttaaca aacaatagtt ttggcaagtc agttaggaca tctactttgt gcatgacaca

 301 agtcattttt ccaacaattg tttacagaca gattatttca cttataattc actgtatcac

 361 aattccagtg ggtcagaagt ttacatacac taagttgact gtgcctttaa acagcttgga

 421 aaattccaga aaatgatgtc atggctttag agaggatccg agggcctatt tcccatgatt

 481 ccttcatatt tgcatatacg atacaaggct gttagagaga taattagaat taatttgact

 541 gtaaacacaa agatattagt acaaaatacg tgacgtagaa agtaataatt tcttgggtag

 601 tttgcagttt taaaattatg ttttaaaatg gactatcata tgcttaccgt aacttgaaag

 661 tatttcgatt tcttggcttt atatatcttg tggaaaggac gaaacaccgg gtcttcgaga

 721 agacctgttt tagagctaga aatagcaagt taaaataagg ctagtccgtt atcaacttga

 781 aaaagtggca ccgagtcggt gctttttttgg ctagctggcc gcgtttaaac gtcgactagg

 841 tcttgaaagg agtgggaatt ggctccggtg cccgtcagtg ggcagagcgc acatcgccca

 901 cagtccccga gaagttgggg ggaggggtcg gcaattgatc cggtgcctag agaaggtggc

 961 gcggggtaaa ctgggaaagt gatgtcgtgt actggctccg cctttttccc gagggtgggg

1021 gagaaccgta tataagtgca gtagtcgccg tgaacgttct ttttcgcaac gggtttgccg

1081 ccagaacaca ggctcgagat gggaaaatca aaagaaatca gccaagacct cagaaaaaga

1141 attgtagacc tccacaagtc tggttcatcc ttgggagcaa tttccaaacg cctggcggta

1201 ccacgttcat ctgtacaaac aatagtacgc aagtataaac accatgggac cacgcagccg

1261 tcataccgct caggaaggag acgcgttctg tctcctagag atgaacgtac tttggtgcga

1321 aaagtgcaaa tcaatcccag aacaacagca aaggaccttg tgaagatgct ggaggaaaca

1381 ggtacaaaag tatctatatc cacagtaaaa cgagtcctat atcgacataa cctgaaaggc

1441 cactcagcaa ggaagaagcc actgctccaa aaccgacata agaaagccag actacggttt

1501 gcaactgcac atggggacaa agatcgtact tttggagaa atgtcctctg gtctgatgaa

1561 acaaaaatag aactgtttgg ccataatgac catcgttatg tttggaggaa gaagggggag

1621 gcttgcaagc cgaagaacac catcccaacc gtgaagcacg gggggtggcag catcatgttg

1681 tgggggtgct ttgctgcagg agggactggt gcacttcaca aaatagatgg catcatggac

1741 gcggtgcagt atgtggatat attgaagcaa catctcaaga catcagtcag gaagttaaag

1801 cttggtcgca aatgggtttt ccaacacgac aatgacccca agcatacttc caaagttgtg

1861 gcaaaatggc ttaaggacaa caaagtcaag gtattggagt ggccatcaca aagccctgac

1921 ctcaatccta tagaaaattt gtgggcagaa ctgaaaaagc gtgtgcgagc aaggaggcct

1981 acaaacctga ctcagttaca ccagctctgt caggaggaat gggccaaaat tcacccaaat

2041 tattgtggga agcttgtgga aggctacccg aaacgtttga cccaagttaa acaatttaaa

2101 ggcaatgcta ccaaatacta ggggccctaa ccgcgggaat aaaagatctt tattttcatt
```

-continued 2161 agatctgtgt gttggttttt tgtgtgaatt cttgagtgta tgtaaacttc tgacccactg 2221 ggaatgtgat gaaagaaata aaagctgaaa tgaatcattc tctctactat tattctgata 2281 tttcacattc ttaaaataaa gtggtgatcc taactgacct aagacaggga atttttacta 2341 ggattaaatg tcaggaattg tgaaaaagtg agtttaaatg tatttggcta aggtgtatgt 2401 aaacttccga cttcaactgt ataggcatgc ggtaaccacg tgcggaccga gcggccgcag 2461 gaacccctag tgatggagtt ggccactccc tctctgcgcg ctcgctcgct cactgaggcc 2521 gggcgaccaa aggtcgcccg acgcccgggc tttgcccggg cggcctcagt gagcgagcga 2581 gcgcgcagct gcctgcaggg gcgcctgatg cggtattttc tccttacgca tctgtgcggt 2641 atttcacacc gcatacgtca aagcaaccat agtacgcgcc ctgtagcggc gcattaagcg 2701 cggcgggtgt ggtggttacg cgcagcgtga ccgctacact tgccagcgcc ctagcgcccg 2761 ctcctttcgc tttcttccct tcctttctcg ccacgttcgc cggctttccc cgtcaagctc 2821 taaatcgggg gctcccttta gggttccgat ttagtgcttt acggcacctc gaccccaaaa 2881 aacttgattt gggtgatggt tcacgtagtg ggccatcgcc ctgatagacg gtttttcgcc 2941 ctttgacgtt ggagtccacg ttctttaata gtggactctt gttccaaact ggaacaacac 3001 tcaaccctat ctcgggctat tcttttgatt tataagggat tttgccgatt tcggcctatt 3061 ggttaaaaaa tgagctgatt taacaaaaat ttaacgcgaa ttttaacaaa atattaacgt 3121 ttacaatttt atggtgcact ctcagtacaa tctgctctga tgccgcatag ttaagccagc 3181 cccgacaccc gccaacaccc gctgacgcgc cctgacgggc ttgtctgctc ccggcatccg 3241 cttacagaca agctgtgacc gtctccggga gctgcatgtg tcagaggttt tcaccgtcat 3301 caccgaaacg cgcgagacga aagggcctcg tgatacgcct atttttatag gttaatgtca 3361 tgataataat ggtttcttag acgtcaggtg gcacttttcg gggaaatgtg cgcggaaccc 3421 ctatttgttt atttttctaa atacattcaa atatgtatcc gctcatgaga caataaccct 3481 gataaatgct tcaataatat tgaaaaagga agagtatgag tattcaacat ttccgtgtcg 3541 cccttattcc cttttttgcg gcattttgcc ttcctgtttt tgctcaccca gaaacgctgg 3601 tgaaagtaaa agatgctgaa gatcagttgg gtgcacgagt gggttacatc gaactggatc 3661 tcaacagcgg taagatcctt gagagttttc gccccgaaga acgttttcca atgatgagca 3721 cttttaaagt tctgctatgt ggcgcggtat tatcccgtat tgacgccggg caagagcaac 3781 tcggtcgccg catacactat tctcagaatg acttggttga gtactcacca gtcacagaaa 3841 agcatcttac ggatggcatg acagtaagag aattatgcag tgctgccata accatgagtg 3901 ataacactgc ggccaactta cttctgacaa cgatcggagg accgaaggag ctaaccgctt 3961 ttttgcacaa catgggggat catgtaactc gccttgatcg ttgggaaccg gagctgaatg 4021 aagccatacc aaacgacgag cgtgacacca cgatgcctgt agcaatggca acaacgttgc 4081 gcaaactatt aactggcgaa ctacttactc tagcttcccg gcaacaatta atagactgga 4141 tggaggcgga taaagttgca ggaccacttc tgcgctcggc ccttccggct ggctggttta 4201 ttgctgataa atctggagcc ggtgagcgtg ggtctcgcgg tatcattgca gcactggggc 4261 cagatggtaa gccctcccgt atcgtagtta tctacacgac ggggagtcag gcaactatgg 4321 atgaacgaaa tagacagatc gctgagatag gtgcctcact gattaagcat tggtaactgt 4381 cagaccaagt ttactcatat atactttaga ttgatttaaa acttcatttt taatttaaaa 4441 ggatctaggt gaagatcctt tttgataatc tcatgaccaa aatcccttaa cgtgagtttt 4501 cgttccactg agcgtcagac cccgtagaaa agatcaaagg atcttcttga gatccttttt 4561 ttctgcgcgt aatctgctgc ttgcaaacaa aaaaaccacc gctaccagcg gtggtttgtt -continued

```
4621 tgccggatca agagctacca actctttttc cgaaggtaac tggcttcagc agagcgcaga
4681 taccaaatac tgtccttcta gtgtagccgt agttaggcca ccacttcaag aactctgtag
4741 caccgcctac atacctcgct ctgctaatcc tgttaccagt ggctgctgcc agtggcgata
4801 agtcgtgtct taccgggttg gactcaagac gatagttacc ggataaggcg cagcggtcgg
4861 gctgaacggg gggttcgtgc acacagccca gcttggagcg aacgacctac accgaactga
4921 gatacctaca gcgtgagcta tgagaaagcg ccacgcttcc cgaagggaga aaggcggaca
4981 ggtatccggt aagcggcagg gtcggaacag gagagcgcac gagggagctt ccagggggaa
5041 acgcctggta tctttatagt cctgtcgggt ttcgccacct ctgacttgag cgtcgatttt
5101 tgtgatgctc gtcagggggg cggagcctat ggaaaaacgc cagcaacgcg gcctttttac
5161 ggttcctggc cttttgctgg ccttttgctc acatgt
```

In another aspect, the invention provides a vector comprising a 5' inverted terminal repeat (ITR) sequence, a U6 promoter sequence, a BbsI restriction site, an sgRNA expression cassette, an EFS sequence, a SB100x cassette, a Thy1.1 cassette, a 3' ITR sequence and an ampicillin resistance gene sequence (AmpR). In one embodiment, the vector comprises SEQ ID NO: 129,218.

```
pLY017SB_pAAV-U6sg(BbsI)-EFS-Thy1
                                                   (SEQ ID NO: 129,218)
   1 cctgcaggca gctgcgcgct cgctcgctca ctgaggccgc ccgggcaaag cccgggcgtc
  61 gggcgacctt tggtcgcccg gcctcagtga gcgagcgagc gcgcagagag ggagtggcca
 121 actccatcac taggggttcc tgcggccgca cgcgttctag actatacagt tgaagtcgga
 181 agtttacata cacttaagtt ggagtcatta aaactcgttt ttcaactact ccacaaattt
 241 cttgttaaca aacaatagtt ttggcaagtc agttaggaca tctactttgt gcatgacaca
 301 agtcattttt ccaacaattg tttacagaca gattatttca cttataattc actgtatcac
 361 aattccagtg ggtcagaagt ttacatacac taagttgact gtgcctttaa acagcttgga
 421 aaattccaga aaatgatgtc atggctttag agaggatccg agggcctatt tcccatgatt
 481 ccttcatatt tgcatatacg atacaaggct gttagagaga taattagaat taatttgact
 541 gtaaacacaa agatattagt acaaaatacg tgacgtagaa agtaataatt tcttgggtag
 601 tttgcagttt taaaattatg ttttaaaatg gactatcata tgcttaccgt aacttgaaag
 661 tatttcgatt tcttggcttt atatatcttg tggaaaggac gaaacaccgg gtcttcgaga
 721 agacctgttt tagagctaga aatagcaagt taaaataagg ctagtccgtt atcaacttga
 781 aaaagtggca ccgagtcggt gctttttttgg ctagctggcc gcgtttaaac gtcgactagg
 841 tcttgaaagg agtgggaatt ggctccggtg cccgtcagtg ggcagagcgc acatcgccca
 901 cagtccccga gaagttgggg ggaggggtcg gcaattgatc cggtgcctag agaaggtggc
 961 gcggggtaaa ctgggaaagt gatgtcgtgt actggctccg cctttttccc gagggtgggg
1021 gagaaccgta tataagtgca gtagtcgccg tgaacgttct ttttcgcaac gggtttgccg
1081 ccagaacaca ggctcgagat gaacccagcc atcagcgtcg ctctcctgct ctcagtcttg
1141 caggtgtccc gagggcagaa ggtgaccagc ctgacagcct gcctggtgaa ccaaaacctt
1201 cgcctggact gccgccatga gaataacacc aaggataact ccatccagca tgagttcagc
1261 ctgacccgag agaagaggaa gcacgtgctc tcaggcaccc ttgggatacc cgagcacacg
1321 taccgctccc gcgtcaccct ctccaaccag ccctatatca aggtccttac cctagccaac
```

-continued 1381 ttcaccacca aggatgaggg cgactacttt tgtgagcttc gcgtgtcggg cgcgaatccc 1441 atgagctcca ataaaagtat cagtgtgtat agagacaagc tggtcaagtg tggcggcata 1501 agcctgctgg ttcagaacac atcctggatg ctgctgctgc tgctttccct ctccctcctc 1561 caagccctgg acttcatttc tctgggcagt ggagagggca gaggaagtct gctaacatgc 1621 ggtgacgtcg aggagaatcc tggcccaatg ggaaaatcaa aagaaatcag ccaagacctc 1681 agaaaaagaa ttgtagacct ccacaagtct ggttcatcct tgggagcaat ttccaaacgc 1741 ctggcggtac cacgttcatc tgtacaaaca atagtacgca agtataaaca ccatgggacc 1801 acgcagccgt cataccgctc aggaaggaga cgcgttctgt ctcctagaga tgaacgtact 1861 ttggtgcgaa aagtgcaaat caatcccaga acaacagcaa aggaccttgt gaagatgctg 1921 gaggaaacag gtacaaaagt atctatatcc acagtaaaac gagtcctata tcgacataac 1981 ctgaaaggcc actcagcaag gaagaagcca ctgctccaaa accgacataa gaaagccaga 2041 ctacggtttg caactgcaca tggggacaaa gatcgtactt tttggagaaa tgtcctctgg 2101 tctgatgaaa caaaaataga actgtttggc cataatgacc atcgttatgt ttggaggaag 2161 aaggggagg cttgcaagcc gaagaacacc atcccaaccg tgaagcacgg gggtggcagc 2221 atcatgttgt gggggtgctt tgctgcagga gggactggtg cacttcacaa aatagatggc 2281 atcatggacg cggtgcagta tgtggatata ttgaagcaac atctcaagac atcagtcagg 2341 aagttaaagc ttggtcgcaa atgggtttc caacacgaca atgaccccaa gcatacttcc 2401 aaagttgtgg caaaatggct taaggacaac aaagtcaagg tattggagtg gccatcacaa 2461 agccctgacc tcaatcctat agaaaatttg tgggcagaac tgaaaaagcg tgtgcgagca 2521 aggaggccta caaacctgac tcagttacac cagctctgtc aggaggaatg ggccaaaatt 2581 cacccaaatt attgtgggaa gcttgtggaa ggctacccga aacgtttgac ccaagttaaa 2641 caatttaaag gcaatgctac caaatactag ggccctaac cgcgggaata aaagatcttt 2701 attttcatta gatctgtgtg ttggtttttt gtgtgaattc ttgagtgtat gtaaacttct 2761 gacccactgg gaatgtgatg aaagaaataa aagctgaaat gaatcattct ctctactatt 2821 attctgatat ttcacattct taaaataaag tggtgatcct aactgaccta agacagggaa 2881 tttttactag gattaaatgt caggaattgt gaaaaagtga gtttaaatgt atttggctaa 2941 ggtgtatgta aacttccgac ttcaactgta taggcatgcg gtaaccacgt gcggaccgag 3001 cggccgcagg aacccctagt gatggagttg gccactccct ctctgcgcgc tcgctcgctc 3061 actgaggccg ggcgaccaaa ggtcgcccga cgcccgggct ttgcccgggc ggcctcagtg 3121 agcgagcgag cgcgcagctg cctgcagggg cgcctgatgc ggtattttct ccttacgcat 3181 ctgtgcggta tttcacaccg catacgtcaa agcaaccata gtacgcgccc tgtagcggcg 3241 cattaagcgc ggcgggtgtg gtggttacgc gcagcgtgac cgctacactt gccagcgccc 3301 tagcgcccgc tcctttcgct ttcttccctt cctttctcgc cacgttcgcc ggctttcccc 3361 gtcaagctct aaatcggggg ctccctttag ggttccgatt tagtgcttta cggcacctcg 3421 accccaaaaa acttgatttg ggtgatggtt cacgtagtgg gccatcgccc tgatagacgg 3481 tttttcgccc tttgacgttg gagtccacgt tctttaatag tggactcttg ttccaaactg 3541 gaacaacact caaccctatc tcgggctatt cttttgattt ataagggatt ttgccgattt 3601 cggcctattg gttaaaaaat gagctgattt aacaaaaatt taacgcgaat tttaacaaaa 3661 tattaacgtt tacaatttta tggtgcactc tcagtacaat ctgctctgat gccgcatagt 3721 taagccagcc ccgacacccg ccaacacccg ctgacgcgcc ctgacgggct tgtctgctcc 3781 cggcatccgc ttacagacaa gctgtgaccg tctccgggag ctgcatgtgt cagaggifit -continued

```
3841 caccgtcatc accgaaacgc gcgagacgaa agggcctcgt gatacgccta tttttatagg
3901 ttaatgtcat gataataatg gtttcttaga cgtcaggtgg cacttttcgg ggaaatgtgc
3961 gcggaacccc tatttgttta tttttctaaa tacattcaaa tatgtatccg ctcatgagac
4021 aataaccctg ataaatgctt caataatatt gaaaaaggaa gagtatgagt attcaacatt
4081 tccgtgtcgc ccttattccc ttttttgcgg cattttgcct tcctgttttt gctcacccag
4141 aaacgctggt gaaagtaaaa gatgctgaag atcagttggg tgcacgagtg ggttacatcg
4201 aactggatct caacagcggt aagatccttg agagttttcg ccccgaagaa cgttttccaa
4261 tgatgagcac ttttaaagtt ctgctatgtg gcgcggtatt atcccgtatt gacgccgggc
4321 aagagcaact cggtcgccgc atacactatt ctcagaatga cttggttgag tactcaccag
4381 tcacagaaaa gcatcttacg gatggcatga cagtaagaga attatgcagt gctgccataa
4441 ccatgagtga taacactgcg gccaacttac ttctgacaac gatcggagga ccgaaggagc
4501 taaccgcttt tttgcacaac atgggggatc atgtaactcg ccttgatcgt tgggaaccgg
4561 agctgaatga agccatacca aacgacgagc gtgacaccac gatgcctgta gcaatggcaa
4621 caacgttgcg caaactatta actggcgaac tacttactct agcttcccgg caacaattaa
4681 tagactggat ggaggcggat aaagttgcag gaccacttct gcgctcggcc cttccggctg
4741 gctggtttat tgctgataaa tctggagccg gtgagcgtgg gtctcgcggt atcattgcag
4801 cactggggcc agatggtaag ccctcccgta tcgtagttat ctacacgacg gggagtcagg
4861 caactatgga tgaacgaaat agacagatcg ctgagatagg tgcctcactg attaagcatt
4921 ggtaactgtc agaccaagtt tactcatata tactttagat tgatttaaaa cttcattttt
4981 aatttaaaag gatctaggtg aagatccttt ttgataatct catgaccaaa atcccttaac
5041 gtgagttttc gttccactga gcgtcagacc ccgtagaaaa gatcaaagga tcttcttgag
5101 atcctttttt tctgcgcgta atctgctgct tgcaaacaaa aaaaccaccg ctaccagcgg
5161 tggtttgttt gccggatcaa gagctaccaa ctctttttcc gaaggtaact ggcttcagca
5221 gagcgcagat accaaatact gtccttctag tgtagccgta gttaggccac cacttcaaga
5281 actctgtagc accgcctaca tacctcgctc tgctaatcct gttaccagtg gctgctgcca
5341 gtggcgataa gtcgtgtctt accgggttgg actcaagacg atagttaccg gataaggcgc
5401 agcggtcggg ctgaacgggg ggttcgtgca cacagcccag cttggagcga acgacctaca
5461 ccgaactgag atacctacag cgtgagctat gagaaagcgc cacgcttccc gaagggagaa
5521 aggcggacag gtatccggta agcggcaggg tcggaacagg agagcgcacg agggagcttc
5581 caggggggaaa cgcctggtat ctttatagtc ctgtcgggtt tcgccacctc tgacttgagc
5641 gtcgattttt gtgatgctcg tcaggggggc ggagcctatg gaaaaacgcc agcaacgcgg
5701 cctttttacg gttcctggcc ttttgctggc cttttgctca catgt
```

In another aspect, the invention provides a vector comprising a 5' inverted terminal repeat (ITR) sequence, a U6 promoter sequence, a BbsI restriction site, an sgRNA expression cassette, a 3' ITR sequence and an ampicillin resistance gene sequence (AmpR). In one embodiment, the vector comprises SEQ ID NO: 129,219.

pSC026b_pAAV-U6sgbbSapI-XD011bb (SEQ ID NO: 129,219)

```
  1 cctgcaggca gctgcgcgct cgctcgctca ctgaggccgc ccgggcaaag cccgggcgtc
 61 gggcgacctt tggtcgcccg gcctcagtga gcgagcgagc gcgcagagag ggagtggcca
121 actccatcac taggggttcc tgcggccgca cgcgttctag aagagggcct atttcccatg
181 attccttcat atttgcatat acgatacaag gctgttagag agataattgg aattaatttg
```

-continued 241 actgtaaaca caaagatatt agtacaaaat acgtgacgta gaaagtaata atttcttggg
301 tagtttgcag ttttaaaatt atgttttaaa atggactatc atatgcttac cgtaacttga
361 aagtatttcg atttcttggc tttatatatc ttGTGGAAAG GACGAAACAC Cggaagagcg
421 agctcttctg ttttagagct aGAAAtagca agttaaaata aggctagtcc gttatcaact
481 tgaaaaagtg gcaccgagtc ggtgcTTTTT Tggtaccgtg cggaccgagc ggccgcagga
541 acccctagtg atggagttgg ccactccctc tctgcgcgct cgctcgctca ctgaggccgg
601 gcgaccaaag gtcgcccgac gcccgggctt tgcccgggcg gcctcagtga gcgagcgagc
661 gcgcagctgc ctgcaggggc gcctgatgcg gtattttctc cttacgcatc tgtgcggtat
721 ttcacaccgc atacgtcaaa gcaaccatag tacgcgccct gtagcggcgc attaagcgcg
781 gcgggtgtgg tggttacgcg cagcgtgacc gctacacttg ccagcgccct agcgcccgct
841 cctttcgctt tcttcccttc ctttctcgcc acgttcgccg gctttccccg tcaagctcta
901 aatcgggggc tccctttagg gttccgattt agtgctttac ggcacctcga ccccaaaaaa
961 cttgatttgg gtgatggttc acgtagtggg ccatcgccct gatagacggt ttttcgccct
1021 ttgacgttgg agtccacgtt ctttaatagt ggactcttgt tccaaactgg aacaacactc
1081 aaccctatct cgggctattc ttttgattta taagggattt tgccgatttc ggcctattgg
1141 ttaaaaaatg agctgattta acaaaaattt aacgcgaatt ttaacaaaat attaacgttt
1201 acaattttat ggtgcactct cagtacaatc tgctctgatg ccgcatagtt aagccagccc
1261 cgacacccgc caacacccgc tgacgcgccc tgacgggctt gtctgctccc ggcatccgct
1321 tacagacaag ctgtgaccgt ctccgggagc tgcatgtgtc agaggttttc accgtcatca
1381 ccgaaacgcg cgagacgaaa gggcctcgtg atacgcctat ttttataggt taatgtcatg
1441 ataataatgg tttcttagac gtcaggtggc acttttcggg gaaatgtgcg cggaacccct
1501 atttgtttat ttttctaaat acattcaaat atgtatccgc tcatgagaca ataaccctga
1561 taaatgcttc aataatattg aaaaaggaag agtatgagta ttcaacattt ccgtgtcgcc
1621 cttattccct tttttgcggc attttgcctt cctgtttttg ctcacccaga aacgctggtg
1681 aaagtaaaag atgctgaaga tcagttgggt gcacgagtgg gttacatcga actggatctc
1741 aacagcggta agatccttga gagttttcgc cccgaagaac gttttccaat gatgagcact
1801 tttaaagttc tgctatgtgg cgcggtatta tcccgtattg acgccgggca agagcaactc
1861 ggtcgccgca tacactattc tcagaatgac ttggttgagt actcaccagt cacagaaaag
1921 catcttacgg atggcatgac agtaagagaa ttatgcagtg ctgccataac catgagtgat
1981 aacactgcgg ccaacttact tctgacaacg atcggaggac cgaaggagct aaccgctttt
2041 ttgcacaaca tgggggatca tgtaactcgc cttgatcgtt gggaaccgga gctgaatgaa
2101 gccataccaa acgacgagcg tgacaccacg atgcctgtag caatggcaac aacgttgcgc
2161 aaactattaa ctggcgaact acttactcta gcttcccggc aacaattaat agactggatg
2221 gaggcggata aagttgcagg accacttctg cgctcggccc ttccggctgg ctggtttatt
2281 gctgataaat ctggagccgg tgagcgtggg tctcgcggta tcattgcagc actggggcca
2341 gatggtaagc cctcccgtat cgtagttatc tacacgacgg ggagtcaggc aactatggat
2401 gaacgaaata gacagatcgc tgagataggt gcctcactga ttaagcattg gtaactgtca
2461 gaccaagttt actcatatat actttagatt gatttaaaac ttcattttta atttaaaagg
2521 atctaggtga agatcctttt tgataatctc atgaccaaaa tcccttaacg tgagttttcg
2581 ttccactgag cgtcagaccc cgtagaaaag atcaaaggat cttcttgaga tectifittt -continued 2641 ctgcgcgtaa tctgctgctt gcaaacaaaa aaaccaccgc taccagcggt ggtttgtttg 2701 ccggatcaag agctaccaac tctifitccg aaggtaactg gcttcagcag agcgcagata 2761 ccaaatactg tccttctagt gtagccgtag ttaggccacc acttcaagaa ctctgtagca 2821 ccgcctacat acctcgctct gctaatcctg ttaccagtgg ctgctgccag tggcgataag 2881 tcgtgtctta ccgggttgga ctcaagacga tagttaccgg ataaggcgca gcggtcgggc 2941 tgaacggggg gttcgtgcac acagcccagc ttggagcgaa cgacctacac cgaactgaga 3001 tacctacagc gtgagctatg agaaagcgcc acgcttcccg aagggagaaa ggcggacagg 3061 tatccggtaa gcggcagggt cggaacagga gagcgcacga gggagcttcc agggggaaac 3121 gcctggtatc tttatagtcc tgtcgggttt cgccacctct gacttgagcg tcgatttttg 3181 tgatgctcgt caggggggcg gagcctatgg aaaaacgcca gcaacgcggc ctttttacgg 3241 ttcctggcct tttgctggcc ttttgctcac atgt In another aspect, the invention provides a vector comprising a 5' inverted terminal repeat (ITR) sequence, a U6 promoter sequence, a BbsI restriction site, an sgRNA expression cassette, an EFS sequence, a Thy1.1 cassette, a 3' ITR sequence and an ampicillin resistance gene sequence (AmpR). In one embodiment, the vector comprises SEQ ID NO: 129,220.

pSC025d_pAAV-U6sgbbSapI-EFS-Thy1

(SEQ ID NO: 129,220)

1 cctgcaggca gctgcgcgct cgctcgctca ctgaggccgc ccgggcaaag cccgggcgtc 61 gggcgacctt tggtcgcccg gcctcagtga gcgagcgagc gcgcagagag ggagtggcca 121 actccatcac taggggttcc tgcggccgca cgcgttctag aagagggcct atttcccatg 181 attccttcat atttgcatat acgatacaag gctgttagag agataattgg aattaatttg 241 actgtaaaca caaagatatt agtacaaaat acgtgacgta gaaagtaata atttcttggg 301 tagtttgcag ttttaaaatt atgttttaaa atggactatc atatgcttac cgtaacttga 361 aagtatttcg atttcttggc tttatatatc ttgtggaaag gacgaaacac cggaagagcg 421 agctcttctg ttttagagct agaaatagca agttaaaata aggctagtcc gttatcaact 481 tgaaaaagtg gcaccgagtc ggtgcttttt tggtacctag gtcttgaaag gagtgggaat 541 tggctccggt gcccgtcagt gggcagagcg cacatcgccc acagtccccg agaagttggg 601 gggaggggtc ggcaattgat ccggtgccta gagaaggtgg cgcggggtaa actgggaaag 661 tgatgtcgtg tactggctcc gcctttttcc cgagggtggg ggagaaccgt atataagtgc 721 agtagtcgcc gtgaacgttc tttttcgcaa cgggtttgcc gccagaacac aggcaccggt 781 tctagacgta cggccaccat gaacccagcc atcagcgtcg ctctcctgct ctcagtcttg 841 caggtgtccc gagggcagaa ggtgaccagc ctgacagcct gcctggtgaa ccaaaacctt 901 cgcctggact gccgccatga gaataacacc aaggataact ccatccagca tgagttcagc 961 ctgacccgag agaagaggaa gcacgtgctc tcaggcaccc ttgggatacc cgagcacacg 1021 taccgctccc gcgtcaccct ctccaaccag ccctatatca aggtccttac cctagccaac 1081 ttcaccacca aggatgaggg cgactacttt tgtgagcttc gcgtaagtgg cgcgaatccc 1141 atgagctcca ataaaagtat cagtgtgtat agagacaagc tggtcaagtg tggcggcata 1201 agcctgctgg ttcagaacac atcctggatg ctgctgctgc tgetttccct ctccctcctc 1261 caagccctgg acttcatttc tctgtgaagc gcttaagaat tcgatatcaa gcttaataaa 1321 agatctttat tttcattaga tctgtgtgtt ggtttttttgt gtggtaacca cgtgcggacc -continued 1381 gagcggccgc aggaacccct agtgatggag ttggccactc cctctctgcg cgctcgctcg 1441 ctcactgagg ccgggcgacc aaaggtcgcc cgacgcccgg gctttgcccg ggcggcctca 1501 gtgagcgagc gagcgcgcag ctgcctgcag gggcgcctga tgcggtattt tctccttacg 1561 catctgtgcg gtatttcaca ccgcatacgt caaagcaacc atagtacgcg ccctgtagcg 1621 gcgcattaag cgcggcgggt gtggtggtta cgcgcagcgt gaccgctaca cttgccagcg 1681 ccctagcgcc cgctcctttc gctttcttcc cttcctttct cgccacgttc gccggctttc 1741 cccgtcaagc tctaaatcgg gggctccctt tagggttccg atttagtgct ttacggcacc 1801 tcgaccccaa aaaacttgat ttgggtgatg gttcacgtag tgggccatcg ccctgataga 1861 cggtttttcg ccctttgacg ttggagtcca cgttctttaa tagtggactc ttgttccaaa 1921 ctggaacaac actcaaccct atctcgggct attcttttga tttataaggg attttgccga 1981 tttcggccta ttggttaaaa aatgagctga tttaacaaaa atttaacgcg aattttaaca 2041 aaatattaac gtttacaatt ttatggtgca ctctcagtac aatctgctct gatgccgcat 2101 agttaagcca gccccgacac ccgccaacac ccgctgacgc gccctgacgg gcttgtctgc 2161 tcccggcatc cgcttacaga caagctgtga ccgtctccgg gagctgcatg tgtcagaggt 2221 tttcaccgtc atcaccgaaa cgcgcgagac gaaagggcct cgtgatacgc ctatttttat 2281 aggttaatgt catgataata atggtttctt agacgtcagg tggcactttt cggggaaatg 2341 tgcgcggaac ccctatttgt ttattifict aaatacattc aaatatgtat ccgctcatga 2401 gacaataacc ctgataaatg cttcaataat attgaaaaag gaagagtatg agtattcaac 2461 atttccgtgt cgcccttatt cccttttttg cggcattttg ccttcctgtt tttgctcacc 2521 cagaaacgct ggtgaaagta aaagatgctg aagatcagtt gggtgcacga gtgggttaca 2581 tcgaactgga tctcaacagc ggtaagatcc ttgagagttt tcgccccgaa gaacgttttc 2641 caatgatgag cacttttaaa gttctgctat gtggcgcggt attatcccgt attgacgccg 2701 ggcaagagca actcggtcgc cgcatacact attctcagaa tgacttggtt gagtactcac 2761 cagtcacaga aaagcatctt acggatggca tgacagtaag agaattatgc agtgctgcca 2821 taaccatgag tgataacact gcggccaact tacttctgac aacgatcgga ggaccgaagg 2881 agctaaccgc ttttttgcac aacatggggg atcatgtaac tcgccttgat cgttgggaac 2941 cggagctgaa tgaagccata ccaaacgacg agcgtgacac cacgatgcct gtagcaatgg 3001 caacaacgtt gcgcaaacta ttaactggcg aactacttac tctagcttcc cggcaacaat 3061 taatagactg gatggaggcg gataaagttg caggaccact tctgcgctcg gcccttccgg 3121 ctggctggtt tattgctgat aaatctggag ccggtgagcg tgggtctcgc ggtatcattg 3181 cagcactggg gccagatggt aagccctccc gtatcgtagt tatctacacg acggggagtc 3241 aggcaactat ggatgaacga aatagacaga tcgctgagat aggtgcctca ctgattaagc 3301 attggtaact gtcagaccaa gtttactcat atatacttta gattgattta aaacttcatt 3361 tttaatttaa aaggatctag gtgaagatcc tttttgataa tctcatgacc aaaatccctt 3421 aacgtgagtt ttcgttccac tgagcgtcag accccgtaga aaagatcaaa ggatcttctt 3481 gagatccttt ttttctgcgc gtaatctgct gcttgcaaac aaaaaaacca ccgctaccag 3541 cggtggtttg tttgccggat caagagctac caactctttt tccgaaggta actggcttca 3601 gcagagcgca gataccaaat actgtccttc tagtgtagcc gtagttaggc caccacttca 3661 agaactctgt agcaccgcct acatacctcg ctctgctaat cctgttacca gtggctgctg 3721 ccagtggcga taagtcgtgt cttaccgggt tggactcaag acgatagtta ccggataagg -continued

```
3781 cgcagcggtc gggctgaacg gggggttcgt gcacacagcc cagcttggag cgaacgacct
3841 acaccgaact gagataccta cagcgtgagc tatgagaaag cgccacgctt cccgaaggga
3901 gaaaggcgga caggtatccg gtaagcggca gggtcggaac aggagagcgc acgagggagc
3961 ttccaggggg aaacgcctgg tatctttata gtcctgtcgg gtttcgccac ctctgacttg
4021 agcgtcgatt tttgtgatgc tcgtcagggg ggcggagcct atggaaaaac gccagcaacg
4081 cggccttttt acggttcctg gccttttgct ggccttttgc tcacatgt
```

In another aspect, the invention provides a vector comprising a 5' inverted terminal repeat (ITR) sequence, a U6 promoter sequence, a BbsI restriction site, an sgRNA expression cassette, an EFS sequence, a SB100x cassette, a GFP-NLS fusion cassette, a 3' ITR sequence and an ampicillin resistance gene sequence (AmpR). In one embodiment, the vector comprises SEQ ID NO: 129,221.

pSC031_pAAV-U6sgbbSapI-EFS-GFP-NLS (SEQ ID NO: 129,221)

```
   1 cctgcaggca gctgcgcgct cgctcgctca ctgaggccgc ccgggcaaag cccgggcgtc
  61 gggcgacctt tggtcgcccg gcctcagtga gcgagcgagc gcgcagagag ggagtggcca
 121 actccatcac taggggttcc tgcggccgca cgcgttctag aagagggcct atttcccatg
 181 attccttcat atttgcatat acgatacaag gctgttagag agataattgg aattaatttg
 241 actgtaaaca caaagatatt agtacaaaat acgtgacgta gaaagtaata atttcttggg
 301 tagtttgcag ttttaaaatt atgttttaaa atggactatc atatgcttac cgtaacttga
 361 aagtatttcg atttcttggc tttatatatc ttgtggaaag gacgaaacac cggaagagcg
 421 agctcttctg ttttagagct agaaatagca agttaaaata aggctagtcc gttatcaact
 481 tgaaaaagtg gcaccgagtc ggtgcttttt tggtacctag gtcttgaaag gagtgggaat
 541 tggctccggt gcccgtcagt gggcagagcg cacatcgccc acagtccccg agaagttggg
 601 gggaggggtc ggcaattgat ccggtgccta gagaaggtgg cgcggggtaa actgggaaag
 661 tgatgtcgtg tactggctcc gcctttttcc cgagggtggg ggagaaccgt atataagtgc
 721 agtagtcgcc gtgaacgttc tttttcgcaa cgggtttgcc gccagaacac aggaccggtt
 781 ctagacgtac ggccaccatg gtgagcaagg gcgaggagct gttcaccggg gtggtgccca
 841 tcctggtcga gctggacggc gacgtaaacg gccacaagtt cagcgtgtcc ggcgagggcg
 901 agggcgatgc cacctacggc aagctgaccc tgaagttcat ctgcaccacc ggcaagctgc
 961 ccgtgccctg gcccaccctc gtgaccaccc tgacctacgg cgtgcagtgc ttcagccgct
1021 accccgacca catgaagcag cacgacttct tcaagtccgc catgcccgaa ggctacgtcc
1081 aggagcgcac catcttcttc aaggacgacg gcaactacaa gacccgcgcc gaggtgaagt
1141 tcgagggcga caccctggtg aaccgcatcg agctgaaggg catcgacttc aaggaggacg
1201 gcaacatcct ggggcacaag ctggagtaca actacaacag ccacaacgtc tatatcatgg
1261 ccgacaagca gaagaacggc atcaaggtga acttcaagat ccgccacaac atcgaggacg
1321 gcagcgtgca gctcgccgac cactaccagc agaacacccc catcggcgac ggccccgtgc
1381 tgctgcccga caaccactac ctgagcaccc agtccgccct gagcaaagac cccaacgaga
1441 agcgcgatca catggtcctg ctggagttcg tgaccgccgc cgggatcact ctcggcatgg
1501 acgagctgta caagaagcgt cctgctgcta ctaagaaagc tggtcaagct aagaaaaaga
1561 aataagaatt cgatatcaag cttaataaaa gatctttatt ttcattagat ctgtgtgttg
1621 gtttttttgtg tggtaaccac gtgcggaccg agcggccgca ggaacccta gtgatggagt
```

-continued 1681 tggccactcc ctctctgcgc gctcgctcgc tcactgaggc cgggcgacca aaggtcgccc 1741 gacgcccggg ctttgcccgg gcggcctcag tgagcgagcg agcgcgcagc tgcctgcagg 1801 ggcgcctgat gcggtatttt ctccttacgc atctgtgcgg tatttcacac cgcatacgtc 1861 aaagcaacca tagtacgcgc cctgtagcgg cgcattaagc gcggcgggtg tggtggttac 1921 gcgcagcgtg accgctacac ttgccagcgc cctagcgccc gctcctttcg ctttcttccc 1981 ttcctttctc gccacgttcg ccggctttcc ccgtcaagct ctaaatcggg ggctcccttt 2041 agggttccga tttagtgctt tacggcacct cgaccccaaa aaacttgatt tgggtgatgg 2101 ttcacgtagt gggccatcgc cctgatagac ggtttttcgc cctttgacgt tggagtccac 2161 gttctttaat agtggactct tgttccaaac tggaacaaca ctcaacccta tctcgggcta 2221 ttcttttgat ttataaggga ttttgccgat ttcggcctat tggttaaaaa atgagctgat 2281 ttaacaaaaa tttaacgcga attttaacaa aatattaacg tttacaattt tatggtgcac 2341 tctcagtaca atctgctctg atgccgcata gttaagccag ccccgacacc cgccaacacc 2401 cgctgacgcg ccctgacggg cttgtctgct cccggcatcc gcttacagac aagctgtgac 2461 cgtctccggg agctgcatgt gtcagaggtt ttcaccgtca tcaccgaaac gcgcgagacg 2521 aaagggcctc gtgatacgcc tatttttata ggttaatgtc atgataataa tggtttctta 2581 gacgtcaggt ggcacttttc ggggaaatgt gcgcggaacc cctatttgtt tatttttcta 2641 aatacattca aatatgtatc cgctcatgag acaataaccc tgataaatgc ttcaataata 2701 ttgaaaaagg aagagtatga gtattcaaca tttccgtgtc gcccttattc ccttttttgc 2761 ggcattttgc cttcctgttt ttgctcaccc agaaacgctg gtgaaagtaa aagatgctga 2821 agatcagttg ggtgcacgag tgggttacat cgaactggat ctcaacagcg gtaagatcct 2881 tgagagtttt cgccccgaag aacgttttcc aatgatgagc acttttaaag ttctgctatg 2941 tggcgcggta ttatcccgta ttgacgccgg gcaagagcaa ctcggtcgcc gcatacacta 3001 ttctcagaat gacttggttg agtactcacc agtcacagaa aagcatctta cggatggcat 3061 gacagtaaga gaattatgca gtgctgccat aaccatgagt gataacactg cggccaactt 3121 acttctgaca acgatcggag gaccgaagga gctaaccgct tttttgcaca acatggggga 3181 tcatgtaact cgccttgatc gttgggaacc ggagctgaat gaagccatac caaacgacga 3241 gcgtgacacc acgatgcctg tagcaatggc aacaacgttg cgcaaactat taactggcga 3301 actacttact ctagcttccc ggcaacaatt aatagactgg atggaggcgg ataaagttgc 3361 aggaccactt ctgcgctcgg cccttccggc tggctggttt attgctgata aatctggagc 3421 cggtgagcgt gggtctcgcg gtatcattgc agcactgggg ccagatggta agccctcccg 3481 tatcgtagtt atctacacga cggggagtca ggcaactatg gatgaacgaa atagacagat 3541 cgctgagata ggtgcctcac tgattaagca ttggtaactg tcagaccaag tttactcata 3601 tatactttag attgatttaa aacttcattt ttaatttaaa aggatctagg tgaagatcct 3661 ttttgataat ctcatgacca aaatccctta acgtgagttt tcgttccact gagcgtcaga 3721 ccccgtagaa aagatcaaag gatcttcttg agatcctttt tttctgcgcg taatctgctg 3781 cttgcaaaca aaaaaaccac cgctaccagc ggtggtttgt ttgccggatc aagagctacc 3841 aactcttttt ccgaaggtaa ctggcttcag cagagcgcag ataccaaata ctgtccttct 3901 agtgtagccg tagttaggcc accacttcaa gaactctgta gcaccgccta catacctcgc 3961 tctgctaatc ctgttaccag tggctgctgc cagtggcgat aagtcgtgtc ttaccgggtt 4021 ggactcaaga cgatagttac cggataaggc gcagcggtcg ggctgaacgg ggggttcgtg -continued

```
4081 cacacagccc agcttggagc gaacgaccta caccgaactg agatacctac agcgtgagct

4141 atgagaaagc gccacgcttc ccgaagggag aaaggcggac aggtatccgg taagcggcag

4201 ggtcggaaca ggagagcgca cgagggagct tccaggggga aacgcctggt atctttatag

4261 tcctgtcggg tttcgccacc tctgacttga gcgtcgattt ttgtgatgct cgtcaggggg

4321 gcggagccta tggaaaaacg ccagcaacgc ggccttttta cggttcctgg ccttttgctg

4381 gccttttgct cacatgt
```

In certain embodiments, any of the vectors of the present invention may comprise an sgRNA expression cassette that expresses an sgRNA comprising a nucleotide sequence selected from the group consisting of SEQ ID NOs: 1-129, 209. In other embodiments, any one of the vectors may comprise an sgRNA expression cassette the expresses an sgRNA comprising a nucleotide sequence selected from the group consisting of SEQ ID NOs: 129,222-140,680. In certain embodiments, any of the vectors of the present invention may comprise an sgRNA expression cassette that expresses an sgRNA consisting of a nucleotide sequence selected from the group consisting of SEQ ID NOs: 1-129, 209. In other embodiments, any one of the vectors may comprise an sgRNA expression cassette that expresses an sgRNA consisting of a nucleotide sequence selected from the group consisting of SEQ ID NOs: 129,222-140,680.

Methods

In one aspect, the invention includes a method of genome editing and screening of a T cell in vitro. The method comprises contacting the T cell with Cas9 and an sgRNA library. The sgRNA library comprises a plurality of vectors, wherein each vector comprises an expression cassette for an sgRNA comprising a nucleotide sequence selected from the group consisting of SEQ ID NOs: 1-129,209. The contacting causes the T cell to undergo genome editing. The T cell is then screened in vitro.

In another aspect, the invention includes a method of genome editing and screening of a T cell in vitro. The method comprises contacting the T cell with Cas9 and an sgRNA library. The sgRNA library comprises a plurality of vectors, wherein each vector comprises an expression cassette for an sgRNA comprising a nucleotide sequence selected from the group consisting of SEQ ID NOs: 129, 222-140,680. The contacting causes the T cell to undergo genome editing. The T cell is then screened in vitro.

Another aspect of the invention includes a method of genome editing and screening of a T cell in vivo. The method comprises contacting an isolated T cell with Cas9 and an sgRNA library. The sgRNA library comprises a plurality of vectors, wherein each vector comprises an expression cassette for an sgRNA comprising a nucleotide sequence selected from the group consisting of SEQ ID NOs: 1-129,209. The contacting causes the T cell to undergo genome editing, thus yielding a modified T cell. The modified T cell is then administered to an animal, and the modified T cell is screened in vivo.

Yet another aspect of the invention includes a method of genome editing and screening of a T cell in vivo. The method comprises contacting an isolated T cell with Cas9 and an sgRNA library. The sgRNA library comprises a plurality of vectors, wherein each vector comprises an expression cassette for an sgRNA comprising a nucleotide sequence selected from the group consisting of SEQ ID NOs: 1-129,209. The contacting causes the T cell to undergo genome editing, thus yielding a modified T cell. The modified T cell is then administered to an animal, and the modified T cell is screened in vivo.

The T cell can be any type of T lymphocyte including but not limited to: a CD8+ cell, a CD4+ cell, or a T regulatory (Treg) cell, a Th1 cell, a Th2 cell, a Th17 cell, a follicular helper T cell (Tfh), a T memory cell, a T effector cell, a T effector memory cell, an engineered T cell, and a CAR T cell. The methods of the invention can further comprise isolating and or enriching the T cells.

In certain embodiments of the invention, the animal has a condition, which can include any condition related to or affected by T cells. Examples of such conditions can include, but are not limited to, (1) Primary immune deficiencies such as Severe Combined Immunodeficiency (SCID), DiGeorge syndrome, Hyperimmunoglobulin E syndrome (also known as Job's Syndrome), Common variable immunodeficiency (CVID) (B-cell levels are normal in circulation but with decreased production of IgG throughout the years, so it is the only primary immune disorder that presents onset in the late teens years), Chronic granulomatous disease (CGD—a deficiency in NADPH oxidase enzyme, which causes failure to generate oxygen radicals. Classical recurrent infection from catalase positive bacteria and fungi), Wiskott-Aldrich syndrome (WAS), Autoimmune lymphoproliferative syndrome (ALPS), Hyper IgM syndrome (X-linked disorder that causes a deficiency in the production of CD40 ligand on activated T-cells. This increases the production and release of IgM into circulation. The B-cell and T-cell numbers are within normal limits. Increased susceptibility to extracellular bacteria and opportunistic infections), Leukocyte adhesion deficiency (LAD), NF-κB Essential Modifier (NEMO) Mutations, Selective immunoglobulin A deficiency (the most common defect of the humoral immunity, characterized by a deficiency of IgA. Produces repeating sinopulmonary and gastrointestinal infections), X-linked agammaglobulinemia (XLA; also known as Bruton type agammaglobulinemia: characterized by a deficiency in tyrosine kinase enzyme that blocks B-cell maturation in the bone marrow. No B-cells are produced to circulation and thus, there are no immunoglobulin classes, although there tends to be a normal cell-mediated immunity), X-linked lymphoproliferative disease (XLP), Ataxia-telangiectasia; (2) Secondary immune deficiencies such as HIV/AIDS; (3) Other internal immune disorders such as immune-mediated inflammatory diseases, autoimmune disease, transplantation rejection, Graft versus Host Disease (GVHD); (4) Infections such as viral infections, bacterial infections, and parasitic infections; (5) Cancers such leukemia, liver cancer, lung cancer, melanoma, Non-Hodgkin lymphoma, pancreatic cancer, prostate cancer, and thyroid cancer.

In certain embodiments, screening T cells after the sgRNA library has been administered to the animal provides information about the specific genes involved in a condition the animal has. Screening T cells can comprise any method commonly known to one of ordinary skill in the art including but not limited to methods of nucleotide sequencing, sgRNA PCR, and/or flow cytometry.

Nucleotide sequencing or "sequencing", as it is commonly known in the art, can be performed by standard methods commonly known to one of ordinary skill in the art. In certain embodiments of the invention, sequencing is performed by targeted capture sequencing. Targeted captured sequencing can be performed as described herein, or by methods commonly performed by one of ordinary skill in the art. In certain embodiments of the invention sequencing is performed via next-generation sequencing. Next-generation sequencing (NGS), also known as high-throughput sequencing, is used herein to describe a number of different modern sequencing technologies that allow to sequence DNA and RNA much more quickly and cheaply than the previously used Sanger sequencing (Metzker, 2010, Nature Reviews Genetics 11.1: 31-46). It is based on micro- and nanotechnologies to reduce the size of sample, the reagent costs, and to enable massively parallel sequencing reactions. It can be highly multiplexed which allows simultaneous sequencing and analysis of millions of samples. NGS includes first, second, third as well as subsequent Next Generations Sequencing technologies. Data generated from NGS can be analyzed via a broad range of computational tools. The wide variety of analysis can be appreciated and performed by those skilled in the art.

Genome editing can include introducing mutations throughout the genome of the cell. The mutations introduced can be any combination of insertions or deletions, including but not limited to a single base insertion, a single base deletion, a frameshift, a rearrangement, and an insertion or deletion of 2, 3, 4, 5, 6, 7, 8, 9, 10, 15, 20, 25, 30, 40, 50, 60, 70, 80, 90, 100, 150, 200, 250, 300, any and all numbers in between, bases. The mutation can occur in a gene or in a non-coding region.

In certain embodiments of the invention, the animal is a mouse. Other animals that can be used include but are not limited to rats, rabbits, dogs, cats, horses, pigs, cows and birds. In certain embodiments, the animal is a human. The sgRNA library can be administered to an animal by any means standard in the art. For example the vectors can be injected into the animal. The injections can be intravenous, subcutaneous, intraperitoneal, or directly into a tissue or organ. In certain embodiments, the sgRNA library is adoptively transferred to the animal.

CRISPR/Cas9

The CRISPR/Cas9 system is a facile and efficient system for inducing targeted genetic alterations. Target recognition by the Cas9 protein requires a 'seed' sequence within the guide RNA (gRNA) and a conserved di-nucleotide containing protospacer adjacent motif (PAM) sequence upstream of the gRNA-binding region. The CRISPR/Cas9 system can thereby be engineered to cleave virtually any DNA sequence by redesigning the gRNA in cell lines (such as 293T cells), primary cells, and CART cells. The CRISPR/Cas9 system can simultaneously target multiple genomic loci by co-expressing a single Cas9 protein with two or more gRNAs, making this system uniquely suited for multiple gene editing or synergistic activation of target genes.

The Cas9 protein and guide RNA form a complex that identifies and cleaves target sequences. Cas9 is comprised of six domains: REC I, REC II, Bridge Helix, PAM interacting, HNK and RuvC. The RecI domain binds the guide RNA, while the Bridge helix binds to target DNA. The HNH and RuvC domains are nuclease domains. Guide RNA is engineered to have a 5' end that is complementary to the target DNA sequence. Upon binding of the guide RNA to the Cas9 protein, a conformational change occurs activating the protein. Once activated, Cas9 searches for target DNA by binding to sequences that match its protospacer adjacent motif (PAM) sequence, A PAM is a two or three nucleotide base sequence within one nucleotide downstream of the region complementary to the guide RNA. In one non-limiting example, the PAM sequence is 5'-NGG-3'. When the Cas9 protein finds its target sequence with the appropriate PAM, it melts the bases upstream of the PAM and pairs them with the complementary region on the guide RNA. Then the RuvC and HNH nuclease domains cut the target DNA after the third nucleotide base upstream of the PAM.

One non-limiting example of a CRISPR/Cas system used to inhibit gene expression, CRISPRi, is described in U.S. Patent Appl. Publ. No. US20140068797. CRISPRi induces permanent gene disruption that utilizes the RNA-guided Cas9 endonuclease to introduce DNA double stranded breaks which trigger error-prone repair pathways to result in frame shift mutations. When coexpressed with a guide RNA, a DNA recognition complex is generated that specifically interferes with transcriptional elongation, RNA polymerase binding, or transcription factor binding. This CRISPRi system efficiently represses expression of targeted genes.

CRISPR/Cas gene disruption occurs when a guide nucleic acid sequence specific for a target gene and a Cas endonuclease are introduced into a cell and form a complex that enables the Cas endonuclease to introduce a double strand break at the target gene. In certain embodiments, the CRISPR/Cas system comprises an expression vector, such as, but not limited to, an pAd5F35-CRISPR vector. In other embodiments, the Cas expression vector induces expression of Cas9 endonuclease. Other endonucleases may also be used, including but not limited to, T7, Cas3, Cas8a, Cas8b, Cas10d, Cse1, Csy1, Csn2, Cas4, Cas10, Csm2, Cmr5, Fok1, other nucleases known in the art, and any combinations thereof.

In certain embodiments, inducing the Cas expression vector comprises exposing the cell to an agent that activates an inducible promoter in the Cas expression vector. In such embodiments, the Cas expression vector includes an inducible promoter, such as one that is inducible by exposure to an antibiotic (e.g., by tetracycline or a derivative of tetracycline, for example doxycycline). However, it should be appreciated that other inducible promoters can be used. The inducing agent can be a selective condition (e.g., exposure to an agent, for example an antibiotic) that results in induction of the inducible promoter. This results in expression of the Cas expression vector.

In certain embodiments, guide RNA(s) and Cas9 can be delivered to a cell as a ribonucleoprotein (RNP) complex. RNPs are comprised of purified Cas9 protein complexed with gRNA and are well known in the art to be efficiently delivered to multiple types of cells, including but not limited to stem cells and immune cells (Addgene, Cambridge, MA, Minis Bio LLC, Madison, WI).

The guide RNA is specific for a genomic region of interest and targets that region for Cas endonuclease-induced double strand breaks. The target sequence of the guide RNA sequence may be within a loci of a gene or within a non-coding region of the genome. In certain embodiments, the guide nucleic acid sequence is at least 10, 11, 12, 13, 14, 15, 16, 17, 18, 19, 20, 21, 22, 23, 24, 25, 26, 27, 30, 31, 32, 33, 34, 35, 36, 37, 38, 39, 40 or more nucleotides in length.

In the context of formation of a CRISPR complex, "target sequence" refers to a sequence to which a guide sequence is designed to have some complementarity, where hybridization between a target sequence and a guide sequence promotes the formation of a CRISPR complex. Full complementarity is not necessarily required, provided there is sufficient complementarity to cause hybridization and promote formation of a CRISPR complex. A target sequence may comprise any polynucleotide, such as a DNA or a RNA polynucleotide. In certain embodiments, a target sequence is located in the nucleus or cytoplasm of a cell. In other embodiments, the target sequence may be within an organelle of a eukaryotic cell, for example, mitochondrion or nucleus. Typically, in the context of an endogenous CRISPR system, formation of a CRISPR complex (comprising a guide sequence hybridized to a target sequence and complexed with one or more Cas proteins) results in cleavage of one or both strands in or near (e.g., within about 1, 2, 3, 4, 5, 6, 7, 8, 9, 10, 20, 50 or more base pairs) the target sequence. As with the target sequence, it is believed that complete complementarity is not needed, provided this is sufficient to be functional.

In certain embodiments, one or more vectors driving expression of one or more elements of a CRISPR system are introduced into a host cell, such that expression of the elements of the CRISPR system direct formation of a CRISPR complex at one or more target sites. For example, a Cas enzyme, a guide sequence linked to a tracr-mate sequence, and a tracr sequence could each be operably linked to separate regulatory elements on separate vectors. Alternatively, two or more of the elements expressed from the same or different regulatory elements may be combined in a single vector, with one or more additional vectors providing any components of the CRISPR system not included in the first vector. CRISPR system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In certain embodiments, a single promoter drives expression of a transcript encoding a CRISPR enzyme and one or more of the guide sequence, tracr mate sequence (optionally operably linked to the guide sequence), and a tracr sequence embedded within one or more intron sequences (e.g., each in a different intron, two or more in at least one intron, or all in a single intron).

In certain embodiments, the CRISPR enzyme is part of a fusion protein comprising one or more heterologous protein domains (e.g. about or more than about 1, 2, 3, 4, 5, 6, 7, 8, 9, 10, or more domains in addition to the CRISPR enzyme). A CRISPR enzyme fusion protein may comprise any additional protein sequence, and optionally a linker sequence between any two domains. Examples of protein domains that may be fused to a CRISPR enzyme include, without limitation, epitope tags, reporter gene sequences, and protein domains having one or more of the following activities: methylase activity, demethylase activity, transcription activation activity, transcription repression activity, transcription release factor activity, histone modification activity, RNA cleavage activity and nucleic acid binding activity. Additional domains that may form part of a fusion protein comprising a CRISPR enzyme are described in U.S. Patent Appl. Publ. No. US20110059502, incorporated herein by reference. In certain embodiments, a tagged CRISPR enzyme is used to identify the location of a target sequence.

Conventional viral and non-viral based gene transfer methods can be used to introduce nucleic acids in mammalian and non-mammalian cells or target tissues. Such methods can be used to administer nucleic acids encoding components of a CRISPR system to cells in culture, or in a host organism. Non-viral vector delivery systems include DNA plasmids, RNA (e.g., a transcript of a vector described herein), naked nucleic acid, and nucleic acid complexed with a delivery vehicle, such as a liposome. Viral vector delivery systems include DNA and RNA viruses, which have either episomal or integrated genomes after delivery to the cell (Anderson, 1992, Science 256:808-813; and Yu, et al., 1994, Gene Therapy 1:13-26).

In certain embodiments, the CRISPR/Cas is derived from a type II CRISPR/Cas system. In other embodiments, the CRISPR/Cas system is derived from a Cas9 protein. The Cas9 protein can be from *Streptococcus pyogenes, Streptococcus thermophilus*, or other species.

In general, Cas proteins comprise at least one RNA recognition and/or RNA binding domain. RNA recognition and/or RNA binding domains interact with the guiding RNA. Cas proteins can also comprise nuclease domains (i.e., DNase or RNase domains), DNA binding domains, helicase domains, RNAse domains, protein-protein interaction domains, dimerization domains, as well as other domains. The Cas proteins can be modified to increase nucleic acid binding affinity and/or specificity, alter an enzymatic activity, and/or change another property of the protein. In certain embodiments, the Cas-like protein of the fusion protein can be derived from a wild type Cas9 protein or fragment thereof. In other embodiments, the Cas can be derived from modified Cas9 protein. For example, the amino acid sequence of the Cas9 protein can be modified to alter one or more properties (e.g., nuclease activity, affinity, stability, and so forth) of the protein. Alternatively, domains of the Cas9 protein not involved in RNA-guided cleavage can be eliminated from the protein such that the modified Cas9 protein is smaller than the wild type Cas9 protein. In general, a Cas9 protein comprises at least two nuclease (i.e., DNase) domains. For example, a Cas9 protein can comprise a RuvC-like nuclease domain and a HNH-like nuclease domain. The RuvC and HNH domains work together to cut single strands to make a double-stranded break in DNA. (Jinek, et al., 2012, Science, 337:816-821). In certain embodiments, the Cas9-derived protein can be modified to contain only one functional nuclease domain (either a RuvC-like or a HNH-like nuclease domain). For example, the Cas9-derived protein can be modified such that one of the nuclease domains is deleted or mutated such that it is no longer functional (i.e., the nuclease activity is absent). In some embodiments in which one of the nuclease domains is inactive, the Cas9-derived protein is able to introduce a nick into a double-stranded nucleic acid (such protein is termed a "nickase"), but not cleave the double-stranded DNA. In any of the above-described embodiments, any or all of the nuclease domains can be inactivated by one or more deletion mutations, insertion mutations, and/or substitution mutations using well-known methods, such as site-directed mutagenesis, PCR-mediated mutagenesis, and total gene synthesis, as well as other methods known in the art.

In one non-limiting embodiment, a vector drives the expression of the CRISPR system. The art is replete with suitable vectors that are useful in the present invention. The vectors to be used are suitable for replication and, optionally, integration in eukaryotic cells. Typical vectors contain transcription and translation terminators, initiation sequences, and promoters useful for regulation of the expression of the desired nucleic acid sequence. The vectors of the present invention may also be used for nucleic acid standard gene delivery protocols. Methods for gene delivery are known in the art (U.S. Pat. Nos. 5,399,346, 5,580,859 and 5,589,466, incorporated by reference herein in their entireties).

Further, the vector may be provided to a cell in the form of a viral vector. Viral vector technology is well known in the art and is described, for example, in Sambrook et al. ($4^{th}$ Edition, Molecular Cloning: A Laboratory Manual, Cold Spring Harbor Laboratory, New York, 2012), and in other virology and molecular biology manuals. Viruses, which are useful as vectors include, but are not limited to, retroviruses, adenoviruses, adeno-associated viruses, herpes viruses, Sindbis virus, gammaretrovirus and lentiviruses. In general, a suitable vector contains an origin of replication functional in at least one organism, a promoter sequence, convenient restriction endonuclease sites, and one or more selectable markers (e.g., WO 01/96584; WO 01/29058; and U.S. Pat. No. 6,326,193).

Introduction of Nucleic Acids

Methods of introducing nucleic acids into a cell include physical, biological and chemical methods. Physical methods for introducing a polynucleotide, such as RNA, into a host cell include calcium phosphate precipitation, lipofection, particle bombardment, microinjection, electroporation, and the like. RNA can be introduced into target cells using commercially available methods which include electroporation (Amaxa Nucleofector-II (Amaxa Biosystems, Cologne, Germany)), (ECM 830 (BTX) (Harvard Instruments, Boston, Mass.) or the Gene Pulser II (BioRad, Denver, Colo.), Multiporator (Eppendort, Hamburg Germany). RNA can also be introduced into cells using cationic liposome mediated transfection using lipofection, using polymer encapsulation, using peptide mediated transfection, or using biolistic particle delivery systems such as "gene guns" (see, for example, Nishikawa, et al. Hum Gene Ther., 12(8):861-70 (2001).

Biological methods for introducing a polynucleotide of interest into a host cell include the use of DNA and RNA vectors. Viral vectors, and especially retroviral vectors, have become the most widely used method for inserting genes into mammalian, e.g., human cells. Other viral vectors can be derived from lentivirus, poxviruses, herpes simplex virus I, adenoviruses and adeno-associated viruses, and the like. See, for example, U.S. Pat. Nos. 5,350,674 and 5,585,362.

Chemical means for introducing a polynucleotide into a host cell include colloidal dispersion systems, such as macromolecule complexes, nanocapsules, microspheres, beads, and lipid-based systems including oil-in-water emulsions, micelles, mixed micelles, and liposomes. An exemplary colloidal system for use as a delivery vehicle in vitro and in vivo is a liposome (e.g., an artificial membrane vesicle).

Regardless of the method used to introduce exogenous nucleic acids into a host cell or otherwise expose a cell to the inhibitor of the present invention, in order to confirm the presence of the nucleic acids in the host cell, a variety of assays may be performed. Such assays include, for example, "molecular biological" assays well known to those of skill in the art, such as Southern and Northern blotting, RT-PCR and PCR; "biochemical" assays, such as detecting the presence or absence of a particular peptide, e.g., by immunological means (ELISAs and Western blots) or by assays described herein to identify agents falling within the scope of the invention.

It should be understood that the method and compositions that would be useful in the present invention are not limited to the particular formulations set forth in the examples. The following examples are put forth so as to provide those of ordinary skill in the art with a complete disclosure and description, and are not intended to limit the scope of what the inventors regard as their invention.

The practice of the present invention employs, unless otherwise indicated, conventional techniques of molecular biology (including recombinant techniques), microbiology, cell biology, biochemistry and immunology, which are well within the purview of the skilled artisan. Such techniques are explained fully in the literature, such as, "Molecular Cloning: A Laboratory Manual", fourth edition (Sambrook et al. (2012) Molecular Cloning, Cold Spring Harbor Laboratory); "Oligonucleotide Synthesis" (Gait, M. J. (1984). Oligonucleotide synthesis. IRL press); "Culture of Animal Cells" (Freshney, R. (2010). Culture of animal cells. Cell Proliferation, 15(2.3), 1); "Methods in Enzymology" "Weir's Handbook of Experimental Immunology" (Wiley-Blackwell; 5 edition (Jan. 15, 1996); "Gene Transfer Vectors for Mammalian Cells" (Miller and Carlos, (1987) Cold Spring Harbor Laboratory, New York); "Short Protocols in Molecular Biology" (Ausubel et al., Current Protocols; 5 edition (Nov. 5, 2002)); "Polymerase Chain Reaction: Principles, Applications and Troubleshooting", (Babar, M., VDM Verlag Dr. Müller (Aug. 17, 2011)); "Current Protocols in Immunology" (Coligan, John Wiley & Sons, Inc. Nov. 1, 2002).

Those skilled in the art will recognize, or be able to ascertain using no more than routine experimentation, numerous equivalents to the specific procedures, embodiments, claims, and examples described herein. Such equivalents were considered to be within the scope of this invention and covered by the claims appended hereto. For example, it should be understood, that modifications in reaction conditions, including but not limited to reaction times, reaction size/volume, and experimental reagents, such as solvents, catalysts, pressures, atmospheric conditions, e.g., nitrogen atmosphere, and reducing/oxidizing agents, with art-recognized alternatives and using no more than routine experimentation, are within the scope of the present application.

It is to be understood that wherever values and ranges are provided herein, all values and ranges encompassed by these values and ranges, are meant to be encompassed within the scope of the present invention. Moreover, all values that fall within these ranges, as well as the upper or lower limits of a range of values, are also contemplated by the present application.

The following examples further illustrate aspects of the present invention. However, they are in no way a limitation of the teachings or disclosure of the present invention as set forth herein.

EXPERIMENTAL EXAMPLES

The invention is now described with reference to the following Examples. These Examples are provided for the purpose of illustration only, and the invention is not limited to these Examples, but rather encompasses all variations that are evident as a result of the teachings provided herein.

The materials and methods employed in these experiments are now described.

Mice: Various strains of mice between the ages of 6-12 weeks of age were used for the present study described. OT-I TCR transgenic mice (OT-I mice) were described by Hogquist et al., Cell 76, 17-27 (1994). Constitutive Cas9-2A-EGFP mice (Cas9 mice) were described by Platt et al., Cell 159, 440-455 (2014). OT-I; Cas9 mice were generated by breeding OT-I and Cas9 mice and genotyped according to Jackson Lab protocol. Naive $CD8^+$ T cells were isolated from OT-I mice, Cas9 mice, and OT-I; Cas9 mice. All animals were housed in standard individually ventilated, pathogen-free conditions, with 12 h:12 h or 13 h:11 h light cycle, room temperature (21-23° C.) and 40-60% relative humidity. When a cohort of animals were receiving multiple treatments, animals were randomized by 1) randomly assign animals to different groups using littermates, 2) random mixing of females prior to treatment, maximizing the evenness or representation of mice from different cages in each group, and/or 3) random assignment of mice to each group, in order to minimize the effect of gender, litter, small difference in age, cage, housing position, where applicable.

Generation of a T cell CRISPR vector (sgRNA-Thy1.1 Expression Vector): A lentiviral T cell CRISPR vector, lenti-pLKO-U6-sgRNA(BsmBI)-EFS-Thy1.1CO-spA, was generated by codon-optimizing and subcloning Thy1.1 and sgRNA expression cassette into a lentiviral vector via Gibson Assembly. Three versions of the vector were generated to enable robust genome editing in T cells.

```
pSC017_pLKO-U6-sgBsmBI-EFS-Thy11CO-spA (SEQ ID NO: 129,213):
ttaatgtagtcttatgcaatactcttgtagtcttgcaacatggtaacgatgagttagcaacatgccttac

aaggagagaaaaagcaccgtgcatgccgattggtggaagtaaggtggtacgatcgtgccttattaggaag

gcaacagacgggtctgacatggattggacgaaccactgaattgccgcattgcagagatattgtatttaag

tgcctagctcgatacataaacgggtctctctggttagaccagatctgagcctgggagctctctggctaac

tagggaacccactgcttaagcctcaataaagcttgccttgagtgcttcaagtagtgtgtgcccgtctgtt

gtgtgactctggtaactagagatccctcagacccttttagtcagtgtggaaaatctctagcagtggcgcc

cgaacagggacttgaaagcgaaagggaaaccagaggagctctctcgacgcaggactcggcttgctgaagc

gcgcacggcaagaggcgaggggcggcgactggtgagtacgccaaaaattttgactagcggaggctagaag

gagagagatgggtgcgagagcgtcagtattaagcgggggagaattagatcgcgatgggaaaaaattcggt

taaggccagggggaaagaaaaaatataaattaaaacatatagtatgggcaagcagggagctagaacgatt

cgcagttaatcctggcctgttagaaacatcagaaggctgtagacaaatactgggacagctacaaccatcc

cttcagacaggatcagaagaacttagatcattatataatacagtagcaaccctctattgtgtgcatcaaa

ggatagagataaaagacaccaaggaagctttagacaagatagaggaagagcaaaacaaaagtaagaccac

cgcacagcaagcggccgctgatcttcagacctggaggaggagatatgagggacaattggagaagtgaatt

atataaatataaagtagtaaaaattgaaccattaggagtagcacccaccaaggcaaagagaagagtggtg

cagagagaaaaaagagcagtgggaataggagctttgttccttgggttcttgggagcagcaggaagcacta

tgggcgcagcgtcaatgacgctgacggtacaggccagacaattattgtctggtatagtgcagcagcagaa

caatttgctgagggctattgaggcgcaacagcatctgttgcaactcacagtctggggcatcaagcagctc

caggcaagaatcctggctgtggaaagatacctaaaggatcaacagctcctggggatttggggttgctctg

gaaaactcatttgcaccactgctgtgccttggaatgctagttggagtaataaatctctggaacagatttg

gaatcacacgacctggatggagtgggacagagaaattaacaattacacaagcttaatacactccttaatt

gaagaatcgcaaaaccagcaagaaaagaatgaacaagaattattggaattagataaatgggcaagtttgt

ggaattggtttaacataacaaattggctgtggtatataaaattattcataatgatagtaggaggcttggt

aggtttaagaatagtttttgctgtactttctatagtgaatagagttaggcagggatattcaccattatcg

tttcagacccacctcccaaccccgaggggacccagagagggcctatttcccatgattccttcatatttgc

atatacgatacaaggctgttagagagataattagaattaatttgactgtaaacacaaagatattagtaca

aaatacgtgacgtagaaagtaataatttcttgggtagtttgcagttttaaaattatgttttaaaatggac

tatcatatgcttaccgtaacttgaaagtatttcgatttcttggctttatatatcttGTGGAAAGGACGAA

ACACCgGAGACGgaCGTCTCtgttttagagctaGAAAtagcaagttaaaataaggctagtccgttatcaa

cttgaaaaagtggcaccgagtcggtgcTTTTTTaagcttggcgtaactagatcttgagacaaatggcagt

attcatccacaattttaaaagaaaaggggggattggggggtacagtgcaggggaaagaatagtagacata

atagcaacagacatacaaactaaagaattacaaaaacaaattacaaaaattcaaaattttcgggtttatt

acagggacagcagagatccactttggcgccggctcgagggggcccggggaattcgctagctaggtcttga

aaggagtgggaattggctccggtgcccgtcagtgggcagagcgcacatcgcccacagtccccgagaagtt
```

-continued gggggggaggggtcggcaattgatccggtgcctagagaaggtggcgcggggtaaactgggaaagtgatgtc
gtgtactggctccgcctttttcccgagggtgggggagaaccgtatataagtgcagtagtcgccgtgaacg
ttctttttcgcaacgggtttgccgccagaacacaggaccggttctagacgtacggccaccATGAACCCAG
CCATCAGCGTCGCTCTCCTGCTCTCAGICTTGCAGGTGTCCCGAGGGCAGAAGGTGACCAGCCTGACAGC
CTGCCTGGTGAACCAAAACCTTCGCCTGGACTGCCGCCATGAGAATAACACCAAGGATAACTCCATCCAG
CATGAGTTCAGCCTGACCCGAGAGAAGAGGAAGCACGTGCTCTCAGGCACCCTTGGGATACCCGAGCACA
CGTACCGCTCCCGCGTCACCCTCTCCAACCAGCCCTATATCAAGGTCCTTACCCTAGCCAACTTCACCAC
CAAGGATGAGGGCGACTACTTTTGTGAGCTTCGCGTAAGTGGCGCGAATCCCATGAGCTCCAATAAAAGT
ATCAGTGTGTATAGAGACAAGCTGGTCAAGTGTGGCGGCATAAGCCTGCTGGTTCAGAACACATCCTGGA
TGCTGCTGCTGCTGCTTTCCCTCTCCCTCCTCCAAGCCCTGGACTTCATTTCTCTGTGAagcgctAATAA
AAGATCTTTATTTTCATTAGATCTGTGTGTTGGTTTTTTGTGTGacgtgcggtcgactttaagaccaatg
acttacaaggcagctgtagatcttagccactttttaaaagaaaaggggggactggaagggctaattcact
cccaacgaagacaagatctgctttttgcttgtactgggtctctctggttagaccagatctgagcctggga
gctctctggctaactagggaacccactgcttaagcctcaataaagcttgccttgagtgcttcaagtagtg
tgtgcccgtctgttgtgtgactctggtaactagagatccctcagacccttttagtcagtgtggaaaatct
ctagcagtacgtatagtagttcatgtcatcttattattcagtatttataacttgcaaagaaatgaatatc
agagagtgagaggaacttgtttattgcagcttataatggttacaaataaagcaatagcatcacaaatttc
acaaataaagcatttttttcactgcattctagttgtggtttgtccaaactcatcaatgtatcttatcatg
tctggctctagctatcccgcccctaactccgcccatcccgcccctaactccgcccagttccgcccattct
ccgccccatggctgactaattttttttatttatgcagaggccgaggccgcctcggcctctgagctattcc
agaagtagtgaggaggcttttttggaggcctagggacgtacccaattcgccctatagtgagtcgtattac
gcgcgctcactggccgtcgttttacaacgtcgtgactgggaaaaccctggcgttacccaacttaatcgcc
ttgcagcacatcccccttcgccagctggcgtaatagcgaagaggcccgcaccgatcgcccttcccaaca
gttgcgcagcctgaatggcgaatgggacgcgccctgtagcggcgcattaagcgcggcgggtgtggtggtt
acgcgcagcgtgaccgctacacttgccagcgccctagcgcccgctcctttcgctttcttcccttcctttc
tcgccacgttcgccggctttccccgtcaagctctaaatcgggggctccctttagggttccgatttagtgc
tttacggcacctcgaccccaaaaaacttgattagggtgatggttcacgtagtgggccatcgccctgatag
acggtttttcgccctttgacgttggagtccacgttctttaatagtggactcttgttccaaactggaacaa
cactcaaccctatctcggtctattcttttgatttataagggattttgccgatttcggcctattggttaaa
aaatgagctgatttaacaaaaatttaacgcgaattttaacaaaatattaacgcttacaatttaggtggca
cttttcggggaaatgtgcgcggaacccctatttgtttatttttctaaatacattcaaatatgtatccgct
catgagacaataaccctgataaatgcttcaataatattgaaaaaggaagagtatgagtattcaacatttc
cgtgtcgcccttattcccttttttgcggcattttgccttcctgtttttgctcacccagaaacgctggtga
aagtaaaagatgctgaagatcagttgggtgcacgagtgggttacatcgaactggatctcaacagcggtaa
gatccttgagagttttcgccccgaagaacgttttccaatgatgagcacttttaaagttctgctatgtggc
gcggtattatcccgtattgacgccgggcaagagcaactcggtcgccgcatacactattctcagaatgact
tggttgagtactcaccagtcacagaaaagcatcttacggatggcatgacagtaagagaattatgcagtgc
tgccataaccatgagtgataacactgcggccaacttacttctgacaacgatcggaggaccgaaggagcta
accgcttttttgcacaacatgggggatcatgtaactcgccttgatcgttgggaaccggagctgaatgaag
ccataccaaacgacgagcgtgacaccacgatgcctgtagcaatggcaacaacgttgcgcaaactattaac
tggcgaactacttactctagcttcccggcaacaattaatagactggatggaggcggataaagttgcagga -continued ccacttctgcgctcggcccttccggctggctggtttattgctgataaatctggagccggtgagcgtgggt ctcgcggtatcattgcagcactggggccagatggtaagccctcccgtatcgtagttatctacacgacggg gagtcaggcaactatggatgaacgaaatagacagatcgctgagataggtgcctcactgattaagcattgg taactgtcagaccaagtttactcatatatactttagattgatttaaaacttcatttttaatttaaaagga tctaggtgaagatcctttttgataatctcatgaccaaaatcccttaacgtgagttttcgttccactgagc gtcagaccccgtagaaaagatcaaaggatcttcttgagatcctttttttctgcgcgtaatctgctgcttg caaacaaaaaaaccaccgctaccagcggtggtttgtttgccggatcaagagctaccaactctttttccga aggtaactggcttcagcagagcgcagataccaaatactgttcttctagtgtagccgtagttaggccacca cttcaagaactctgtagcaccgcctacatacctcgctctgctaatcctgttaccagtggctgctgccagt ggcgataagtcgtgtcttaccgggttggactcaagacgatagttaccggataaggcgcagcggtcgggct gaacggggggttcgtgcacacagcccagcttggagcgaacgacctacaccgaactgagatacctacagcg tgagctatgagaaagcgccacgcttcccgaagggagaaaggcggacaggtatccggtaagcggcagggtc ggaacaggagagcgcacgagggagcttccagggggaaacgcctggtatctttatagtcctgtcgggtttc gccacctctgacttgagcgtcgatttttgtgatgctcgtcaggggggcggagcctatggaaaaacgccag caacgcggcctttttacggttcctggccttttgctggccttttgctcacatgttctttcctgcgttatcc cctgattctgtggataaccgtattaccgcctttgagtgagctgataccgctcgccgcagccgaacgaccg agcgcagcgagtcagtgagcgaggaagcggaagagcgcccaatacgcaaaccgcctctccccgcgcgttg gccgattcattaatgcagctggcacgacaggtttcccgactggaaagcgggcagtgagcgcaacgcaatt aatgtgagttagctcactcattaggcaccccaggctttacactttatgcttccggctcgtatgttgtgtg gaattgtgagcggataacaatttcacacaggaaacagctatgaccatgattacgccaagcgcgcaattaa ccctcactaaagggaacaaaagctggagctgcaagc pSC008_pLKO-U6-BsmBI-chRNA(+85)-EFS-Thy11 (SEQ ID NO: 129,214):

1 ttaatgtagt cttatgcaat actcttgtag tcttgcaaca tggtaacgat gagttagcaa 61 catgccttac aaggagagaa aaagcaccgt gcatgccgat tggtggaagt aaggtggtac 121 gatcgtgcct tattaggaag gcaacagacg ggtctgacat ggattggacg aaccactgaa 181 ttgccgcatt gcagagatat tgtatttaag tgcctagctc gatacataaa cgggtctctc 241 tggttagacc agatctgagc ctgggagctc tctggctaac tagggaaccc actgcttaag 301 cctcaataaa gcttgccttg agtgcttcaa gtagtgtgtg cccgtctgtt gtgtgactct 361 ggtaactaga gatccctcag acccttttag tcagtgtgga aaatctctag cagtggcgcc 421 cgaacaggga cttgaaagcg aaagggaaac cagaggagct ctctcgacgc aggactcggc 481 ttgctgaagc gcgcacggca agaggcgagg ggcggcgact ggtgagtacg ccaaaaattt 541 tgactagcgg aggctagaag gagagagatg ggtgcgagag cgtcagtatt aagcggggga 601 gaattagatc gcgatgggaa aaaattcggt taaggccagg gggaaagaaa aaatataaat 661 taaaacatat agtatgggca agcagggagc tagaacgatt cgcagttaat cctggcctgt 721 tagaaacatc agaaggctgt agacaaatac tgggacagct acaaccatcc cttcagacag 781 gatcagaaga acttagatca ttatataata cagtagcaac cctctattgt gtgcatcaaa 841 ggatagagat aaaagacacc aaggaagctt tagacaagat agaggaagag caaaacaaaa 901 gtaagaccac cgcacagcaa gcggccgctg atcttcagac ctggaggagg agatatgagg 961 gacaattgga gaagtgaatt atataaatat aaagtagtaa aaattgaacc attaggagta 1021 gcacccacca aggcaaagag aagagtggtg cagagagaaa aaagagcagt gggaatagga 1081 gctttgttcc ttgggttctt gggagcagca ggaagcacta tgggcgcagc gtcaatgacg -continued

```
1141 ctgacggtac aggccagaca attattgtct ggtatagtgc agcagcagaa caatttgctg
1201 agggctattg aggcgcaaca gcatctgttg caactcacag tctggggcat caagcagctc
1261 caggcaagaa tcctggctgt ggaaagatac ctaaaggatc aacagctcct ggggatttgg
1321 ggttgctctg gaaaactcat ttgcaccact gctgtgcctt ggaatgctag ttggagtaat
1381 aaatctctgg aacagatttg gaatcacacg acctggatgg agtgggacag agaaattaac
1441 aattacacaa gcttaataca ctccttaatt gaagaatcgc aaaaccagca agaaaagaat
1501 gaacaagaat tattggaatt agataaatgg gcaagtttgt ggaattggtt taacataaca
1561 aattggctgt ggtatataaa attattcata atgatagtag gaggcttggt aggtttaaga
1621 atagtttttg ctgtactttc tatagtgaat agagttaggc agggatattc accattatcg
1681 tttcagaccc acctcccaac cccgagggga cccagagagg gcctatttcc catgattcct
1741 tcatatttgc atatacgata caaggctgtt agagagataa ttagaattaa tttgactgta
1801 aacacaaaga tattagtaca aaatacgtga cgtagaaagt aataatttct tgggtagttt
1861 gcagttttaa aattatgttt taaaatggac tatcatatgc ttaccgtaac ttgaaagtat
1921 ttcgatttct tggctttata tatcttGTGG AAAGGACGAA ACACCgGAGA CGgaCGTCTC
1981 tgttttagag ctaGAAAtag caagttaaaa taaggctagt ccgttatcaa cttgaaaaag
2041 tggcaccgag tcggtgcTTT TTTaagcttg gcgtaactag atcttgagac aaatggcagt
2101 attcatccac aattttaaaa gaaaaggggg gattgggggg tacagtgcag gggaaagaat
2161 agtagacata atagcaacag acatacaaac taaagaatta caaaaacaaa ttacaaaaat
2221 tcaaaatttt cgggtttatt acagggacag cagagatcca ctttggcgcc ggctcgaggg
2281 ggcccgggga attcgctagc taggtcttga aaggagtggg aattggctcc ggtgcccgtc
2341 agtgggcaga gcgcacatcg cccacagtcc ccgagaagtt ggggggaggg gtcggcaatt
2401 gatccggtgc ctagagaagg tggcgcgggg taaactggga aagtgatgtc gtgtactggc
2461 tccgcctttt tcccgagggt gggggagaac cgtatataag tgcagtagtc gccgtgaacg
2521 ttctttttcg caacgggttt gccgccagaa cacaggaccg gttctagacg tacggccacc
2581 ATGAACCCAG CCATCAGCGT CGCTCTCCTG CTCTCAGTCT TGCAGGTGTC CCGAGGGCAG
2641 AAGGTGACCA GCCTGACAGC CTGCCTGGTG AACCAAAACC TTCGCCTGGA CTGCCGCCAT
2701 GAGAATAACA CCAAGGATAA CTCCATCCAG CATGAGTTCA GCCTGACCCG AGAGAAGAGG
2761 AAGCACGTGC TCTCAGGCAC CCTTGGGATA CCCGAGCACA CGTACCGCTC CCGCGTCACC
2821 CTCTCCAACC AGCCCTATAT CAAGGTCCTT ACCCTAGCCA ACTTCACCAC CAAGGATGAG
2881 GGCGACTACT TTTGTGAGCT TCGCGTCTCG GGCGCGAATC CCATGAGCTC CAATAAAAGT
2941 ATCAGTGTGT ATAGAGACAA GCTGGTCAAG TGTGGCGGCA TAAGCCTGCT GGTTCAGAAC
3001 ACATCCTGGA TGCTGCTGCT GCTGCTTTCC CTCTCCCTCC TCCAAGCCCT GGACTTCATT
3061 TCTCTGTGAa gcgctAATAA AAGATCTTTA TTTTCATTAG ATCTGTGTGT TGGTTTTTTG
3121 TGTggtaaCT CGAGacgtgc ggtcgacttt aagaccaatg acttacaagg cagctgtaga
3181 tcttagccac tttttaaaag aaaagggggg actggaaggg ctaattcact cccaacgaag
3241 acaagatctg ctttttgctt gtactgggtc tctctggtta gaccagatct gagcctggga
3301 gctctctggc taactaggga acccactgct taagcctcaa taaagcttgc cttgagtgct
3361 tcaagtagtg tgtgcccgtc tgttgtgtga ctctggtaac tagagatccc tcagaccctt
3421 ttagtcagtg tggaaaatct ctagcagtac gtatagtagt tcatgtcatc ttattattca
3481 gtatttataa cttgcaaaga aatgaatatc agagagtgag aggaacttgt ttattgcagc
```

-continued

```
3541 ttataatggt tacaaataaa gcaatagcat cacaaatttc acaaataaag catttttttc
3601 actgcattct agttgtggtt tgtccaaact catcaatgta tcttatcatg tctggctcta
3661 gctatcccgc ccctaactcc gcccatcccg cccctaactc cgcccagttc cgcccattct
3721 ccgccccatg gctgactaat tttttttatt tatgcagagg ccgaggccgc ctcggcctct
3781 gagctattcc agaagtagtg aggaggcttt tttggaggcc tagggacgta cccaattcgc
3841 cctatagtga gtcgtattac gcgcgctcac tggccgtcgt tttacaacgt cgtgactggg
3901 aaaaccctgg cgttacccaa cttaatcgcc ttgcagcaca tccccctttc gccagctggc
3961 gtaatagcga agaggcccgc accgatcgcc cttcccaaca gttgcgcagc ctgaatggcg
4021 aatgggacgc gccctgtagc ggcgcattaa gcgcggcggg tgtggtggtt acgcgcagcg
4081 tgaccgctac acttgccagc gccctagcgc ccgctccttt cgctttcttc ccttcctttc
4141 tcgccacgtt cgccggcttt ccccgtcaag ctctaaatcg ggggctccct ttagggttcc
4201 gatttagtgc tttacggcac ctcgacccca aaaaacttga ttagggtgat ggttcacgta
4261 gtgggccatc gccctgatag acggtttttc gccctttgac gttggagtcc acgttcttta
4321 atagtggact cttgttccaa actggaacaa cactcaaccc tatctcggtc tattcttttg
4381 atttataagg gattttgccg atttcggcct attggttaaa aaatgagctg atttaacaaa
4441 aatttaacgc gaattttaac aaaatattaa cgcttacaat ttaggtggca cttttcgggg
4501 aaatgtgcgc ggaaccccta tttgtttatt tttctaaata cattcaaata tgtatccgct
4561 catgagacaa taaccctgat aaatgcttca ataatattga aaaaggaaga gtatgagtat
4621 tcaacatttc cgtgtcgccc ttattccctt ttttgcggca ttttgccttc ctgtttttgc
4681 tcacccagaa acgctggtga aagtaaaaga tgctgaagat cagttgggtg cacgagtggg
4741 ttacatcgaa ctggatctca acagcggtaa gatccttgag agttttcgcc ccgaagaacg
4801 ttttccaatg atgagcactt ttaaagttct gctatgtggc gcggtattat cccgtattga
4861 cgccgggcaa gagcaactcg gtcgccgcat acactattct cagaatgact tggttgagta
4921 ctcaccagtc acagaaaagc atcttacgga tggcatgaca gtaagagaat tatgcagtgc
4981 tgccataacc atgagtgata acactgcggc caacttactt ctgacaacga tcggaggacc
5041 gaaggagcta accgcttttt tgcacaacat gggggatcat gtaactcgcc ttgatcgttg
5101 ggaaccggag ctgaatgaag ccataccaaa cgacgagcgt gacaccacga tgcctgtagc
5161 aatggcaaca acgttgcgca aactattaac tggcgaacta cttactctag cttcccggca
5221 acaattaata gactggatgg aggcggataa agttgcagga ccacttctgc gctcggccct
5281 tccggctggc tggtttattg ctgataaatc tggagccggt gagcgtgggt ctcgcggtat
5341 cattgcagca ctggggccag atggtaagcc ctcccgtatc gtagttatct acacgacggg
5401 gagtcaggca actatggatg aacgaaatag acagatcgct gagataggtg cctcactgat
5461 taagcattgg taactgtcag accaagttta ctcatatata ctttagattg atttaaaact
5521 tcatttttaa tttaaaagga tctaggtgaa gatccttttt gataatctca tgaccaaaat
5581 cccttaacgt gagttttcgt tccactgagc gtcagacccc gtagaaaaga tcaaaggatc
5641 ttcttgagat cctttttttc tgcgcgtaat ctgctgcttg caaacaaaaa aaccaccgct
5701 accagcggtg gtttgtttgc cggatcaaga gctaccaact ctttttccga aggtaactgg
5761 cttcagcaga gcgcagatac caaatactgt tcttctagtg tagccgtagt taggccacca
5821 cttcaagaac tctgtagcac cgcctacata cctcgctctg ctaatcctgt taccagtggc
5881 tgctgccagt ggcgataagt cgtgtcttac cgggttggac tcaagacgat agttaccgga
5941 taaggcgcag cggtcgggct gaacgggggg ttcgtgcaca cagcccagct tggagcgaac
```

-continued

```
6001 gacctacacc gaactgagat acctacagcg tgagctatga gaaagcgcca cgcttcccga
6061 agggagaaag gcggacaggt atccggtaag cggcagggtc ggaacaggag agcgcacgag
6121 ggagcttcca gggggaaacg cctggtatct ttatagtcct gtcgggtttc gccacctctg
6181 acttgagcgt cgatttttgt gatgctcgtc aggggggcgg agcctatgga aaaacgccag
6241 caacgcggcc tttttacggt tcctggcctt ttgctggcct tttgctcaca tgttctttcc
6301 tgcgttatcc cctgattctg tggataaccg tattaccgcc tttgagtgag ctgataccgc
6361 tcgccgcagc cgaacgaccg agcgcagcga gtcagtgagc gaggaagcgg aagagcgccc
6421 aatacgcaaa ccgcctctcc ccgcgcgttg gccgattcat taatgcagct ggcacgacag
6481 gtttcccgac tggaaagcgg gcagtgagcg caacgcaatt aatgtgagtt agctcactca
6541 ttaggcaccc caggctttac actttatgct tccggctcgt atgttgtgtg gaattgtgag
6601 cggataacaa tttcacacag gaaacagcta tgaccatgat tacgccaagc gcgcaattaa
6661 ccctcactaa agggaacaaa agctggagct gcaagc
```

pSC021_pLKO-U6-sgBsmBI-PGK-Thy11CO-spA.sbd (SEQ ID NO: 129,215):

```
   1 ttaatgtagt cttatgcaat actcttgtag tcttgcaaca tggtaacgat gagttagcaa
  61 catgccttac aaggagagaa aaagcaccgt gcatgccgat tggtggaagt aaggtggtac
 121 gatcgtgcct tattaggaag gcaacagacg ggtctgacat ggattggacg aaccactgaa
 181 ttgccgcatt gcagagatat tgtatttaag tgcctagctc gatacataaa cgggtctctc
 241 tggttagacc agatctgagc ctgggagctc tctggctaac tagggaaccc actgcttaag
 301 cctcaataaa gcttgccttg agtgcttcaa gtagtgtgtg cccgtctgtt gtgtgactct
 361 ggtaactaga gatccctcag acccttttag tcagtgtgga aaatctctag cagtggcgcc
 421 cgaacaggga cttgaaagcg aaagggaaac cagaggagct ctctcgacgc aggactcggc
 481 ttgctgaagc gcgcacggca agaggcgagg ggcggcgact ggtgagtacg ccaaaaattt
 541 tgactagcgg aggctagaag gagagagatg ggtgcgagag cgtcagtatt aagcggggga
 601 gaattagatc gcgatgggaa aaaattcggt taaggccagg gggaaagaaa aaatataaat
 661 taaaacatat agtatgggca agcagggagc tagaacgatt cgcagttaat cctggcctgt
 721 tagaaacatc agaaggctgt agacaaatac tgggacagct acaaccatcc cttcagacag
 781 gatcagaaga acttagatca ttatataata cagtagcaac cctctattgt gtgcatcaaa
 841 ggatagagat aaaagacacc aaggaagctt tagacaagat agaggaagag caaaacaaaa
 901 gtaagaccac cgcacagcaa gcggccgctg atcttcagac ctggaggagg agatatgagg
 961 gacaattgga gaagtgaatt atataaatat aaagtagtaa aaattgaacc attaggagta
1021 gcacccacca aggcaaagag aagagtggtg cagagagaaa aaagagcagt gggaatagga
1081 gctttgttcc ttgggttctt gggagcagca ggaagcacta tgggcgcagc gtcaatgacg
1141 ctgacggtac aggccagaca attattgtct ggtatagtgc agcagcagaa caatttgctg
1201 agggctattg aggcgcaaca gcatctgttg caactcacag tctggggcat caagcagctc
1261 caggcaagaa tcctggctgt ggaaagatac ctaaaggatc aacagctcct ggggatttgg
1321 ggttgctctg gaaaactcat ttgcaccact gctgtgcctt ggaatgctag ttggagtaat
1381 aaatctctgg aacagatttg gaatcacacg acctggatgg agtgggacag agaaattaac
1441 aattacacaa gcttaataca ctccttaatt gaagaatcgc aaaaccagca agaaaagaat
1501 gaacaagaat tattggaatt agataaatgg gcaagtttgt ggaattggtt taacataaca
1561 aattggctgt ggtatataaa attattcata atgatagtag gaggcttggt aggtttaaga
1621 atagtttttg ctgtactttc tatagtgaat agagttaggc agggatattc accattatcg
```

-continued 1681 tttcagaccc acctcccaac cccgagggga cccagagagg gcctatttcc catgattcct 1741 tcatatttgc atatacgata caaggctgtt agagagataa ttagaattaa tttgactgta 1801 aacacaaaga tattagtaca aaatacgtga cgtagaaagt aataatttct tgggtagttt 1861 gcagttttaa aattatgttt taaaatggac tatcatatgc ttaccgtaac ttgaaagtat 1921 ttcgatttct tggctttata tatcttGTGG AAAGGACGAA ACACCgGAGA CGgaCGTCTC 1981 tgttttagag ctaGAAAtag caagttaaaa taaggctagt ccgttatcaa cttgaaaaag 2041 tggcaccgag tcggtgcTTT TTTaagcttg gcgtaactag atcttgagac aaatggcagt 2101 attcatccac aattttaaaa gaaaaggggg gattgggggg tacagtgcag gggaaagaat 2161 agtagacata atagcaacag acatacaaac taaagaatta caaaaacaaa ttacaaaaat 2221 tcaaaatttt cgggtttatt acagggacag cagagatcca ctttggcgcc ggctcgaggg 2281 ggcccgggga attcgctagc gtctgaagag gagtttacgt ccagccaagc ttaggatctc 2341 gacctcgaaa ttctaccggg taggggaggc gcttttccca aggcagtctg gagcatgcgc 2401 tttagcagcc ccgctggcac ttggcgctac acaagtggcc tctggcctcg cacacattcc 2461 acatccaccg gtagcgccaa ccggctccgt tctttggtgg ccccttcgcg ccaccttcta 2521 ctcctcccct agtcaggaag ttcccccccg ccccgcagct cgcgtcgtgc aggacgtgac 2581 aaatggaagt agcatgtcac actagtctcg tgcagatgga cagcaccgct gagcaatgga 2641 agcgggtagg cctttggggc agcggccaat agcagctttg ctccttcgct ttctgggctc 2701 agcagctggg aagggtgggt ccgggggcgg gctcaggggc gggctcaggg gcggggcggg 2761 cgcccgaagg tcctccggag gcccggcatt ctgcacgctt caaaagcgca cgtctgccgc 2821 gctgttctcc tcttcctcat ctccgggcct ttcgacctgc atccatctag atctcgagca 2881 gctgaagctt aaccggttct agacgtacgg ccaccATGAA CCCAGCCATC AGCGTCGCTC

2941 TCCTGCTCTC AGTCTTGCAG GTGTCCCGAG GGCAGAAGGT GACCAGCCTG ACAGCCTGCC

3001 TGGTGAACCA AAACCTTCGC CTGGACTGCC GCCATGAGAA TAACACCAAG GATAACTCCA

3061 TCCAGCATGA GTTCAGCCTG ACCCGAGAGA AGAGGAAGCA CGTGCTCTCA GGCACCCTTG

3121 GGATACCCGA GCACACGTAC CGCTCCCGCG TCACCCTCTC CAACCAGCCC TATATCAAGG

3181 TCCTTACCCT AGCCAACTTC ACCACCAAGG ATGAGGGCGA CTACTTTTGT GAGCTTCGCG

3241 TAAGTGGCGC GAATCCCATG AGCTCCAATA AAAGTATCAG TGTGTATAGA GACAAGCTGG

3301 TCAAGTGTGG CGGCATAAGC CTGCTGGTTC AGAACACATC CTGGATGCTG CTGCTGCTGC

3361 TTTCCCTCTC CCTCCTCCAA GCCCTGGACT TCATTTCTCT GTGAagcgct AATAAAAGAT

3421 CTTTATTTTC ATTAGATCTG TGTGTTGGTT TTTTGTGTGa cgtgcggtcg actttaagac 3481 caatgactta caaggcagct gtagatctta gccacttttt aaaagaaaag gggggactgg 3541 aagggctaat tcactcccaa cgaagacaag atctgctttt tgcttgtact gggtctctct 3601 ggttagacca gatctgagcc tgggagctct ctggctaact agggaaccca ctgcttaagc 3661 ctcaataaag cttgccttga gtgcttcaag tagtgtgtgc ccgtctgttg tgtgactctg 3721 gtaactagag atccctcaga cccttttagt cagtgtggaa aatctctagc agtacgtata 3781 gtagttcatg tcatcttatt attcagtatt tataacttgc aaagaaatga atatcagaga 3841 gtgagaggaa cttgtttatt gcagcttata atggttacaa ataaagcaat agcatcacaa 3901 atttcacaaa taaagcattt ttttcactgc attctagttg tggtttgtcc aaactcatca 3961 atgtatctta tcatgtctgg ctctagctat cccgccccta actccgccca tcccgcccct 4021 aactccgccc agttccgccc attctccgcc ccatggctga ctaatttttt ttatttatgc -continued 4081 agaggccgag gccgcctcgg cctctgagct attccagaag tagtgaggag gctttttttgg 4141 aggcctaggg acgtacccaa ttcgccctat agtgagtcgt attacgcgcg ctcactggcc 4201 gtcgttttac aacgtcgtga ctgggaaaac cctggcgtta cccaacttaa tcgccttgca 4261 gcacatcccc ctttcgccag ctggcgtaat agcgaagagg cccgcaccga tcgcccttcc 4321 caacagttgc gcagcctgaa tggcgaatgg gacgcgccct gtagcggcgc attaagcgcg 4381 gcgggtgtgg tggttacgcg cagcgtgacc gctacacttg ccagcgccct agcgcccgct 4441 cctttcgctt tcttcccttc ctttctcgcc acgttcgccg gctttccccg tcaagctcta 4501 aatcgggggc tccctttagg gttccgattt agtgctttac ggcacctcga ccccaaaaaa 4561 cttgattagg gtgatggttc acgtagtggg ccatcgccct gatagacggt ttttcgccct 4621 ttgacgttgg agtccacgtt ctttaatagt ggactcttgt tccaaactgg aacaacactc 4681 aaccctatct cggtctattc ttttgattta taagggattt tgccgatttc ggcctattgg 4741 ttaaaaaatg agctgattta acaaaaattt aacgcgaatt ttaacaaaat attaacgctt 4801 acaatttagg tggcactttt cggggaaatg tgcgcggaac ccctatttgt ttatttttct 4861 aaatacattc aaatatgtat ccgctcatga gacaataacc ctgataaatg cttcaataat 4921 attgaaaaag gaagagtatg agtattcaac atttccgtgt cgcccttatt cccttttttg 4981 cggcattttg ccttcctgtt tttgctcacc cagaaacgct ggtgaaagta aaagatgctg 5041 aagatcagtt gggtgcacga gtgggttaca tcgaactgga tctcaacagc ggtaagatcc 5101 ttgagagttt tcgccccgaa gaacgttttc caatgatgag cacttttaaa gttctgctat 5161 gtggcgcggt attatcccgt attgacgccg ggcaagagca actcggtcgc cgcatacact 5221 attctcagaa tgacttggtt gagtactcac cagtcacaga aaagcatctt acggatggca 5281 tgacagtaag agaattatgc agtgctgcca taaccatgag tgataacact gcggccaact 5341 tacttctgac aacgatcgga ggaccgaagg agctaaccgc ttttttgcac aacatggggg 5401 atcatgtaac tcgccttgat cgttgggaac cggagctgaa tgaagccata ccaaacgacg 5461 agcgtgacac cacgatgcct gtagcaatgg caacaacgtt gcgcaaacta ttaactggcg 5521 aactacttac tctagcttcc cggcaacaat taatagactg gatggaggcg gataaagttg 5581 caggaccact tctgcgctcg gcccttccgg ctggctggtt tattgctgat aaatctggag 5641 ccggtgagcg tgggtctcgc ggtatcattg cagcactggg gccagatggt aagccctccc 5701 gtatcgtagt tatctacacg acggggagtc aggcaactat ggatgaacga aatagacaga 5761 tcgctgagat aggtgcctca ctgattaagc attggtaact gtcagaccaa gtttactcat 5821 atatacttta gattgattta aaacttcatt tttaatttaa aaggatctag gtgaagatcc 5881 tttttgataa tctcatgacc aaaatccctt aacgtgagtt ttcgttccac tgagcgtcag 5941 accccgtaga aaagatcaaa ggatcttctt gagatccttt ttttctgcgc gtaatctgct 6001 gcttgcaaac aaaaaaacca ccgctaccag cggtggtttg tttgccggat caagagctac 6061 caactctttt tccgaaggta actggcttca gcagagcgca gataccaaat actgttcttc 6121 tagtgtagcc gtagttaggc caccacttca agaactctgt agcaccgcct acatacctcg 6181 ctctgctaat cctgttacca gtggctgctg ccagtggcga taagtcgtgt cttaccgggt 6241 tggactcaag acgatagtta ccggataagg cgcagcggtc gggctgaacg gggggttcgt 6301 gcacacagcc cagcttggag cgaacgacct acaccgaact gagataccta cagcgtgagc 6361 tatgagaaag cgccacgctt cccgaaggga gaaaggcgga caggtatccg gtaagcggca 6421 gggtcggaac aggagagcgc acgagggagc ttccaggggg aaacgcctgg tatctttata 6481 gtcctgtcgg gtttcgccac ctctgacttg agcgtcgatt tttgtgatgc tcgtcagggg -continued

```
6541 ggcggagcct atggaaaaac gccagcaacg cggccttttt acggttcctg gccttttgct
6601 ggccttttgc tcacatgttc tttcctgcgt tatcccctga ttctgtggat aaccgtatta
6661 ccgcctttga gtgagctgat accgctcgcc gcagccgaac gaccgagcgc agcgagtcag
6721 tgagcgagga agcggaagag cgcccaatac gcaaaccgcc tctccccgcg cgttggccga
6781 ttcattaatg cagctggcac gacaggtttc ccgactggaa agcgggcagt gagcgcaacg
6841 caattaatgt gagttagctc actcattagg caccccaggc tttacacttt atgcttccgg
6901 ctcgtatgtt gtgtggaatt gtgagcggat aacaatttca cacaggaaac agctatgacc
6961 atgattacgc caagcgcgca attaaccctc actaaaggga acaaaagctg gagctgcaag
7021 c
```

Genome-scale mouse T cell CRISPR library cloning: The original mouse CRISPR knockout library, in two sub-libraries (mGeCKOa and mGeCKOb) was from Sanjana et al., Nat Methods 11, 783-784 (2014). mGeCKOa and mGeCKOb were sub-cloned in equal molar, by Gibson assembly and electroporation, into the T cell CRISPR vector to generate the Genome-scale mouse T cell CRISPR library (MKO), with a total of 129,209 sgRNAs including 1,000 non-targeting controls (NTCs). An estimated library coverage of >50× (~$7\times10^6$ total colonies) was achieved in electroporation. The library was subsequently sequence-verified by Illumina sequencing. At least 94.1% (121,608/129,209) of unique sgRNAs the whole library cloned, targeting 98.3% (22,375/22,768) of all protein coding genes and microRNAs in the mouse genome, with a tight log-normal distribution representing the vast majority of all designed sgRNAs (90% within 2 orders of magnitude, 99% within 3 orders of magnitude).

Viral library production: The MKO library plasmid was transfected into low-passage HEK293FT cells at 80% confluency in 15 cm tissue culture plates. Viral supernatant was collected at 48 h and 72 h post-transfection, filtered via a 0.45 μm filtration unit (Fisher/VWR), and concentrated using AmiconUltra 100 kD ultracentrifugation units (Millipore), aliquoted and stored in −80° C. until use. Virus for empty vector was produced in a similar manner.

T cell isolation and culture: Spleens and mesenteric lymph nodes (mLNs) were isolated from various indicated mouse strains, and placed in ice-cold 2% FBS [FBS (Sigma)+RPMI-1640 (Lonza)]. Organs were prepared by mashing organs through a 100 μm filter. Lymphocytes were suspended in 2% FBS. RBCs were lysed with 1 ml of ACK Lysis Buffer (Lonza) per spleen, incubated for 2 mins at room temperature, and washed with 2% FBS. Lymphocytes were filtered through a 40 μm filter and resuspended with MACS Buffer (PBS+0.5% BSA+2 μM EDTA). Naive $CD8^+$ T cells were isolated using the protocol and kit established by Miltenyi. Naive $CD8^+$ T cells were resuspended with cRPMI (RPMI-1640+10% FBS+2 mM L-Glutamine+100 U Pen/Strep (Fisher)+49 nM β-mercaptoethanol (Sigma)) to a final concentration of $1\times10^6$ cells/ml. Medium for in vivo experiments was supplemented with 2 ng/ml IL-2+2.5 ng/ml IL-7+50 ng/ml IL-15+1 μg/ml anti-CD28. Medium for in vitro experiments was supplemented with 2 ng/ml IL-2+2 ng/ml IL-12p70+1 μg/ml anti-CD28. Cells were cultured on plates pretreated with 5 μg/ml anti-CD3 and incubated at 37° C. Various cytokines and antibodies were purchased from BD, Biolegend and eBiosciences.

T cell transduction, virus titration: T cells were infected in culture immediately after isolation by directly adding concentrated virus into the media. 3 days after infection, T cells were stained for Thy1.1 expression and analyzed on FACS. Viral titer was determined for each batch by the number of $Thy1.1^+$ T cells normalized to total T cells divided by the volume of virus used. At least 3 doses of viruses with experimental duplicates were used for determining viral titer.

Antibody and Flow Cytometry: Infectivity of $CD8^+$ T cells was assessed via surface staining with anti-CD3ε APC, anti-CD8α FITC, and anti-Thy1.1 PE. Biolegend antibodies used in experiments include anti-CD3ε PE/Cy7, anti-CD8α APC, anti-CD16/32, CD62L PE, CD107a PE, anti-GranzymeA PE, anti-SIINFEKL:H-$2K^b$ PE, and anti-Thy1.1 PE. Anti-human/mouse DHX37/Dhx37 was purchased from Novus Biologicals. Anti-rabbit IgG AF594 was purchased from cell signaling. For surface stains, cells were stained on ice for 30 mins. Samples were collected on a BD FACSAria cell sorter with 3 lasers, and analyzed using FlowJo software 9.9.4 (Treestar, Ashland, OR) on a MAC® workstation.

Library-scale viral transduction of T cells: T cells were isolated and cultured as described herein. With the viral titer information, for each infection replicate, a total of $>1\times10^8$ Cas9 or naive OT-I; Cas9 $CD8^+$ T cells were transduced at a MOI of 1 with concentrated lentivirus containing the MKO library described above, to achieve an initial library coverage of >700×. Transduction with the virus containing the empty vector was performed in parallel with a total of $>1\times10^7$ naive $CD8^+$ T cells. Unlike cancer cell screens, pooled screens in primary cells often use relatively high MOI (Chen et al., (2014) Immunity 41, 325-338; Zhou et al., (2014) Nature 506, 52-57), as sufficient infectivity is necessary to reach sufficient on-target efficiency in these cells. Multiple computational strategies were used to generate quantitative ranked list of genes and to distinguish mis-association or false-positives from potential true hits with strong selection, including usage of independent infection replicates, different mice, independent screens, different TCRs, and independent sgRNAs. In each experiment, 3 infection replicates were applied for generation of T cell library unless otherwise noted.

Adoptive transfer of viral library infected T cells and tissue processing: At day 0 of the culture, naive $CD8^+$ T cells were infected with the lentiviral MKO library, and incubated at 37° C. for 3 days. On day 3 of culture, T cells were collected, washed with ice-cold PBS, and resuspended to a final concentration of $5\times10^7$ cells/ml. $1\times10^7$ cells were injected intravenously into each mouse. C57BL/6 (B6), B6.129, B6.129.Fvb, Cas9, or $Rag1^{-/-}$ mice were used as recipient mice in respective experiments. All adoptive cell transfer experiments in this study were done without lymphodepletion unless otherwise noted. On 7-day post-transfer, mice were sacrificed, and relevant organs were isolated. Skin draining lymph nodes were comprised of inguinal, popliteal, axillary, and brachial lymph nodes. Cervical lymph nodes isolated entailed the 6 superficial cervical lymph nodes. Abdominal lymph nodes included the mesenteric and pancreatic lymph nodes. Other relevant organs isolated were the spleen, liver, pancreas, lung, muscle and brain.

Generation of a neoantigen expression vector (mCherry-cOVA Expression Vector): A lentiviral mCherry-cOVA (mCh-cOVA) vector, lenti-pLKO-U6-sg(BsmBI)-EF S-mCherry-2A-cOVA, was generated by subcloning cOVA into a mCherry lentiviral vector via Gibson Assembly.

```
pMD02: lenti-pLKO-U6-sgBsmBI-EFS-mCherry-2A-cOVA (SEQ ID NO: 129,216):
     1 ttaatgtagt cttatgcaat actcttgtag tcttgcaaca tggtaacgat gagttagcaa

    61 catgccttac aaggagagaa aaagcaccgt gcatgccgat tggtggaagt aaggtggtac

   121 gatcgtgcct tattaggaag gcaacagacg ggtctgacat ggattggacg aaccactgaa

   181 ttgccgcatt gcagagatat tgtatttaag tgcctagctc gatacataaa cgggtctctc

   241 tggttagacc agatctgagc ctgggagctc tctggctaac tagggaaccc actgcttaag

   301 cctcaataaa gcttgccttg agtgcttcaa gtagtgtgtg cccgtctgtt gtgtgactct

   361 ggtaactaga gatccctcag acccttttag tcagtgtgga aaatctctag cagtggcgcc

   421 cgaacaggga cttgaaagcg aaagggaaac cagaggagct ctctcgacgc aggactcggc

   481 ttgctgaagc gcgcacggca agaggcgagg ggcggcgact ggtgagtacg ccaaaaattt

   541 tgactagcgg aggctagaag gagagagatg ggtgcgagag cgtcagtatt aagcggggga

   601 gaattagatc gcgatgggaa aaaattcggt taaggccagg gggaaagaaa aaatataaat

   661 taaaacatat agtatgggca agcagggagc tagaacgatt cgcagttaat cctggcctgt

   721 tagaaacatc agaaggctgt agacaaatac tgggacagct acaaccatcc cttcagacag

   781 gatcagaaga acttagatca ttatataata cagtagcaac cctctattgt gtgcatcaaa

   841 ggatagagat aaaagacacc aaggaagctt tagacaagat agaggaagag caaaacaaaa

   901 gtaagaccac cgcacagcaa gcggccgctg atcttcagac ctggaggagg agatatgagg

   961 gacaattgga gaagtgaatt atataaatat aaagtagtaa aaattgaacc attaggagta

  1021 gcacccacca aggcaaagag aagagtggtg cagagagaaa aaagagcagt gggaatagga

  1081 gctttgttcc ttgggttctt gggagcagca ggaagcacta tgggcgcagc gtcaatgacg

  1141 ctgacggtac aggccagaca attattgtct ggtatagtgc agcagcagaa caatttgctg

  1201 agggctattg aggcgcaaca gcatctgttg caactcacag tctggggcat caagcagctc

  1261 caggcaagaa tcctggctgt ggaaagatac ctaaaggatc aacagctcct ggggatttgg

  1321 ggttgctctg gaaaactcat ttgcaccact gctgtgcctt ggaatgctag ttggagtaat

  1381 aaatctctgg aacagatttg gaatcacacg acctggatgg agtgggacag agaaattaac

  1441 aattacacaa gcttaataca ctccttaatt gaagaatcgc aaaaccagca agaaaagaat

  1501 gaacaagaat tattggaatt agataaatgg gcaagtttgt ggaattggtt taacataaca

  1561 aattggctgt ggtatataaa attattcata atgatagtag gaggcttggt aggtttaaga

  1621 atagtttttg ctgtactttc tatagtgaat agagttaggc agggatattc accattatcg

  1681 tttcagaccc acctcccaac cccgagggga cccagagagg gcctatttcc catgattcct

  1741 tcatatttgc atatacgata caaggctgtt agagagataa ttagaattaa tttgactgta

  1801 aacacaaaga tattagtaca aaatacgtga cgtagaaagt aataatttct tgggtagttt

  1861 gcagttttaa aattatgttt taaaatggac tatcatatgc ttaccgtaac ttgaaagtat

  1921 ttcgatttct tggctttata tatcttGTGG AAAGGACGAA ACACCgGAGA CGgaCGTCTC

  1981 tgttttagag ctaGAAAtag caagttaaaa taaggctagt ccgttatcaa cttgaaaaag

  2041 tggcaccgag tcggtgcTTT TTTaagcttg gcgtaactag atcttgagac aaatggcagt

  2101 attcatccac aattttaaaa gaaaaggggg gattgggggg tacagtgcag gggaaagaat

  2161 agtagacata atagcaacag acatacaaac taaagaatta caaaaacaaa ttacaaaaat
```

-continued 2221 tcaaaatttt cgggtttatt acagggacag cagagatcca ctttggcgcc ggctcgaggg
2281 ggcccgggtg caaagatgga taaagtttta aacagagagg aatctttgca gctaatggac
2341 cttctaggtc ttgaaaggag tgggaattgg ctccggtgcc cgtcagtggg cagagcgcac
2401 atcgcccaca gtccccgaga agttgggggg aggggtcggc aattgatccg gtgcctagag
2461 aaggtggcgc ggggtaaact gggaaagtga tgtcgtgtac tggctccgcc tttttcccga
2521 gggtggggga gaaccgtata taagtgcagt agtcgccgtg aacgttcttt ttcgcaacgg
2581 gtttgccgcc agaacacagg taagtgccgt gtgtggttcc cgcgggcctg gcctctttac
2641 gggttatggc ccttgcgtgc cttgaattac ttccactggc tgcagtacgt gattcttgat
2701 cccgagcttc gggttggaag tgggtgggag agttcgaggc cttgcgctta aggagcccct
2761 tcgcctcgtg cttgagttga ggcctggcct gggcgctggg gccgccgcgt gcgaatctgg
2821 tggcaccttc gcgcctgtct cgctgctttc gataagtctc tagccattta aaatttttga
2881 tgacctgctg cgacgctttt tttctggcaa gatagtcttg taaatgcggg ccaagatctg
2941 cacactggta tttcggtttt tggggccgcg ggcggcgacg gggcccgtgc gtcccagcgc
3001 acatgttcgg cgaggcgggg cctgcgagcg cggccaccga gaatcggacg ggggtagtct
3061 caagctggcc ggcctgctct ggtgcctggc ctcgcgccgc cgtgtatcgc cccgccctgg
3121 gcggcaaggc tggcccggtc ggcaccagtt gcgtgagcgg aaagatggcc gcttcccggc
3181 cctgctgcag ggagctcaaa atggaggacg cggcgctcgg gagagcgggc gggtgagtca
3241 cccacacaaa ggaaaagggc ctttccgtcc tcagccgtcg cttcatgtga ctccacggag
3301 taccgggcgc cgtccaggca cctcgattag ttctcgagct tttggagtac gtcgtcttta
3361 ggttgggggg aggggtttta tgcgatggag tttccccaca ctgagtgggt ggagactgaa
3421 gttaggccag cttggcactt gatgtaattc tccttggaat ttgccctttt tgagtttgga
3481 tcttggttca ttctcaagcc tcagacagtg gttcaaagtt tttttcttcc atttcaggtg
3541 tcgtgacgta cggccaccat gGTGAGCAAG GGCGAGGAGG ATAACATGGC CATCATCAAG
3601 GAGTTCATGC GCTTCAAGGT GCACATGGAG GGCTCCGTGA ACGGCCACGA GTTCGAGATC
3661 GAGGGCGAGG GCGAGGGCCG CCCCTACGAG GGCACCCAGA CCGCCAAGCT GAAGGTGACC
3721 AAGGGTGGCC CCCTGCCCTT CGCCTGGGAC ATCCTGTCCC CTCAGTTCAT GTACGGCTCC
3781 AAGGCCTACG TGAAGCACCC CGCCGACATC CCCGACTACT TGAAGCTGTC CTTCCCCGAG
3841 GGCTTCAAGT GGGAGCGCGT GATGAACTTC GAGGACGGCG GCGTGGTGAC CGTGACCCAG
3901 GACTCCTCCC TGCAGGACGG CGAGTTCATC TACAAGGTGA AGCTGCGCGG CACCAACTTC
3961 CCCTCCGACG GCCCCGTAAT GCAGAAGAAG ACCATGGGCT GGGAGGCCTC CTCCGAGCGG
4021 ATGTACCCCG AGGACGGCGC CCTGAAGGGC GAGATCAAGC AGAGGCTGAA GCTGAAGGAC
4081 GGCGGCCACT ACGACGCTGA GGTCAAGACC ACCTACAAGG CCAAGAAGCC CGTGCAGCTG
4141 CCCGGCGCCT ACAACGTCAA CATCAAGTTG GACATCACCT CCCACAACGA GGACTACACC
4201 ATCGTGGAAC AGTACGAACG CGCCGAGGGC CGCCACTCCA CCGGCGGCAT GGACGAGCTG
4261 TACAAGGGCA GTGGAGAGGG CAGAGGAAGT CTGCTAACAT GCGGTGACGT CGAGGAGAAT
4321 CCTGGCCCAA TGGGCTCCAT CGGCGCAGCA AGCATGGAAT TTTGTTTTGA TGTATTCAAG
4381 GAGCTCATCA ATTCCTGGGT AGAAAGTCAG ACAAATGGAA TTATCAGAAA TGTCCTTCAG
4441 CCAAGCTCCG TGGATTCTCA AACTGCAATG GTTCTGGTTA ATGCCATTGT CTTCAAAGGA
4501 CTGTGGGAGA AAACATTTAA GGATGAAGAC ACACAAGCAA TGCCTTTCAG AGTGACTGAG
4561 CAAGAAAGCA AACCTGTGCA GATGATGTAC CAGATTGGTT TATTTAGAGT GGCATCAATG -continued

4621 GCTTCTGAGA AAATGAAGAT CCTGGAGCTT CCATTTGCCA GTGGGACAAT GAGCATGTTG

4681 GTGCTGTTGC CTGATGAAGT CTCAGGCCTT GAGCAGCTTG AGAGTATAAT CAACTTTGAA

4741 AAACTGACTG AATGGACCAG TTCTAATGTT ATGGAAGAGA GGAAGATCAA AGTGTACTTA

4801 CCTCGCATGA AGATGGAGGA AAAATACAAC CTCACATCTG TCTTAATGGC TATGGGCATT

4861 ACTGACGTGT TTAGCTCTTC AGCCAATCTG TCTGGCATCT CCTCAGCAGA GAGCCTGAAG

4921 ATATCTCAAG CTGTCCATGC AGCACATGCA GAAATCAATG AAGCAGGCAG AGAGGTGGTA

4981 GGGTCAGCAG AGGCTGGAGT GGATGCTGCA AGCGTCTCTG AAGAATTTAG GGCTGACCAT

5041 CCATTCCTCT TCTGTATCAA GCACATCGCA ACCAACGCCG TTCTCTTCTT TGGCAGATGT

5101 GTTTCCCCTT AAacgcgtta agtcgacaat caacctctgg attacaaaat ttgtgaaaga 5161 ttgactggta ttcttaacta tgttgctcct tttacgctat gtggatacgc tgctttaatg 5221 cctttgtatc atgctattgc ttcccgtatg gctttcattt tctcctcctt gtataaatcc 5281 tggttgctgt ctctttatga ggagttgtgg cccgttgtca ggcaacgtgg cgtggtgtgc 5341 actgtgtttg ctgacgcaac ccccactggt tggggcattg ccaccacctg tcagctcctt 5401 tccgggactt tcgctttccc cctccctatt gccacggcgg aactcatcgc cgcctgcctt 5461 gcccgctgct ggacaggggc tcggctgttg ggcactgaca attccgtggt gttgtcgggg 5521 aaatcatcgt cctttccttg gctgctcgcc tgtgttgcca cctggattct gcgcgggacg 5581 tccttctgct acgtcccttc ggccctcaat ccagcggacc ttccttcccg cggcctgctg 5641 ccggctctgc ggcctcttcc gcgtcttcgc cttcgccctc agacgagtcg gatctccctt 5701 tgggccgcct ccccgcgtcg actttaagac caatgactta caaggcagct gtagatctta 5761 gccacttttt aaaagaaaag gggggactgg aagggctaat tcactcccaa cgaagacaag 5821 atctgctttt tgcttgtact gggtctctct ggttagacca gatctgagcc tgggagctct 5881 ctggctaact agggaaccca ctgcttaagc ctcaataaag cttgccttga gtgcttcaag 5941 tagtgtgtgc ccgtctgttg tgtgactctg gtaactagag atccctcaga cccttttagt 6001 cagtgtggaa aatctctagc agtacgtata gtagttcatg tcatcttatt attcagtatt 6061 tataacttgc aaagaaatga atatcagaga gtgagaggaa cttgtttatt gcagcttata 6121 atggttacaa ataaagcaat agcatcacaa atttcacaaa taaagcattt ttttcactgc 6181 attctagttg tggtttgtcc aaactcatca atgtatctta tcatgtctgg ctctagctat 6241 cccgccccta actccgccca tcccgcccct aactccgccc agttccgccc attctccgcc 6301 ccatggctga ctaatttttt ttatttatgc agaggccgag gccgcctcgg cctctgagct 6361 attccagaag tagtgaggag gcttttttgg aggcctaggg acgtacccaa ttcgccctat 6421 agtgagtcgt attacgcgcg ctcactggcc gtcgttttac aacgtcgtga ctgggaaaac 6481 cctggcgtta cccaacttaa tcgccttgca gcacatcccc ctttcgccag ctggcgtaat 6541 agcgaagagg cccgcaccga tcgcccttcc caacagttgc gcagcctgaa tggcgaatgg 6601 gacgcgccct gtagcggcgc attaagcgcg gcgggtgtgg tggttacgcg cagcgtgacc 6661 gctacacttg ccagcgccct agcgcccgct cctttcgctt tcttcccttc ctttctcgcc 6721 acgttcgccg gctttccccg tcaagctcta aatcgggggc tccctttagg gttccgattt 6781 agtgctttac ggcacctcga ccccaaaaaa cttgattagg gtgatggttc acgtagtggg 6841 ccatcgccct gatagacggt ttttcgccct ttgacgttgg agtccacgtt ctttaatagt 6901 ggactcttgt tccaaactgg aacaacactc aaccctatct cggtctattc ttttgattta 6961 taagggattt tgccgatttc ggcctattgg ttaaaaaatg agctgattta acaaaaattt 7021 aacgcgaatt ttaacaaaat attaacgctt acaatttagg tggcactttt cggggaaatg -continued

```
7081 tgcgcggaac ccctatttgt ttatttttct aaatacattc aaatatgtat ccgctcatga
7141 gacaataacc ctgataaatg cttcaataat attgaaaaag gaagagtatg agtattcaac
7201 atttccgtgt cgcccttatt cccttttttg cggcattttg ccttcctgtt tttgctcacc
7261 cagaaacgct ggtgaaagta aaagatgctg aagatcagtt gggtgcacga gtgggttaca
7321 tcgaactgga tctcaacagc ggtaagatcc ttgagagttt tcgccccgaa gaacgttttc
7381 caatgatgag cacttttaaa gttctgctat gtggcgcggt attatcccgt attgacgccg
7441 ggcaagagca actcggtcgc cgcatacact attctcagaa tgacttggtt gagtactcac
7501 cagtcacaga aaagcatctt acggatggca tgacagtaag agaattatgc agtgctgcca
7561 taaccatgag tgataacact gcggccaact tacttctgac aacgatcgga ggaccgaagg
7621 agctaaccgc ttttttgcac aacatggggg atcatgtaac tcgccttgat cgttgggaac
7681 cggagctgaa tgaagccata ccaaacgacg agcgtgacac cacgatgcct gtagcaatgg
7741 caacaacgtt gcgcaaacta ttaactggcg aactacttac tctagcttcc cggcaacaat
7801 taatagactg gatggaggcg gataaagttg caggaccact tctgcgctcg gcccttccgg
7861 ctggctggtt tattgctgat aaatctggag ccggtgagcg tgggtctcgc ggtatcattg
7921 cagcactggg gccagatggt aagccctccc gtatcgtagt tatctacacg acggggagtc
7981 aggcaactat ggatgaacga aatagacaga tcgctgagat aggtgcctca ctgattaagc
8041 attggtaact gtcagaccaa gtttactcat atatacttta gattgattta aaacttcatt
8101 tttaatttaa aaggatctag gtgaagatcc tttttgataa tctcatgacc aaaatccctt
8161 aacgtgagtt ttcgttccac tgagcgtcag accccgtaga aaagatcaaa ggatcttctt
8221 gagatccttt ttttctgcgc gtaatctgct gcttgcaaac aaaaaaacca ccgctaccag
8281 cggtggtttg tttgccggat caagagctac caactctttt tccgaaggta actggcttca
8341 gcagagcgca gataccaaat actgttcttc tagtgtagcc gtagttaggc caccacttca
8401 agaactctgt agcaccgcct acatacctcg ctctgctaat cctgttacca gtggctgctg
8461 ccagtggcga taagtcgtgt cttaccgggt tggactcaag acgatagtta ccggataagg
8521 cgcagcggtc gggctgaacg gggggttcgt gcacacagcc cagcttggag cgaacgacct
8581 acaccgaact gagataccta cagcgtgagc tatgagaaag cgccacgctt cccgaaggga
8641 gaaaggcgga caggtatccg gtaagcggca gggtcggaac aggagagcgc acgagggagc
8701 ttccaggggg aaacgcctgg tatctttata gtcctgtcgg gtttcgccac ctctgacttg
8761 agcgtcgatt tttgtgatgc tcgtcagggg ggcggagcct atggaaaaac gccagcaacg
8821 cggccttttt acggttcctg gccttttgct ggccttttgc tcacatgttc tttcctgcgt
8881 tatcccctga ttctgtggat aaccgtatta ccgcctttga gtgagctgat accgctcgcc
8941 gcagccgaac gaccgagcgc agcgagtcag tgagcgagga agcggaagag cgcccaatac
9001 gcaaaccgcc tctccccgcg cgttggccga ttcattaatg cagctggcac gacaggtttc
9061 ccgactggaa agcgggcagt gagcgcaacg caattaatgt gagttagctc actcattagg
9121 caccccaggc tttacacttt atgcttccgg ctcgtatgtt gtgtggaatt gtgagcggat
9181 aacaatttca cacaggaaac agctatgacc atgattacgc caagcgcgca attaaccctc
9241 actaaaggga acaaaagctg gagctgcaag c
```

Generation of stably transfected mCherry-cOVA expressing cell line: E0771 murine breast cancer cells were transduced with mCh-cOVA-expressing lentivirus. After 3 days post-transduction, transduced E0771 cells were cultured individually in 96-well plates by resuspending cells to 10 cells/ml and culturing 100 μl of cell suspension in each well. Two weeks later, clonal $mCh^+$E0771 clones were identified by fluorescence microscopy. $mCh^+$E0771 clones were stained with established anti-mouse [H-2$K^b$ bound to SIINFEKL] antibody (Porgador et al., Immunity 6, 715-726

(1997)) to determine cOVA expression. Different $mCh^+$ $cOVA^+$ clones were selected based on cOVA expression. E0771 cells were pulsed with varying concentrations of SIINFEKL peptide for 4 hours at 37° C., and subsequently stained with an the established antibody described elsewhere herein. $mCh^+cOVA^+$E0771 clones were compared to SIINFEKL-pulsed cells. Clone 3 was chosen for in vivo experiments because of its low, uniform expression of cOVA to select for genes with stronger phenotypes. In addition, a LCC-mChcOVA cell line was generated by transducing a mouse lung cancer cell line.

Transplantation of cancer cells into $Rag1^{-/-}$ mice and tissue processing: $5\times10^6$ $mCh^+cOVA^+$E0771 cells were injected either subcutaneously or into the intra-mammary fat pad of $Rag1^{-/-}$ mice. Ten days post-transplantation, viral library infected T cells, were intravenously injected in tumor-bearing $Rag1^{-/-}$ mice. After 7 days, draining lymph nodes, non-draining lymph nodes, spleens, lungs, and tumors were isolated. Samples were prepared for DNA extraction or FACS analysis.

Spleens and lymph nodes were prepared as described elsewhere herein. Tumors were broken down into smaller fragments, about the size of lentils. Tumors were then dissociated with 1 μg/ml Collagenase IV for 30 minutes using GentleMacs Octo dissociator from Miltenyi, and cell suspensions were passed through 100 μm filter twice before staining.

Degranulation (kill) assay in genome-scale CRISPR screening and validation: Experiments were first optimized by pulsing E0771 cells with varying concentrations of SIINFEKL peptide for 4 hours at 37° C., and subsequently stained with the anti-mouse [SIINFEKL:H-$2K^b$] antibody and analyzed by flow cytometry. The dose of 1 ng/ml was chosen as it represents the maximum concentration tested without being detected by anti-(SIINFEKL:H-$2K^b$). Naive OT-I; Cas9 $CD8^+$ T cells were isolated and transduced with MKO lentiviral library described herein. Infected OT-I; Cas9 $CD8^+$ T cells were incubated on plates pretreated with 5 μg/ml anti-CD3ε in cRPMI supplemented with 2 ng/ml IL-2+2 ng/ml IL-12p70+1 μg/ml anti-CD28 for 6 days. 12 hours before assay, infected OT-I; Cas9 $CD8^+$ T cells were incubated on untreated plates in the presence of 2 ng/ml IL-2+2 ng/ml IL-12p70 to rest the cells. On day 6, 12 hours before the assay, $1\times10^7$ E0771 cells were also plated on 10 cm plate in D10 media (DMEM+10% FBS+100 U Pen/Strep). The following day, E0771 cells were incubated with warm D10 media supplemented with either 0 or 1 ng/ml SIINFEKL peptide for 4 hours. Meanwhile, infected OT-I; Cas9 $CD8^+$ T cells were resuspended to a final concentration $1\times10^6$ cells/ml with cRPMI+2 nM monensin+anti-CD107a PE antibody, and added to E0771 cells at a T cell: seeding cancer cell ratio=1:1. Cells were coincubated at 37° C. for 2 hours. Cells were then stained with anti-CD8 APC for 30 minutes on ice, and cells were sorted via BD FACSAria. A total of $1\times10^7$ T cells were analyzed, and the top 5% $CD107a^+$ cells were sorted, and subjected to genomic DNA extraction, CRISPR library readout, and screen data analysis. A total of three biological replicates were performed.

In validation experiments, both T cells and E0771 cells were scaled down accordingly, while maintaining T cell: seeding cancer cell ratio=1:1. Briefly, cells were infected and cultured at 37° C. for 7 days. On day 6, T cells were rested overnight and E0771 cells were plated in 12-well plates at $5\times10^5$ cells/ml/well. E0771 cells were then incubated with 10 ng/ml SIINFEKL for 4 hours in D10 media. $5\times10^5$ OT-I; Cas9 $CD8^+$ T cells were added to the pulsed E0771 cells. During co-culture, IL-2, IL-12, anti-CD107a-PE (1:400), and monensin was added. After 2 hours of incubation, cells were isolated, stained, and run on flow cytometry.

Genomic DNA extraction from cells and mouse tissues: For gDNA extraction, three methods were used. Method 1: for samples with a total number of less than or equal to $1\times10^5$ cells, 100 μl of QuickExtract solution (Epicentre) was directly added to cells and incubated at 65° C. for 30 to 60 minutes until the cell pellets were completely dissolved. Method 2: for cellular samples with a total number of $1\times10^5$ to $2\times10^6$ cells, or tissue samples from mouse lymph nodes, samples were subjected to QIAamp Fast DNA Tissue Kit (Qiagen) following the manufacturer's protocol. Method 3: for cellular samples with a total number of greater than $2\times10^6$ cells, or tissue samples from mouse organs such as spleen, lung, liver, brain, pancreas, colon, or tumor samples, a custom Puregene protocol was used.

Briefly, 50-200 mg of frozen ground tissue were resuspended in 6 ml of Lysis Buffer (50 mM Tris, 50 mM EDTA, 1% SDS, pH 8) in a 15 ml conical tube, and 30 μl of 20 mg/ml Proteinase K (Qiagen) were added to the tissue/cell sample and incubated at 55° C. overnight. The next day, 30 μl of 10 mg/ml RNAse A (Qiagen) was added to the lysed sample, which was then inverted 25 times and incubated at 37° C. for 30 minutes. Samples were cooled on ice before addition of 2 ml of pre-chilled 7.5M ammonium acetate (Sigma) to precipitate proteins. The samples were vortexed at high speed for 20 seconds and then centrifuged at ≥4,000×g for 10 minutes. Then, a tight pellet was visible in each tube and the supernatant was carefully decanted into a new 15 ml conical tube. Then 6 ml 100% isopropanol was added to the tube, inverted 50 times and centrifuged at ≥4,000×g for 10 minutes. Genomic DNA was visible as a small white pellet in each tube. The supernatant was discarded, 6 ml of freshly prepared 70% ethanol was added, the tube was inverted 10 times, and then centrifuged at ≥4,000×g for 1 minute. The supernatant was discarded by pouring; the tube was briefly spun, and remaining ethanol was removed using a P200 pipette. After air-drying for 10-30 minutes, the DNA changed appearance from a milky white pellet to slightly translucent. Then, 500 μl of $ddH_2O$ was added, the tube was incubated at 65° C. for 1 hour and at room temperature overnight to fully resuspend the DNA. The next day, the gDNA samples were vortexed briefly. The gDNA concentration was measured using a Nanodrop (Thermo Scientific).

SgRNA library readout by deep sequencing: The sgRNA library readout was performed using a two-steps PCR strategy, where the first PCR includes enough genomic DNA to preserve full library complexity and the second PCR adds appropriate sequencing adapters to the products from the first PCR.

For PCR #1, a region containing sgRNA cassette was amplified using primers specific to the T cell CRISPR vector:

```
Forward
                              (SEQ ID NO: 129,211)
CCCGAGGGGACCCAGAGAG

Reverse
                              (SEQ ID NO: 129,212)
CAATTCCCACTCCTTTCAAGAC
```

PCR was performed using Phusion Flash High Fidelity Master Mix (PF) or DreamTaq Green PCR Master Mix (DT) (ThermoFisher). For reactions using PF, in PCR #1, the thermocycling parameters were: 98° C. for 2 min, 18-24 cycles of (98° C. for 1 s, 62° C. for 5 s, 72° C. for 30 s), and 72° C. for 2 minutes. For reactions using DT, the thermocycling parameters were adjusted according to manufacturer's protocol. In each PCR #1 reaction, 3 μg of total gDNA was used. For each sample, the appropriate number of PCR #1 reactions was used to capture the full representation of the screen. For example, at ~200× coverage of the 129,209 MKO sgRNA library, gDNA from $2.5\times10^7$ cells was used. Assuming 6.6 pg of gDNA per cell, ~160 μg of gDNA was used per sample, in approximately 50 PCR #1 reactions (with ~3 μg of gDNA per reaction).

PCR #1 products for each biological sample were pooled and used for amplification with barcoded second PCR primers. For each sample, at least 4 PCR #2 reactions were performed using 2 μl of the pooled PCR #1 product per PCR #2 reaction. Second PCR products were pooled and then normalized for each biological sample before combining uniquely barcoded separate biological samples. The pooled product was then gel purified from a 2% E-gel EX (Life Technologies) using the QiaQuick kit (Qiagen). The purified pooled library was then quantified with a gel-based method using the Low-Range Quantitative Ladder Life Technologies, dsDNA High-Sensitivity Qubit (Life Technologies), BioAnalyzer (Agilent) and/or qPCR. Diluted libraries with 5-20% PhiX were sequenced with MiSeq, HiSeq 2500 or HiSeq 4000 systems (Illumina).

Demultiplexing and read preprocessing: Raw single-end fastq read files were filtered and demultiplexed using Cutadapt (Martin et al., EMBnet.journal 17, 10-12 (2011)). To remove extra sequences downstream (i.e. 3' end) of the sgRNA spacer sequences, the following settings were used: cutadapt --discard-untrimmed -a GTTTTAGAGCTAGAAATGGC (SEQ ID NO: 140,897). As the forward PCR primers used to readout sgRNA representation were designed to have a variety of barcodes to facilitate multiplexed sequencing, these filtered reads were then demultiplexed with the following settings: cutadapt -g file: fbc.fasta --no-trim, where fbc.fasta contained the 12 possible barcode sequences within the forward primers. Finally, to remove extra sequences upstream (i.e. 5' end) of the sgRNA spacers, the following settings were used: cutadapt --discard-untrimmed -g GTGGAAAGGACGAAACACCG (SEQ ID NO: 140,898). Through this procedure, the raw fastq read files could be pared down to the 20 bp sgRNA spacer sequences.

Mapping of sgRNA spacers and quantitation of sgRNAs: Having extracted the 20 bp sgRNA spacer sequences from each demulitplexed sample, the sgRNA spacers were then mapped to the MKO library from which they originated (mGeCKO). A bowtie index of either sgRNA library was generated using the bowtie-build command in Bowtie 1.1.2 (Langmead et al., Genome Biol 10, R25 (2009). Using these bowtie indexes, the filtered fastq read files were mapped using the following settings: bowtie -v 1 --suppress 4,5,6,7 --chunkmbs 2000 -best. Using the resultant mapping output, the number of reads that had mapped to each sgRNA within the library were quantitated. To generate sgRNA representation barplots, a detection threshold of 1 read was set, and the number of unique sgRNAs present in each sample was counted.

Normalization and summary-level analysis of sgRNA abundances: The number of reads in each sample was normalized by converting raw sgRNA counts to reads per million (rpm). The rpm values were then subject to $\log_2$ transformation for certain analyses. To generate correlation heatmaps, the NMF R package was used (Gaujoux et al., BMC Bioinformatics 11, 367 (2010)) and the Pearson correlations between individual samples calculated using $\log_2$ rpm counts. To calculate the cumulative distribution function for each sample group, the normalized sgRNA counts were first averaged across all samples within a given group. Then the ecdfplot function in the latticeExtra R package was used to generate empirical cumulative distribution plots.

Enrichment analysis of sgRNAs: Three criteria were used to identify the top candidate genes: 1) if an sgRNA comprised≥2% of the total reads in at least one organ sample; 2) if an sgRNA was deemed statistically significantly enriched in ≥25% of all organ samples using a false-discovery rate (FDR) threshold of 2% based on the abundances of all non-targeting controls; or 3) if ≥2 independent sgRNAs targeting the same gene were each found to be statistically significant at FDR<2% in at least one sample. For the first and second criteria, individual sgRNA hits were collapsed to genes to facilitate comparisons with the hits from the third criteria.

Heatmap of sgRNA library representation: Heatmaps of the top enriched sgRNAs were generated using the aheatmap function with default setting (NMF R package). Only sgRNAs with a $\log_2$ rpm≥1 were included for visualization in the heatmaps.

Overlap and significance analysis of enriched sgRNAs: To generate Venn diagrams of enriched sgRNAs, all sgRNAs were considered that were found to be significantly enriched across different statistical calling algorithms, different T cells, or different experiments.

Additional CRISPR screen T cell survival analysis by organ: Enrichment analysis was first performed for each organ as a sample to call significant sgRNAs passing specific FDR cutoff. Sets of significant sgRNAs were compared against each other. In addition, the whole library representation was used as input for dimensional reduction analysis using t-SNE as in single-cell RNA-seq analysis, to find clusters of organs.

Minipool screen validation: SgRNA minipools were generated by pooling a selection of genes from the primary screen and cloned into the same T cell CRISPR vector. Viral production, transduction, and adoptive transfer was done similar to the screen with 1e6 T cells per transfer.

Pathway enrichment analysis of enriched sgRNAs: SgRNAs that were significantly enriched in each tissue type were determined. To convert these sgRNAs to their target genes, the resultant gene sets for DAVID functional annotation analysis were used (Huang da et al., Nucleic Acids Res 37, 1-13 (2009)). A GO category was considered statistically significant if the enrichment p value is less than 0.01, and Benjamini-Hochberg adjusted p-value was less than 0.1.

Gene ontology and pathway enrichment analysis: Various gene sets were used for gene ontology and pathway enrichment analysis using DAVID functional annotation analysis. For sgRNA set, sgRNAs were converted to their target genes and then the resultant genes were used for analysis.

Testing anti-tumor function of T cells with sgRNAs targeting individual genes by adoptive transfer: SgRNAs targeting individual genes were cloned into the T cell CRISPR vector. Two independent sgRNAs targeting each gene (e.g. Dhx37) were used. Virus prep and T cell infection were performed as described herein. $5\times10^6$ $mCh^+cOVA^+$ E0771 cells were injected either subcutaneously or into the intra-mammary fat pad of $Rag1^{-/-}$ mice. 7 days post-transplantation, freshly isolated naive OT-I; Cas9 $CD8^+$ T cells were plated on plates pretreated with 5 μg/ml anti-CD3ε in cRPMI supplemented with 2 ng/ml IL-2+2.5 ng/mL IL-7+50 ng/mL IL-15+1 μg/ml anti-CD28, infected with these sgRNA-containing lentiviruses (at MOI of ~≤1) as described herein, and cultured for 3 days. 10 days post-transplantation, $5\times10^6$ virally infected T cells were intravenously injected in tumor-bearing $Rag1^{-/-}$ mice (T cell: initial cancer cell ratio=1:1). PBS and empty vector infected T cells were used as adoptive transfer controls. Tumor sizes were measured by caliper once to twice per week. 6 weeks after adoptive transfer, tumors were dissected, and samples were subjected to molecular, cellular, histology analysis, or single-cell RNA-seq. For statistical comparison of tumor growth curves, multiple t-tests were performed (Benjamini, Krieger and Yekutieli FDR method) on each time point.

Tumor Infiltration Lymphocyte (TIL) Isolation for single cell RNA-seq: Tumor bearing mice were euthanized at designated time points, and their tumors were collected and kept in ice cold 2% FBS. Tumors were minced into 1-3 mm size pieces using scalpel and then digested in 1 μg/ml Collagenase IV for 30-60 min using Miltenyi GentleMACS™ Octo Dissociator. Tumor suspensions were filtered twice through 100 μm cell strainer, and again through 40 μm cell strainer to remove large bulk. Subsequently, tumor suspensions were carefully layered onto Ficoll-Paque™ media (GE Healthcare) and centrifuged at 400 g for 30 min to enrich lymphocytes at the bilayer interface. Cells at the interface were carefully collected, and washed twice with 2% FBS, counted, and stained with indicated antibodies for 30 minutes on ice. $CD3^+CD8^+$ TILs were then sorted on BD FACSAria™. A total of $3\times10^3$ to $2\times10^4$ TILs were collected per tumor.

Mouse TIL single cell RNA-seq (scRNAseq): TILs sorted from freshly isolated tumors were subjected to single-cell RNAseq library preparation, according to manufacturer's protocol (10× Genomics). In brief, Single Cell Master Mix was prepared fresh containing RT reagent mix, RT primer, additive A, and RT enzyme mix. A Single Cell 3' Chip was placed in a 10×™ Chip Holder. 50% glycerol solution was added to each unused well accordingly, TIL solution at ~100 cell/ul was added together with the master mix. The Single Cell 3' Gel Bead Strip was placed into a 10×™ Vortex Adapter and vortex for 30 sec. Then, Single Cell 3' Gel Bead suspension and Partitioning Oil were dispensed into the bottom of the wells in the specified rows. The fully loaded chip was then inserted into Chromium™ Controller to generate emulsion. The emulsion was then transferred to a 96-well PCR plate for GEM-RT reaction, RT clean up, cDNA amplification, cDNA clean up, quantification and QC, and subjected to Illumina library construction. In library construction, clean input cDNA was then subjected to fragmentation, end repair & A-tailing. After that, double sided size selection was performed using SPRI Select, followed by adaptor ligation, clean up, and sample indexing PCR, pooling and PCR cleanup, resulting a single-cell RNA-seq library. Enzymatic Fragmentation and Size Selection were used to optimize the cDNA amplicon size prior to library construction per manufacturer's protocols. R1 (read 1 primer sequence) are added to the molecules during GEM incubation. P5, P7, a sample index and R2 (read 2 primer sequence) are added during library construction via end repair, A-tailing, adaptor ligation and PCR. The Single Cell 3' Protocol produces Illumina-ready sequencing libraries contain the P5 and P7 primers used in Illumina bridge amplification. This final library was then QC'ed and quantified using BioAnalyzer, and loaded on a Hiseq 2500 RapidRun for standard Illumina paired-end sequencing, where Barcode and 10 bp randomer (UMI) was encoded in Read 1, while Read 2 was used to sequence the cDNA fragment. Sample index sequences were incorporated as the i7 index read.

scRNA-seq data processing: TIL scRNA-seq fastq data was pre-processed using established and custom pipelines. Briefly, raw Illumina data files were subjected to Cell Ranger, which used cellranger mkfastq to wrap Illumina's bcl2fastq to correctly demultiplex Chromium-prepared sequencing samples and to convert barcode and read data to FASTQ files. Then, cellranger count was used to take FASTQ files and perform alignments to the mouse genome (mm10), filtering, and UMI counting. Raw sequencing output was first preprocessed by Cell Ranger 1.3 (10× Genomics) (Zheng et al., 2017b) using cellranger mkfastq, count, and aggr (no normalization mode). Cells passed the initial quality control metrics imposed by the Cell Ranger pipeline were further filtered using a variety of criteria (Lun et al., (2016) F1000Res 5, 2122): 1) All cells with a total library count (i.e. # of UMIs) that was ≥4 standard deviations below the mean were excluded; 2) All cells with library diversity (i.e. # of detected genes/features) that was ≥4 standard deviations below the mean were excluded; and 3) All cells in which mitochondrial genes disproportionately comprised the total % of the library (≥4 standard deviations above the mean) were excluded. After applying these 3 filters, a final set of cells was retained for further analysis. The 27,998 genes/features were additionally filtered the using a flat cutoff metric: genes with low variance were excluded. Finally, the data was normalized by library size using the scran R package (Lun et al., (2016) F1000Res 5, 2122).

scRNA-seq t-SNE dimension reduction and visualization: Using the final normalized and processed dataset (described above), t-SNE dimension reduction was performed using the Rtsne R package with default settings (Maaten, (2014) J Mach Learn Res 15, 3221-3245; Maaten and Hinton, (2008) J Mach Learn Res 9, 2579-2605). Individual data points were colored based on the treatment condition for each cell.

scRNA-seq differential expression analysis: Using the final normalized and processed dataset (described above), differential expression analysis was performed using the edgeR R package (Robinson et al., (2010) Bioinformatics 26, 139-14). In brief, edgeR first estimates the negative binomial dispersion parameter to model the variance between cells from the same treatment group. A generalized linear model is then fitted to determine differentially expressed genes between treatment conditions. Multiple hypothesis correction was performed by the Benjamini-Hochberg method. Significantly differentially expressed genes were defined as having a Benjamini-Hochberg adjusted $p<0.05$, with upregulated genes having a positive log fold change and downregulated genes having a negative log fold change. Volcano plots were generated using edgeR output statistics. Gene ontology enrichment analyses on differentially expressed genes were performed using the PANTHER classification system (Mi et al., (2013) Nat Protoc 8, 1551-1566). The statistical overrepresentation test was used to identify enriched GO (biological process) categories among the differentially expressed genes. Bonferroni multiple hypothesis correction was performed.

scRNA-seq heatmap of differentially expressed genes: To generate an overall view of the top differentially expressed genes, each row of the dataset (i.e. by gene) was scaled to obtain z-scores. Heatmaps were generated using the NMF R package (Gaujoux and Seoighe, (2010) BMC Bioinformatics 11, 367).

Analysis of human T cell scRNA-seq data: Human T cell scRNA-seq data from liver cancer patients (Zheng et al., (2017) Cell 169, 1342-1356 e1316) were retrieved from GEO (GSE98638). Cells were classified according to the original definitions: peripheral blood, tissue-resident, tumor-normal junction, and tumor-infiltrating T cells; $CD3^+/CD4^+/CD25^-$ T cells, $CD3^+/CD8^+$ T cells, and $CD3^+/CD4^+/CD25^+$ T cells. Stratification of subpopulation of cells that express relative higher level of DHX37 ($DHX37^+$ T cells) and as compared to those expressing lower or undetectable level ($DHX37^-$ T cells) was done by a cutoff of 1 $log_2(cpm)$ normalized expression. Analysis of differentially expressed genes was done by comparing $DHX37^+$ and $DHX37^-$ groups using two-sided unpaired Welch's t test assuming unequal variance.

DHX37 overexpression: A Dhx37 cDNA was cloned into a lentiviral vector using standard molecular biology techniques, and was used to transfect or transduce cells to overexpress the protein.

Analysis of human DHX37 expression by western blot: Human PB $CD4^+$, $CD8^+$ T cells, as well as patient TILs were analyzed for DHX37 protein expression by western blot with a rabit polyclonal antibody (Novus, NBP2-13922).

Analysis of human DHX37 expression by FACS: Intracellular DHX37 expression was analyzed for human PB $CD8^+$ T cells, as well as patient TILs with a rabit polyclonal antibody (Novus, NBP2-13922).

Analysis of human DHX37 using tissue microarray (TMA): All work involving human samples was approved by institutional IRB. Human tissue samples were collected with existing IRB protocols in place. TMAs from several cancer types were retrieved from biospecimen bank for the following cancer types: glioma, breast cancer and melanoma, with normal and tumor biopsies for brain origin. IHC for DHX37 was done with a rabit polyclonal antibody (Novus, NBP2-13922). H&E and IHC slides were scanned using Leica slidescanners and scored manually for lymphocytes and DHX37+ cells.

Generation of an AAV T cell knockout vector: An adeno-associated virus (AAV) knockout vector, pAAV-U6-sgBbsI-EFS-Thy1.1-PolyA, was generated by subcloning Thy1.1 and sgRNA expression cassette into a AAV vector via Gibson Assembly (NEB). For individual gene targeting, the AAV knockout vector was digested with BbsI. Oligonucleotides encoding sgRNAs for MlI3, B2m, and mDhx37 were ligated into the digested AAV knockout vector using T4 ligase (NEB).

AAV virus production: The AAV knockout plasmid vector (AAV-vector), AAV-MlI3, AAV-B2m, and AAV-mDhx37 were subjected to AAV9 production and chemical purification. Briefly, HEK293FT cells (ThermoFisher) were transiently transfected with transfer (AAV-plasmids), serotype (AAV9) and packaging (pDF6) plasmids using polyethyleneimine (PEI). Approximately 72 h post-transfection, cells were dislodged and transferred to a conical tube in sterile PBS. 1/10 volume of pure chloroform was added to the mixture and incubated at 37° C. for 1 h. NaCl was added to a final concentration of 1 M. The mixture was subsequently shaken until dissolved and then pelleted at 20,000 gx at 4° C. for 15 min. The chloroform layer was discarded while the aqueous layer was transferred to another tube. PEG8000 was added to 10% (w/v) and shaken until dissolved. The mixture was incubated at 4° C. for 1 h and spun at 20,000 gx at 4° C. for 15 min. After the supernatant was discarded, the pellet was resuspended in $DPBS+MgCl_2$, treated with benzonase (Sigma), and then incubated at 37° C. for 30 min. Chloroform (1:1 volume) was then added, shaken and spun down at 12,000 g at 4° C. for 15 min. The aqueous layer was isolated and passed through a 100-kDa MWCO (Millipore). The concentrated solution was washed with PBS and the filtration process was repeated. Virus was titered by qPCR using custom Taqman assays (ThermoFisher).

AAV viral transduction: T cell pellets were directly transduced with indicated AAV-virus. 3 days after infection, T cells were stained for Thy1.1 expression and analyzed on FACS.

Determining cutting efficiency: DNA from cells was extracted by incubating cells with Epicentre QuickExtract for 65° C. for 30 minutes, and subsequently incubated at 98° C. for 5 minutes. gDNA from samples was amplified by PCR. Purified PCR product was subjected to both T7 endonuclease surveyor (NEB) and Nextera sequencing according to Illumina protocol.

Acute deletion and gene expression analysis of mouse CD8 T cells: OT-I; Cas9 $CD8^+$ T cells were transduced with AAV-sgDhx37 or AAV-sgNTC, activated and cultured in vitro for 6 days, and then subjected to 10x Genomics single-cell RNAseq library prep. The initial scRNAseq data processing was done as above.

Single cell RNAseq analysis with Seurat: Raw UMI-based 10x count matrices were analyzed using Seurat (Butler and Satija, (2017) bioRxiv) with recommended settings. Counts were normalized by UMIs per cell, and log transformed for downstream analysis. Graph-based clustering was performed to identify subpopulations across the entire dataset. Subsequently, differential expression analysis comparing sgDhx37 and NTC samples was performed by non-parametric Wilcoxon test.

Nuclear staining: Nuclear staining was performed using FoxP3 staining kit and protocol from eBioscience. Prior to nuclear staining, primary antibodies were pre-adsorbed for at least 30 minutes on ice. Serum used for pre-adsorption varied depending on species of samples stained. 5% human serum was used to pre-adsorb antibodies for human T cell staining. 5% normal mouse and 5% normal rat serum was used to pre-adsorb antibodies for murine T cell staining. Cells were stained with primary stain overnight at 4° C., and subsequently stained with secondary antibody for 1 h at room temperature.

Endosomal staining: Endosomal staining was performed using BD Cytofix/Cytoperm staining kit and protocol. Prior to endosomal staining, cells were incubated with anti-CD16/32 to neutralize FcγRII/III, and subsequently stained with endosomal stain for 30 minutes on ice.

Blinding statement: Investigators were blinded for sequencing data analysis, but not blinded for tumor engraftment, adoptive transfer, organ dissection and flow cytometry.

The results of the experiments are now described.

Figure 15B:
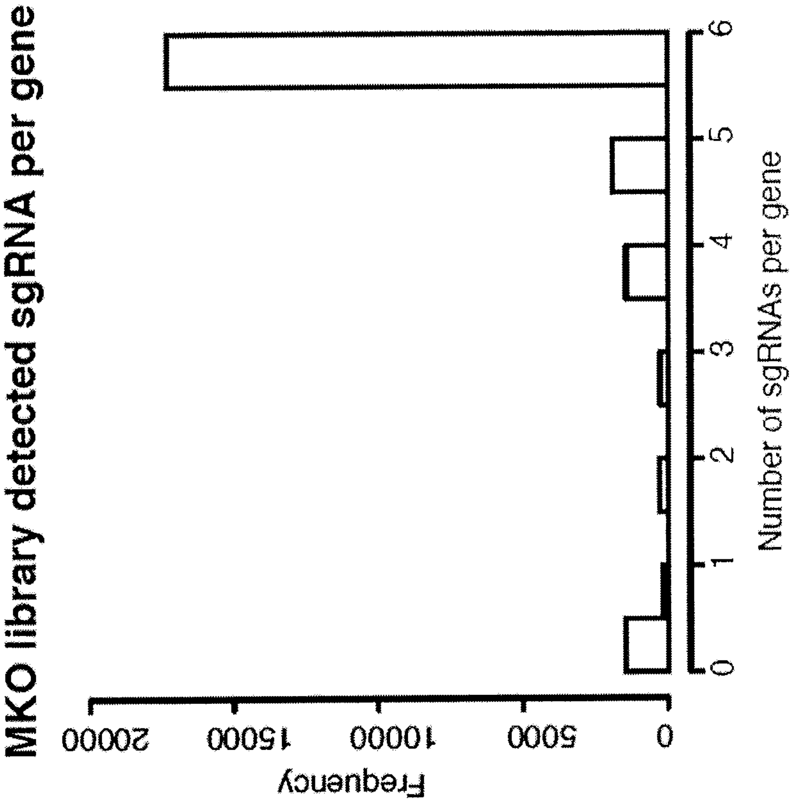
FIGS. 15A-15F are a series of plots and images illustrating generation, QC, and titration of a genome-scale T cell CRISPR library (MKO) for screening.
Figure 15A:
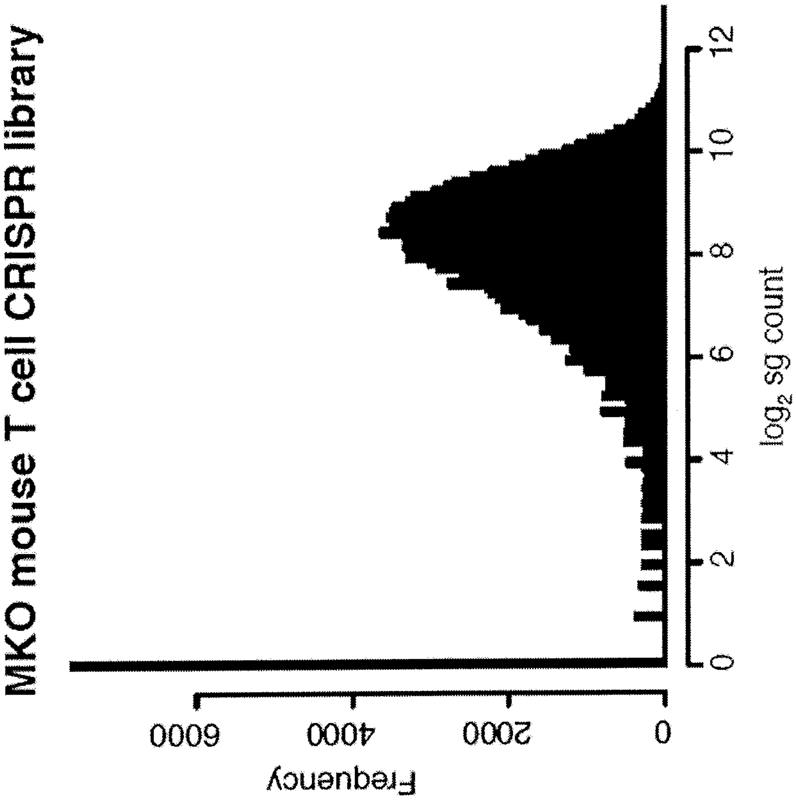

Example 1: Design, Construction and Production of T Cell Crispr Vector and Genome-Scale Library To enable efficient genome editing and isolation of $CD8^+$ T cells, a T cell CRISPR vector was designed and generated. This vector contained an sgRNA expression cassette enabling genome editing in conjunction with Cas9, and a cassette that expresses a congenic variant of Thy1 protein (Thy1.1), enabling the specific identification and single-cell isolation of transduced $CD8^+$ T cells (FIG. 1A). To enable large-scale genetic manipulation and thus high-throughput screening, a genome-scale sgRNA library containing a total of 129,209 sgRNAs (SEQ ID NOs: 1-129,209) including 1,000 non-targeting controls (NTCs), was cloned into this vector at an estimated library coverage of >50x (~$7×10^6$ total colonies). The successful cloning of the library was verified by Illumina sequencing: (1) tight log-normal distribution of designed sgRNAs with 97.6% of sgRNAs within 2 orders of magnitude (O.M.), and 99.9% within 3 O. M, (2) covering 98.3% targeted genes (FIGS. 15A-15B).

Figure 1B:
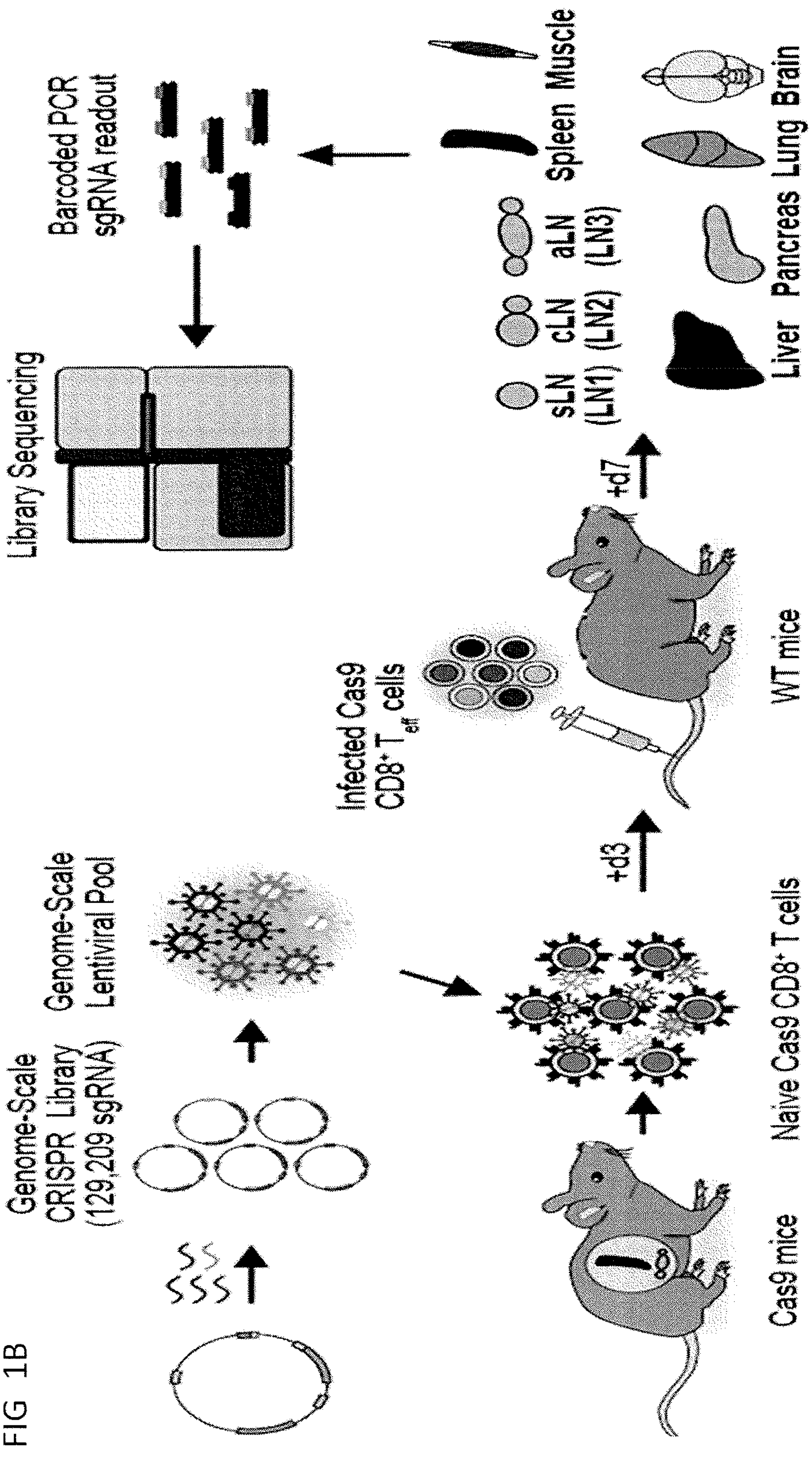
Figure 7A:
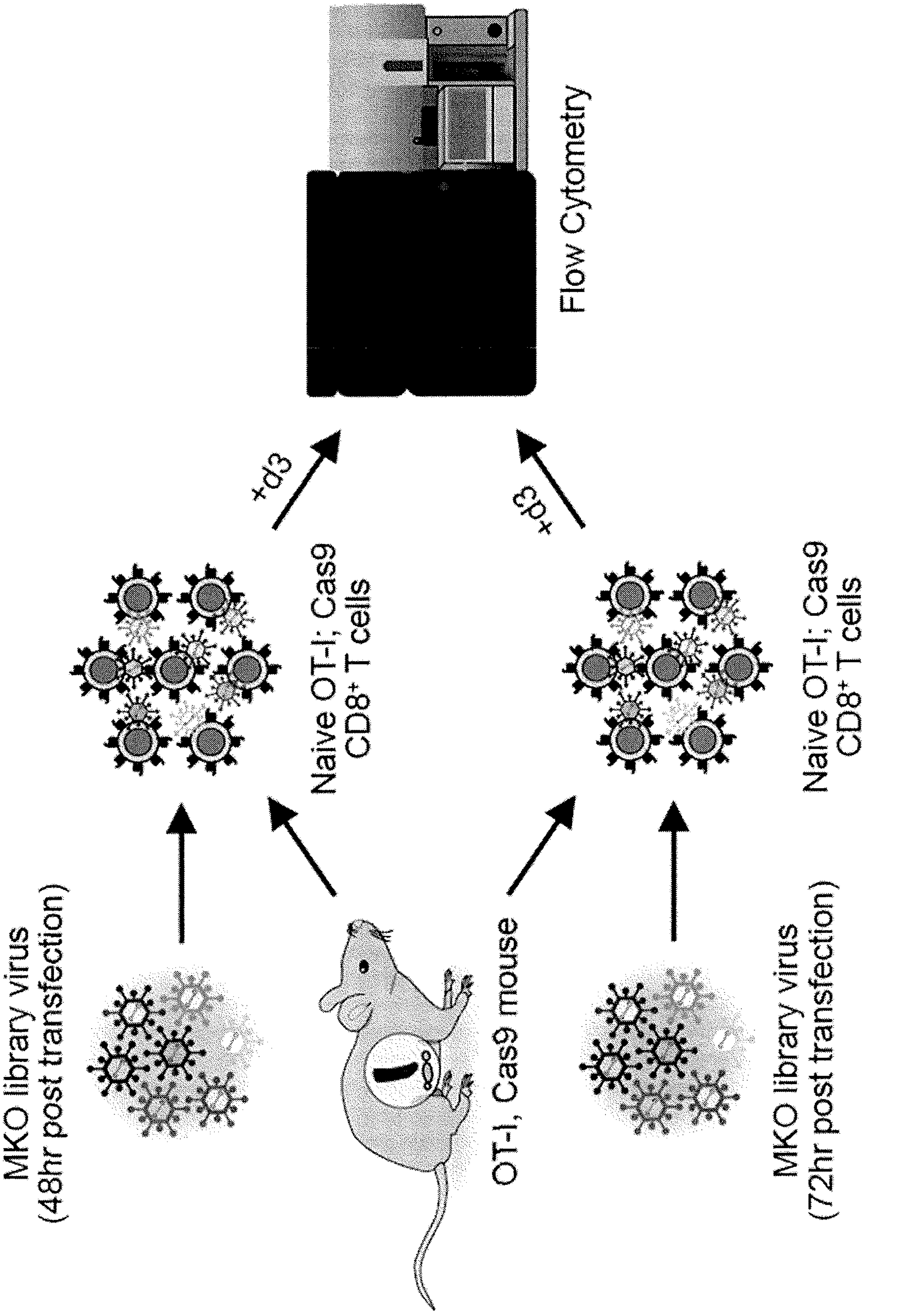
FIGS. 7A-7E are a series of plots and images illustrating FACS data for setup experiments of OT-I; Cas9 $CD8^+$ T cell survival in WT mice.
Figure 7B:
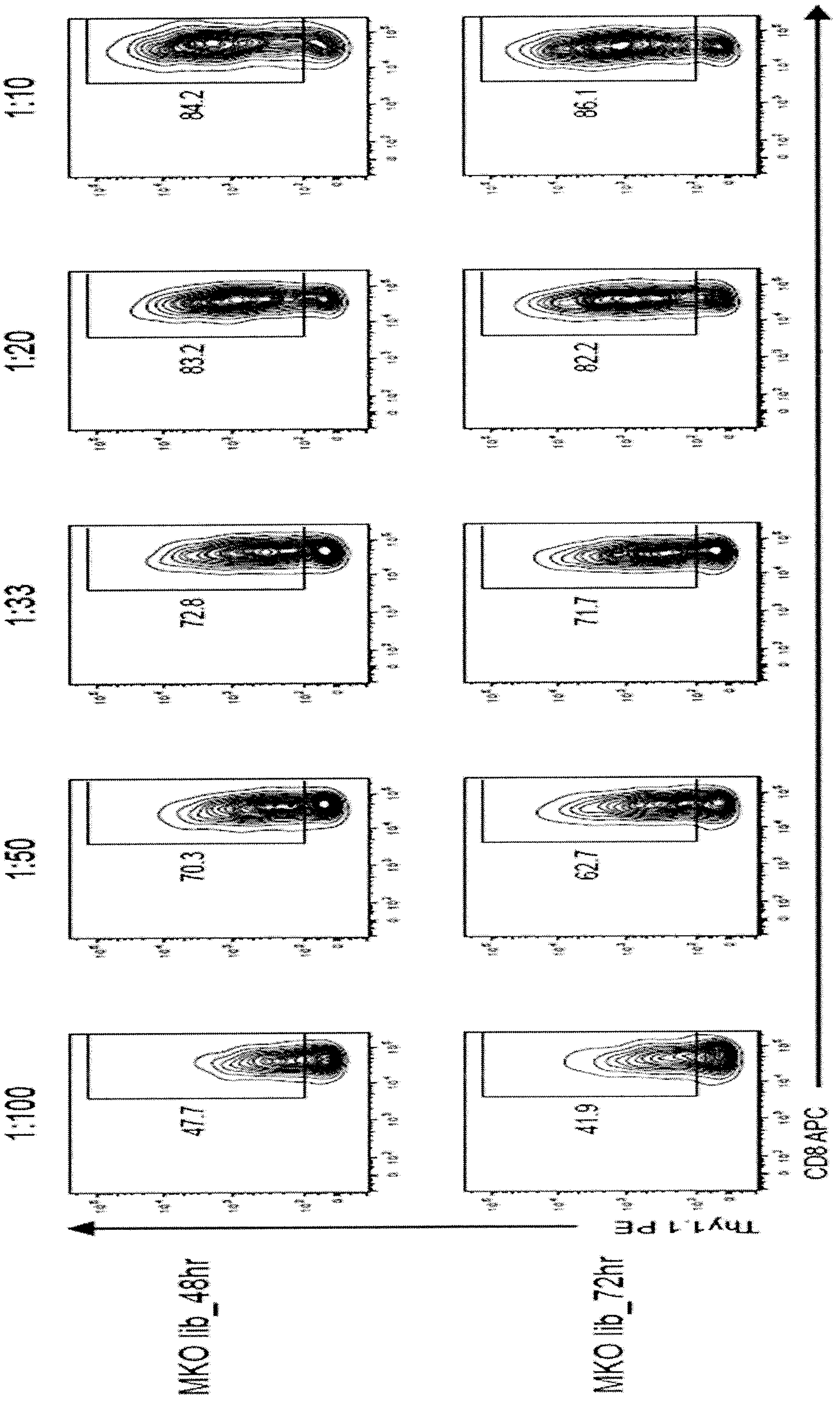
Figure 7C:
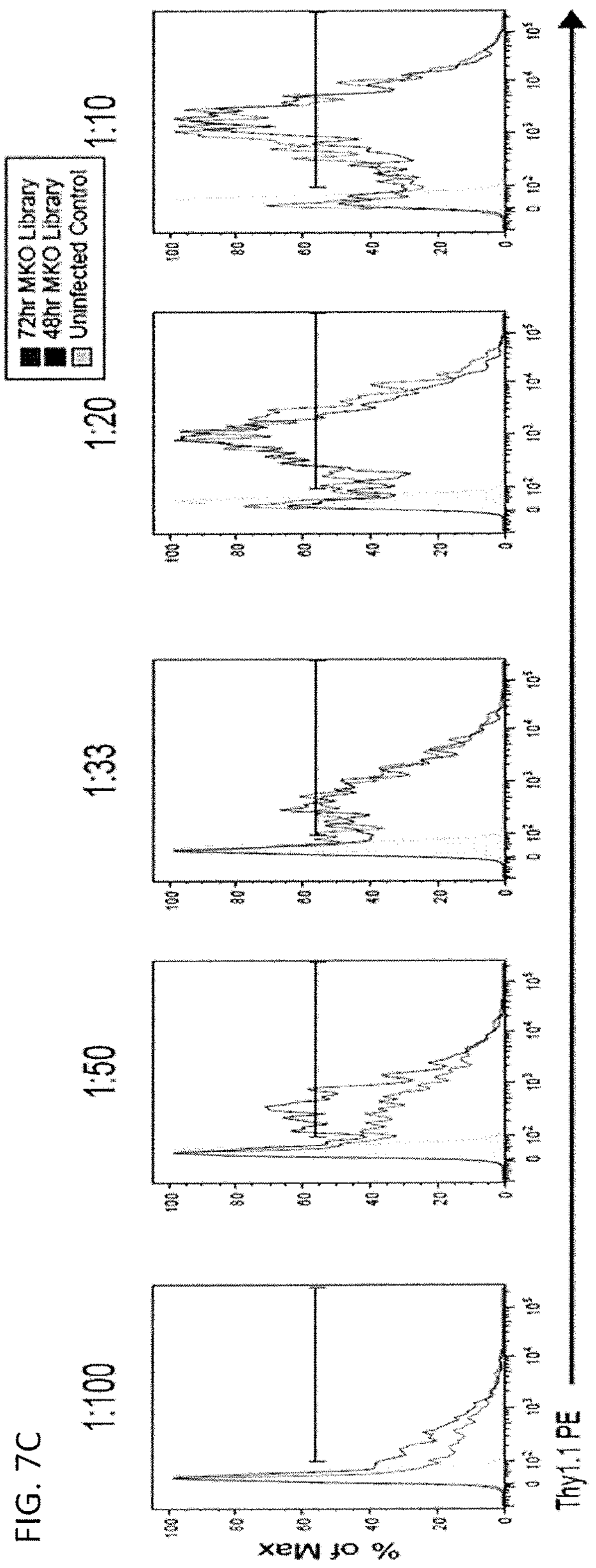
Figure 7D:
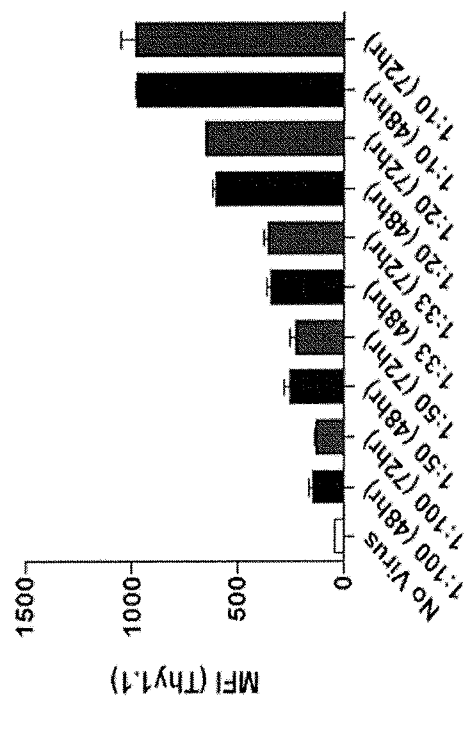
Figure 7E:
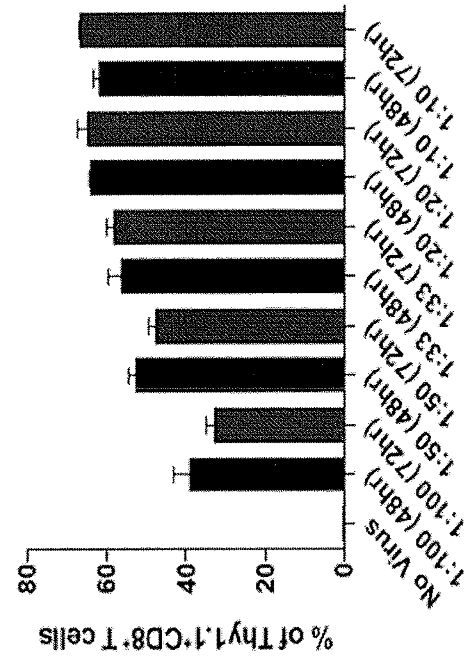
Figure 15C:
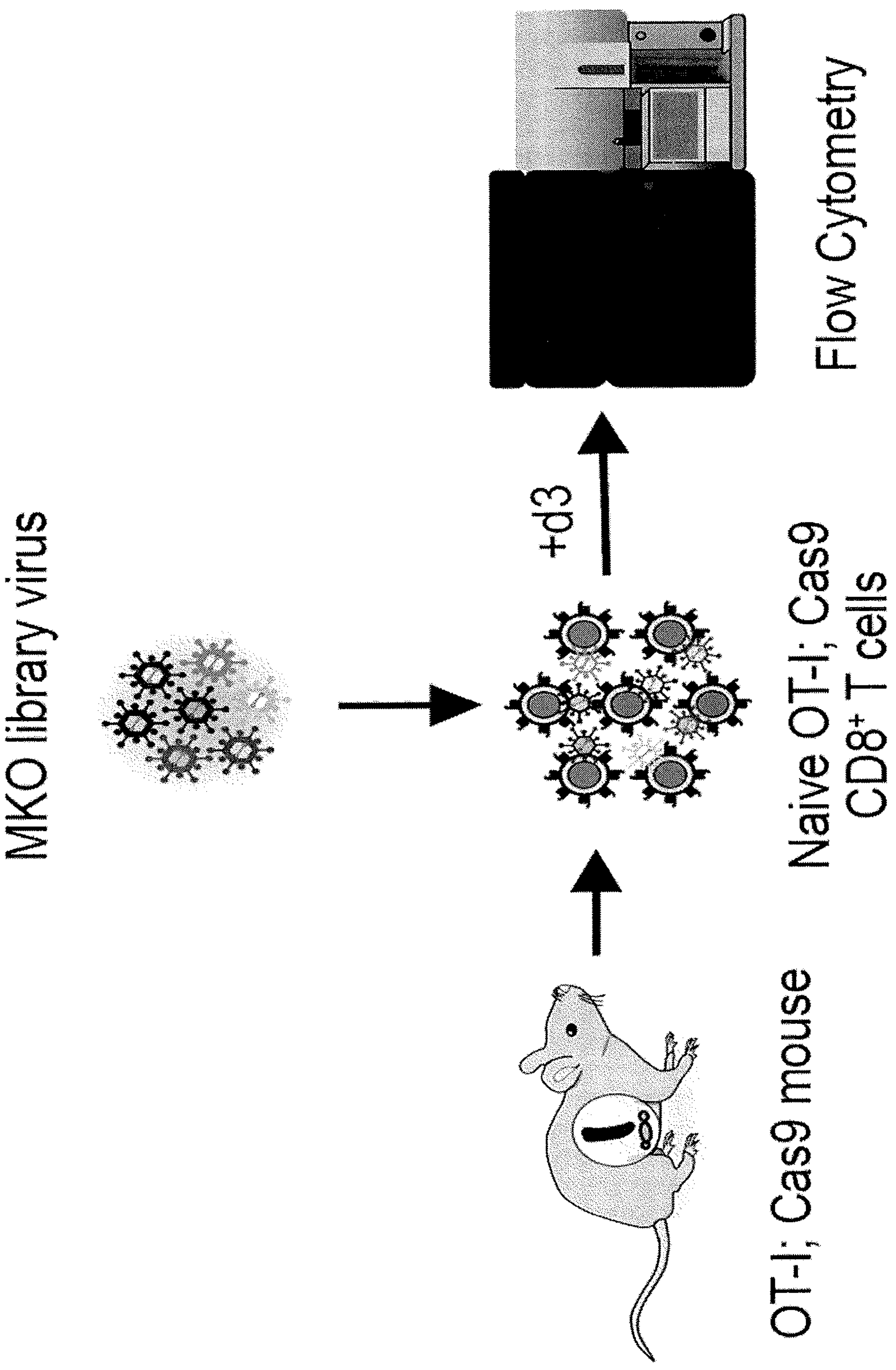
Figure 15D:
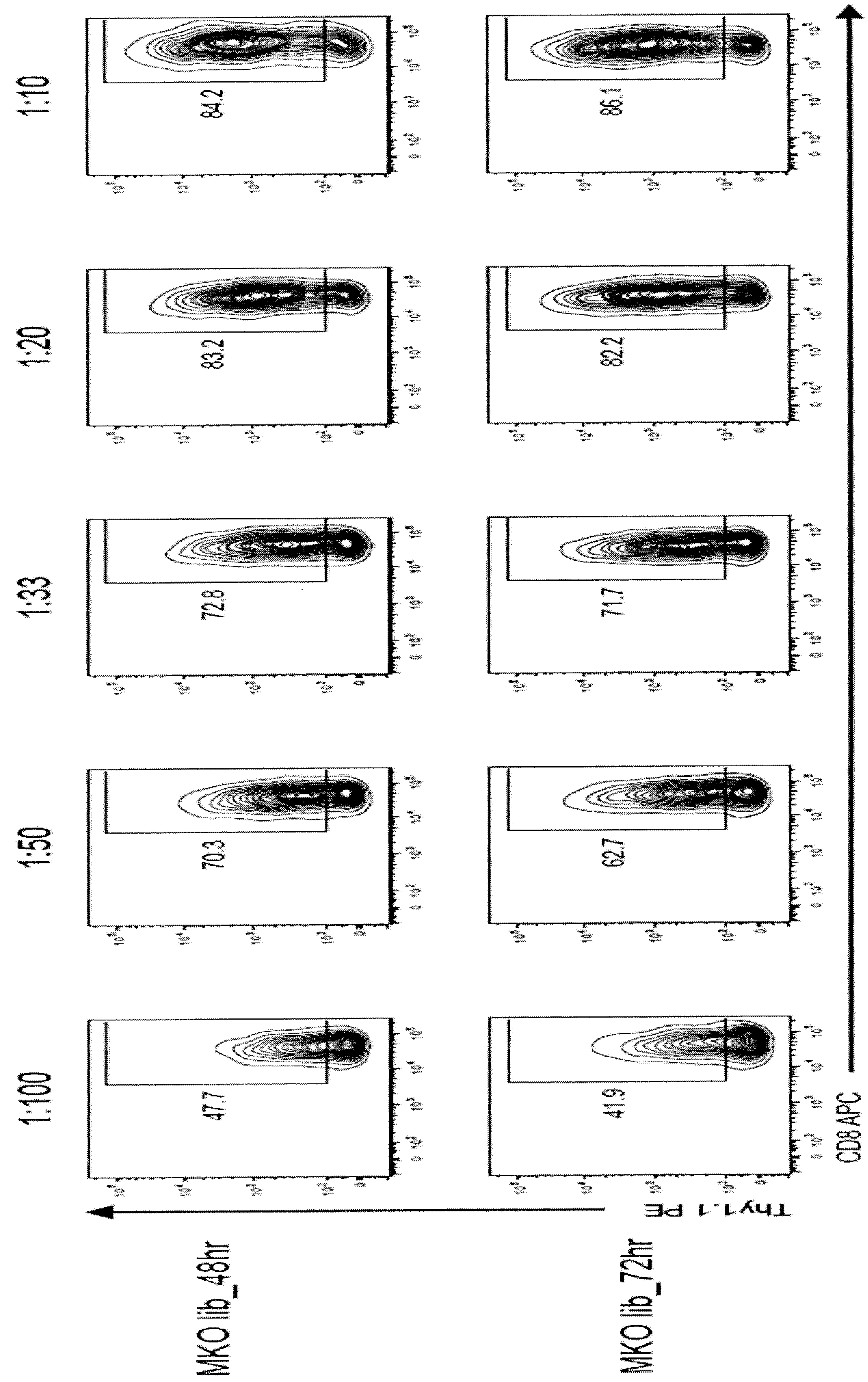
Figure 15E:
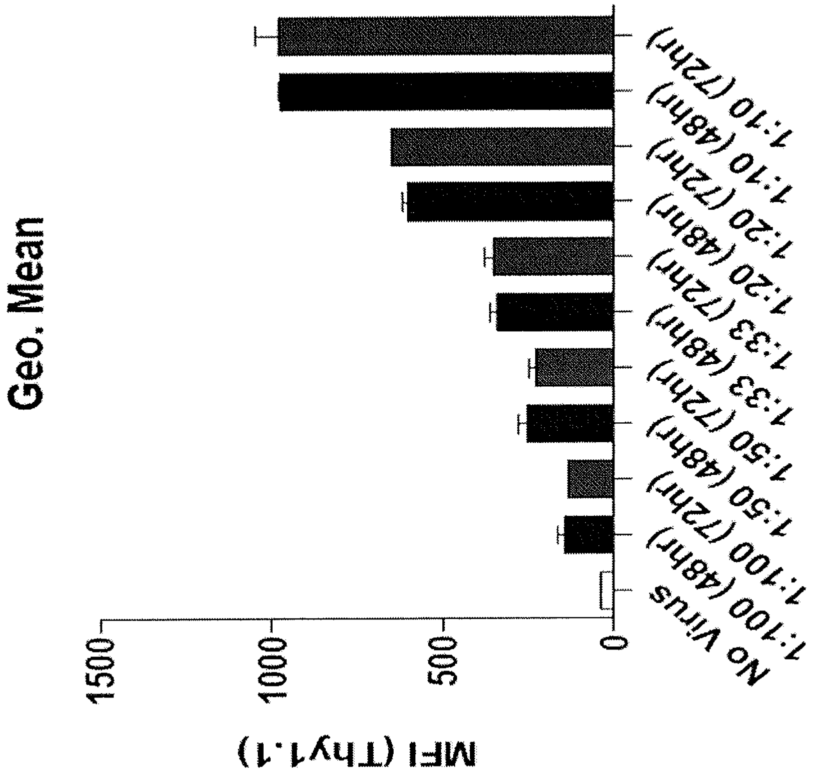
Figure 15F:
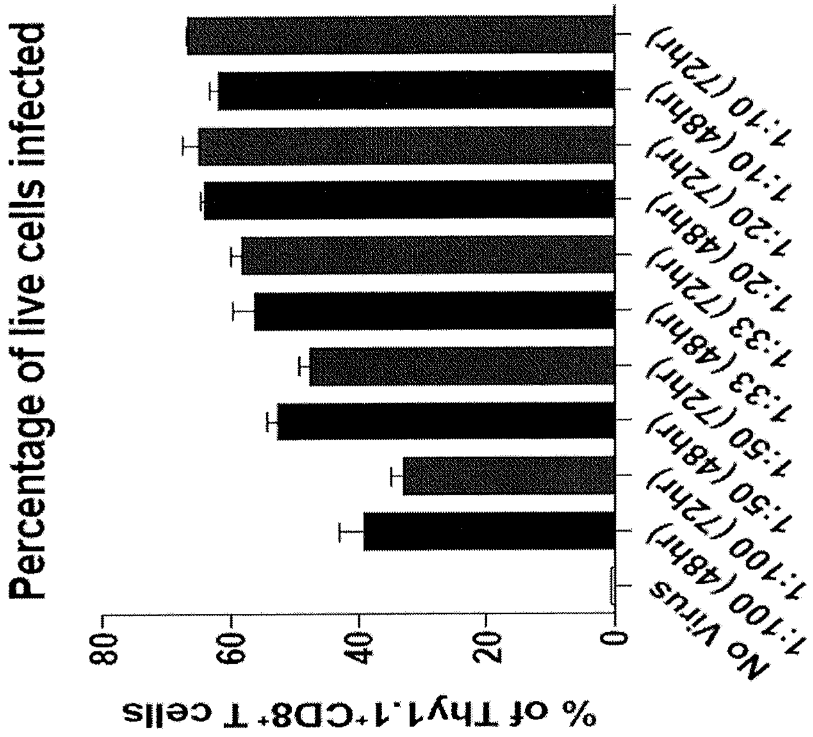

High-titer lentivirus was generated from the mouse genome-scale sgRNA library (termed MKO thereafter), and tested for efficient virus transduction of cytotoxic T cells. Naive $CD8^+$ T cells were isolated from mice that constitutively express Cas9, enabling genetic perturbations upon delivery of sgRNA, transduced with various concentrations of MKO virus, and analyzed for expression of the Thy1.1 surface marker via flow cytometry three days post-infection (FIG. 1B, FIG. 7A, FIG. 15C). Efficient transduction of $CD8^+$ T cells was achieved with various concentrations of MKO virus, starting at a 1:100 dilution of the original virus concentrate (FIG. 1C, FIGS. 7B-7E, FIG. 15D-15F).

Example 2: Genome-Scale Mutagenesis of $CD8^+$ T Cells and Adoptive Transfer

Figure 1C:
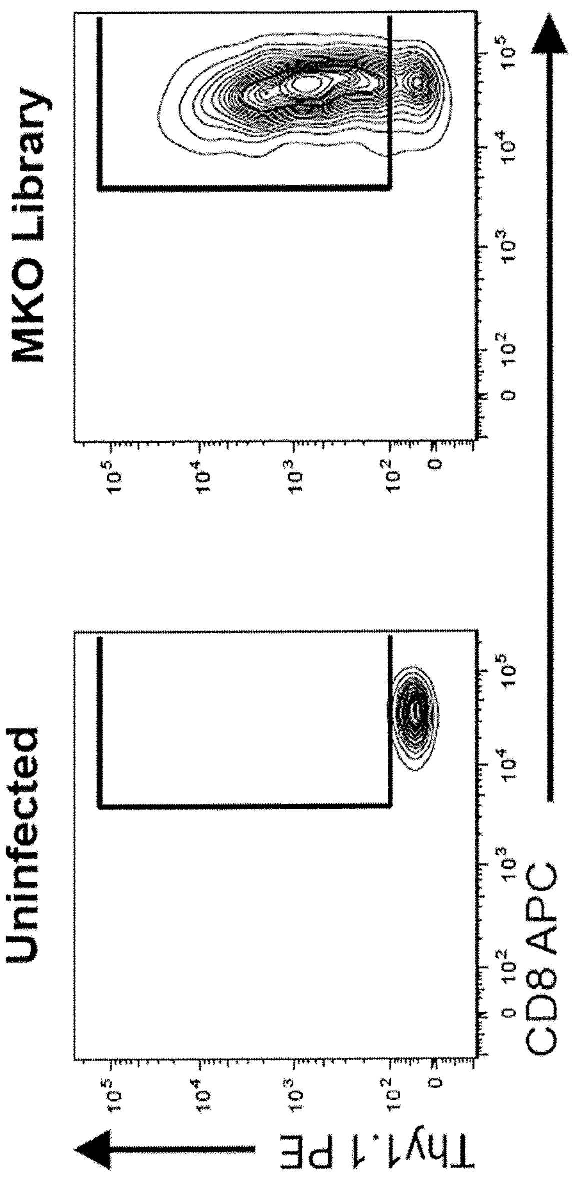

To map the genetic factors modulating the trafficking and survival of diverse T cell populations in vivo, the MKO library was used to interrogate the survival of adoptively transferred mutant T cells after trafficking to relevant organs (FIG. 1B). First, freshly isolated naive Cas9 $CD8^+$ T cells were mutagenized by transducing with the MKO lentiviral sgRNA library to achieve an initial coverage of >700× for each infection replicate (n=3). Three days after transduction, the MKO-infected mutant pool of $CD8^+$ T cells (MKO T cell library) was adoptively transferred into wildtype C57BL/6 (B6) recipient mice (n=7) (FIG. 1B), without lymphodepletion or any other immune modulation. After adoptive transfer, T cells in circulation traffick to lymphoid and non-lymphoid organs in which they either survive or undergo apoptosis. In order to systematically examine whether T cells trafficked to these organs and persisted within the in vivo tissue microenvironment, the relative abundance of surviving mutants was assessed seven days after adoptive transfer. The mice were sacrificed and various lymphoid and non-lymphoid organs isolated to investigate the surviving MKO T cells in each organ by sequencing the sgRNA representation. The liver, pancreas, lung, muscle and brain were collected and surveyed as representative non-lymphoid organs, and the spleen and several types of lymph nodes (LNs) as lymphoid organs (FIG. 1C). The LNs collected included three groups: LN1—skin draining lymph nodes (sLNs) comprised of inguinal, popliteal, axillary, and brachial lymph nodes; LN2—cervical lymph nodes (cLNs) that entailed the 6 superficial lymph nodes; and LN3—abdominal lymph nodes (aLNs) that included the mesenteric and the pancreatic lymph nodes (FIG. 1B).

Figure 1D:
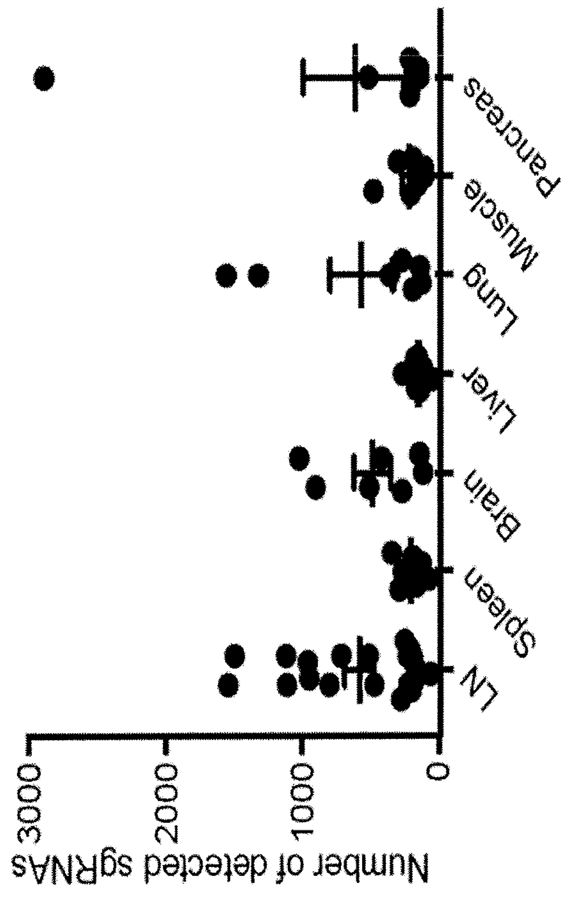
Figure 1E:
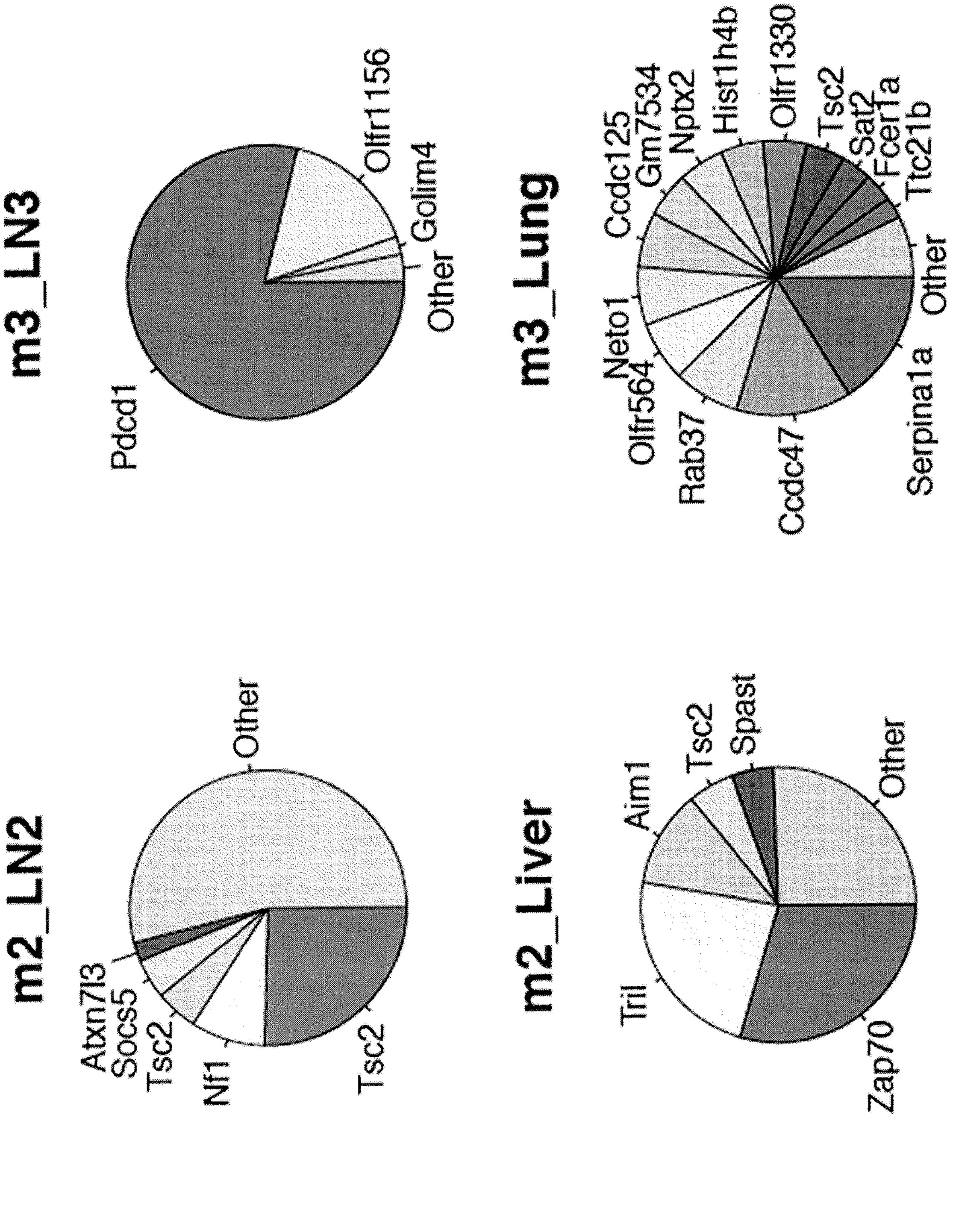
Figure 1F:
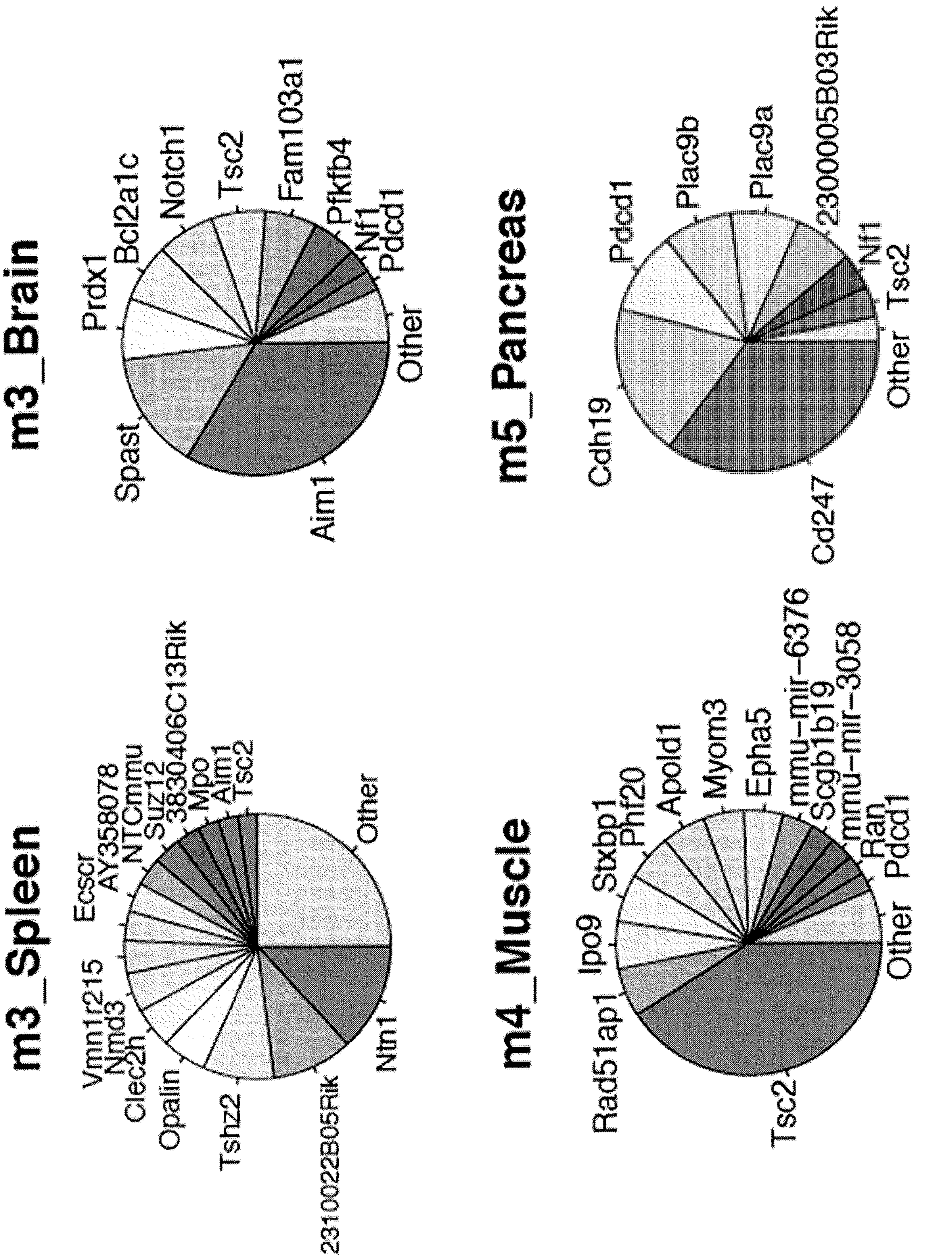
Figure 1G:
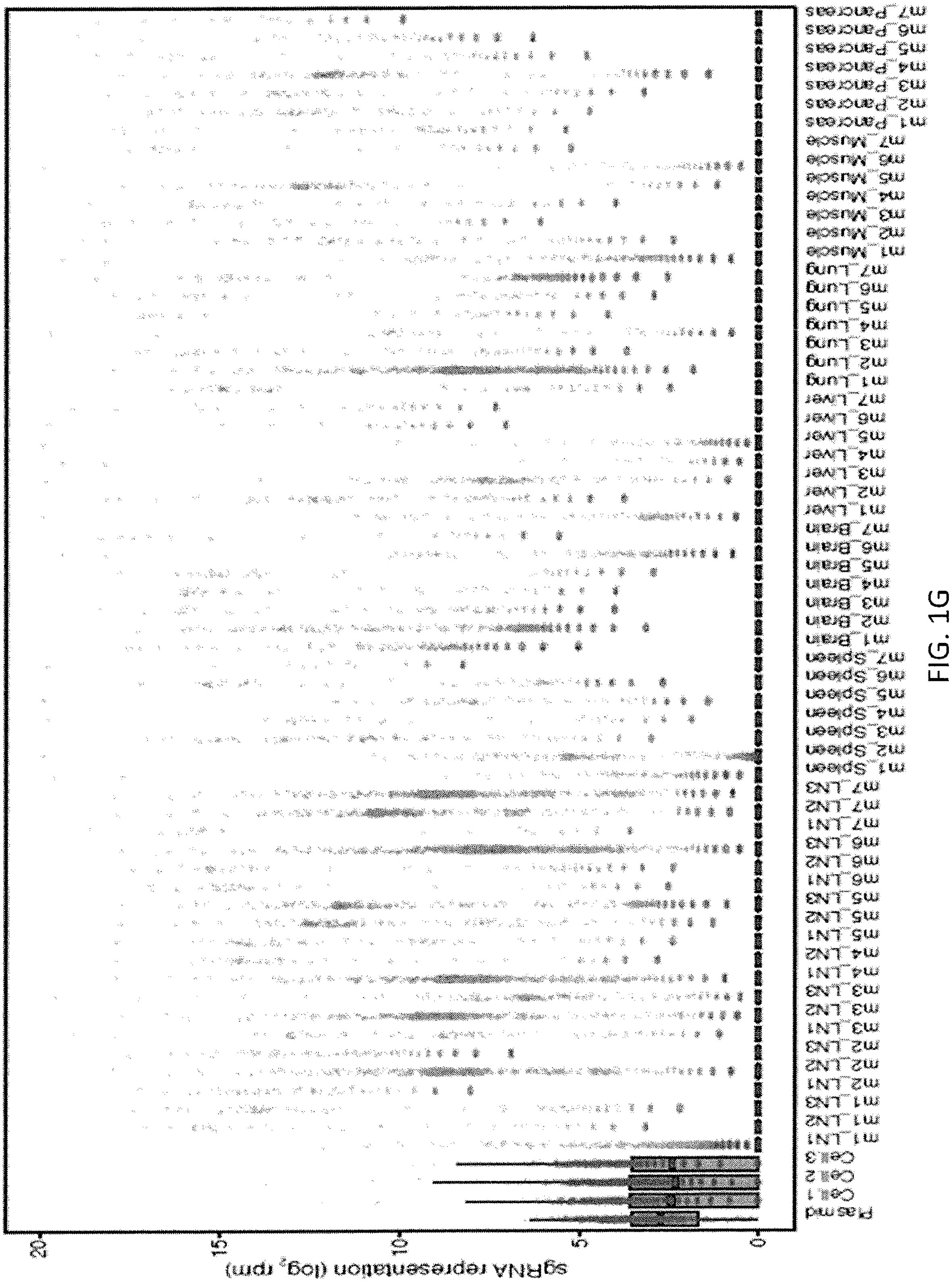
Figure 1H:
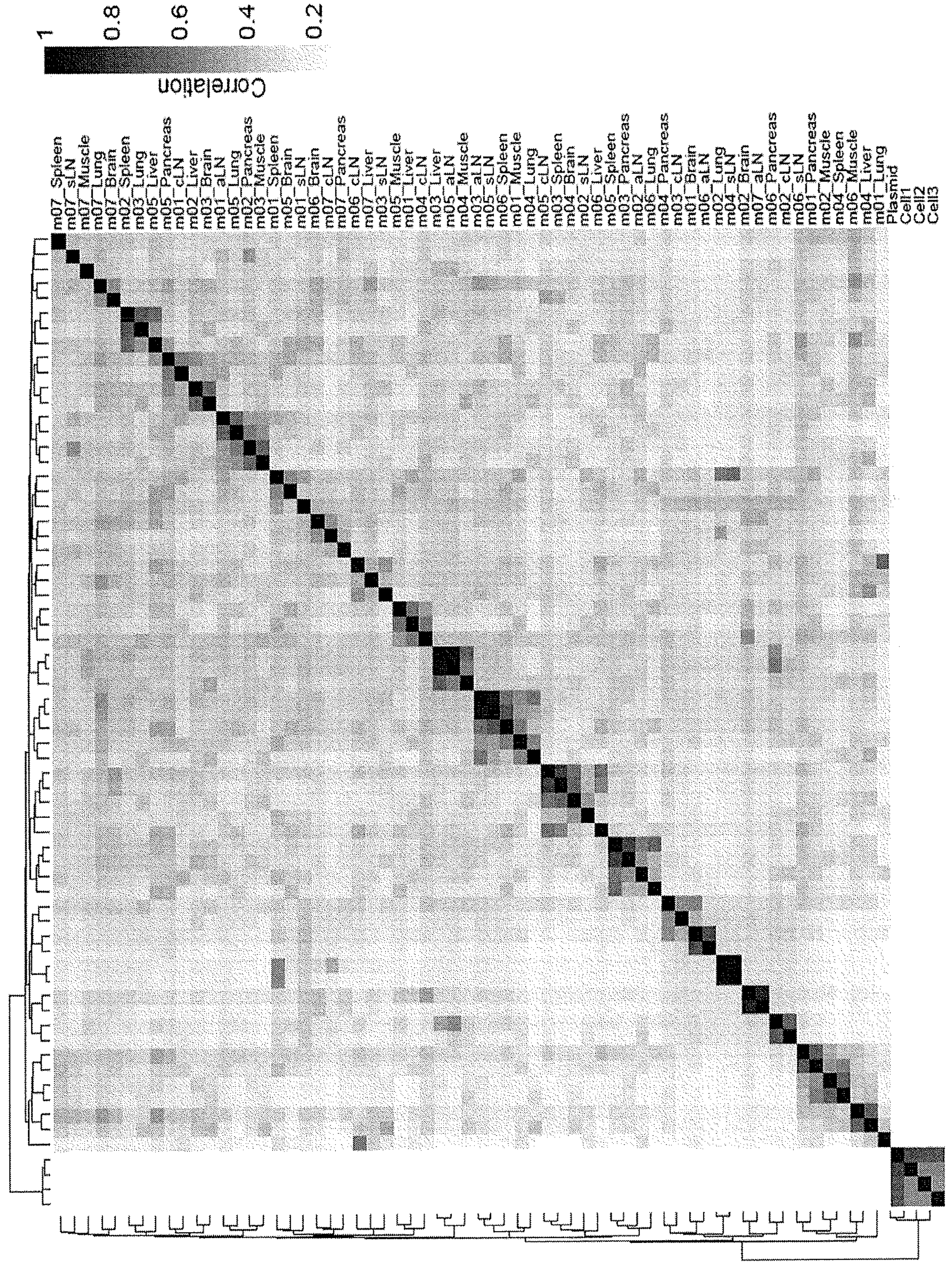
Figure 8A:
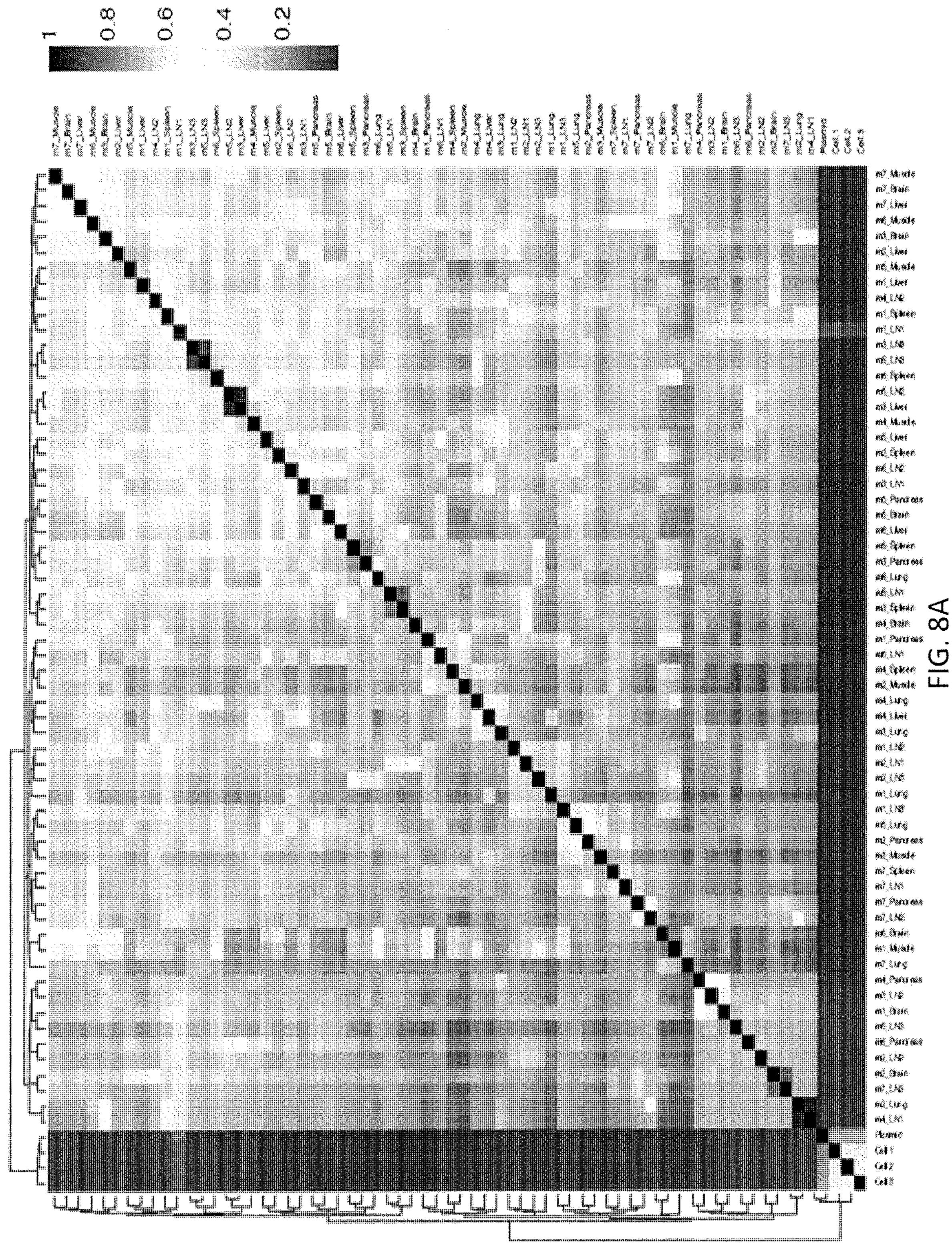
Figure 8B:
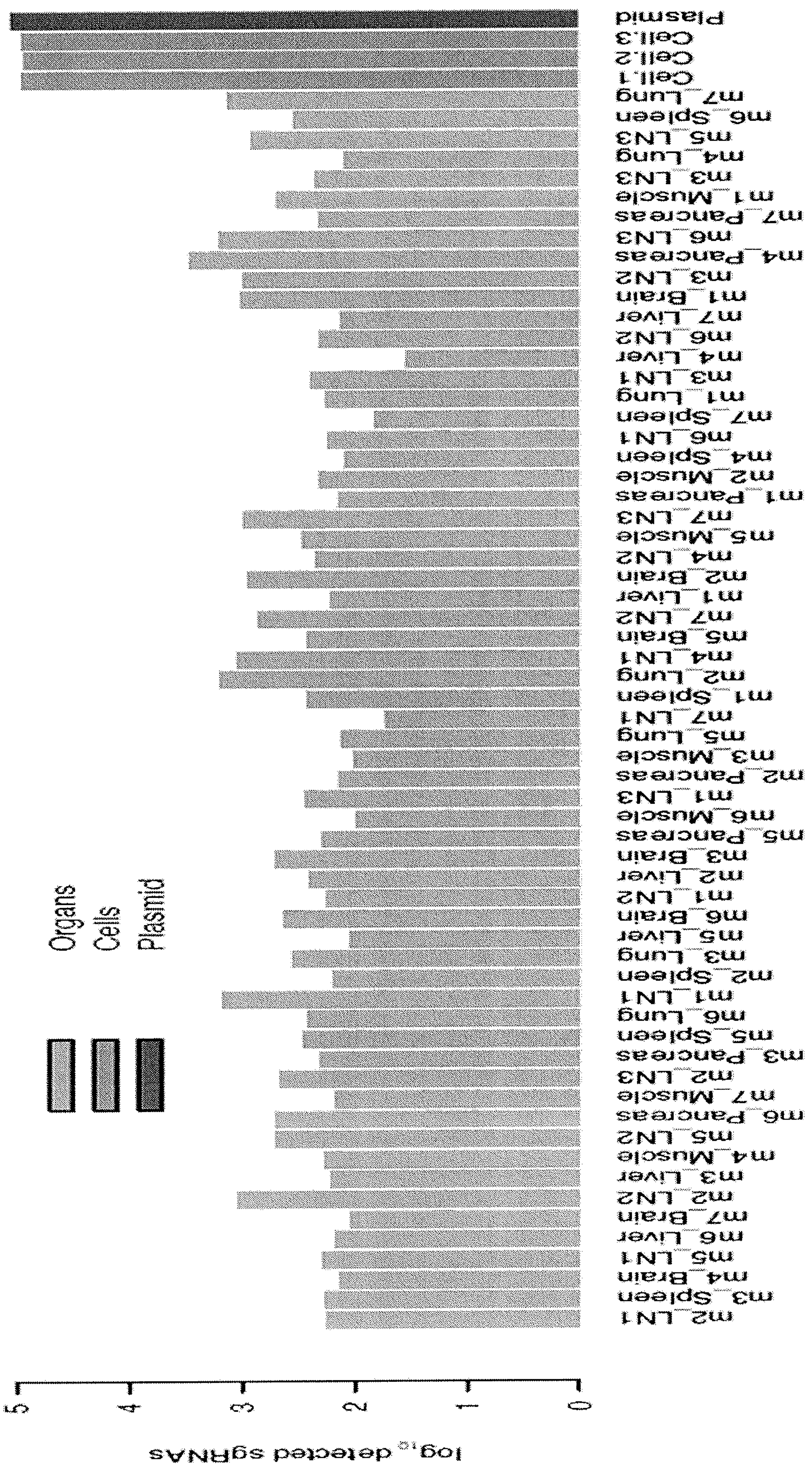

Example 3: In Vivo Analysis of Genome-Scale T Cell Mutants for Representation in Mouse Organs after $CD8^+$ $T_{eff}$ Cell Trafficking Illumina sequencing was performed and the sgRNA library representation of the $CD8^+$ T cells in all organs, as well as three representative pools of pre-injected MKO-transduced T cells, were successfully readout. As shown in FIGS. 1E-1F, different organs can display highly dynamic compositions of sgRNAs. While an organ can be dominated by one or a few T cell mutants (e.g. a $CD8^+$ T cell clone with an sgRNA targeting Program cell death protein 1 (PD-1/Pdcd1) dominated the LN sample in mouse 3) (FIG. 1E), a given organ can also consist of multiple highly abundant, but non-dominating clones (FIGS. 1E-1F, FIGS. 9A-9I). Monoclonal (one major clone), oligoclonal (2 to 10 major clones each with ≥2% of total reads) and polyclonal (more than 10 clones with 2% or more reads) compositions of T cell variants exist in both lymphoid and non-lymphoid organs (FIGS. 1E-1G, FIGS. 9A-9I). The library representation in all three replicates of uninfected T cells closely clustered with each other and the MKO plasmid library, whereas the library representation of all organs clustered together (FIG. 1H, FIG. 8A). On average, a total of 86,277±536 (78.34%±0.49% of plasmid) sgRNAs were detected in the initial T cell population (mean±s.e.m. (standard error of the mean), n=3) (FIG. 8B), whereas only a small fraction of sgRNAs (435±62, or 0.39%±0.06% of plasmid)) were detected in internal organs, indicating a low diversity of T cell mutants in these organs (FIG. 8B). Across all organ types, the LN group had the most detected sgRNAs (578±106 (mean±s.e.m.), n=20) whereas liver had the least (142±25, n=7) (FIG. 1D, FIG. 8B). These data suggest that, after trafficking in vivo for 7 days, only a small fraction of the adoptively transferred $CD8^+$ T cell variants survived in the destination organs.

Figure 8C:
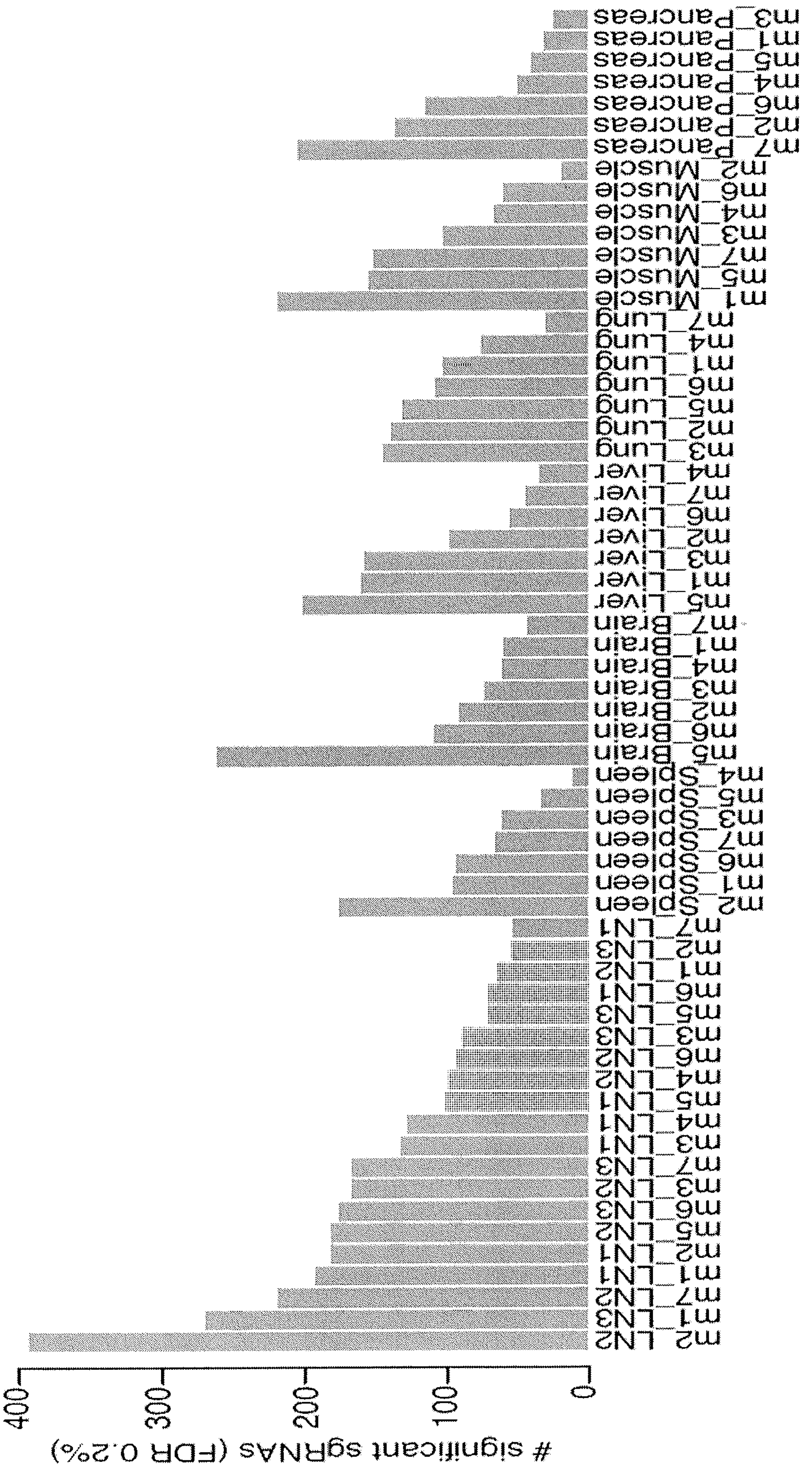
Figure 8D:
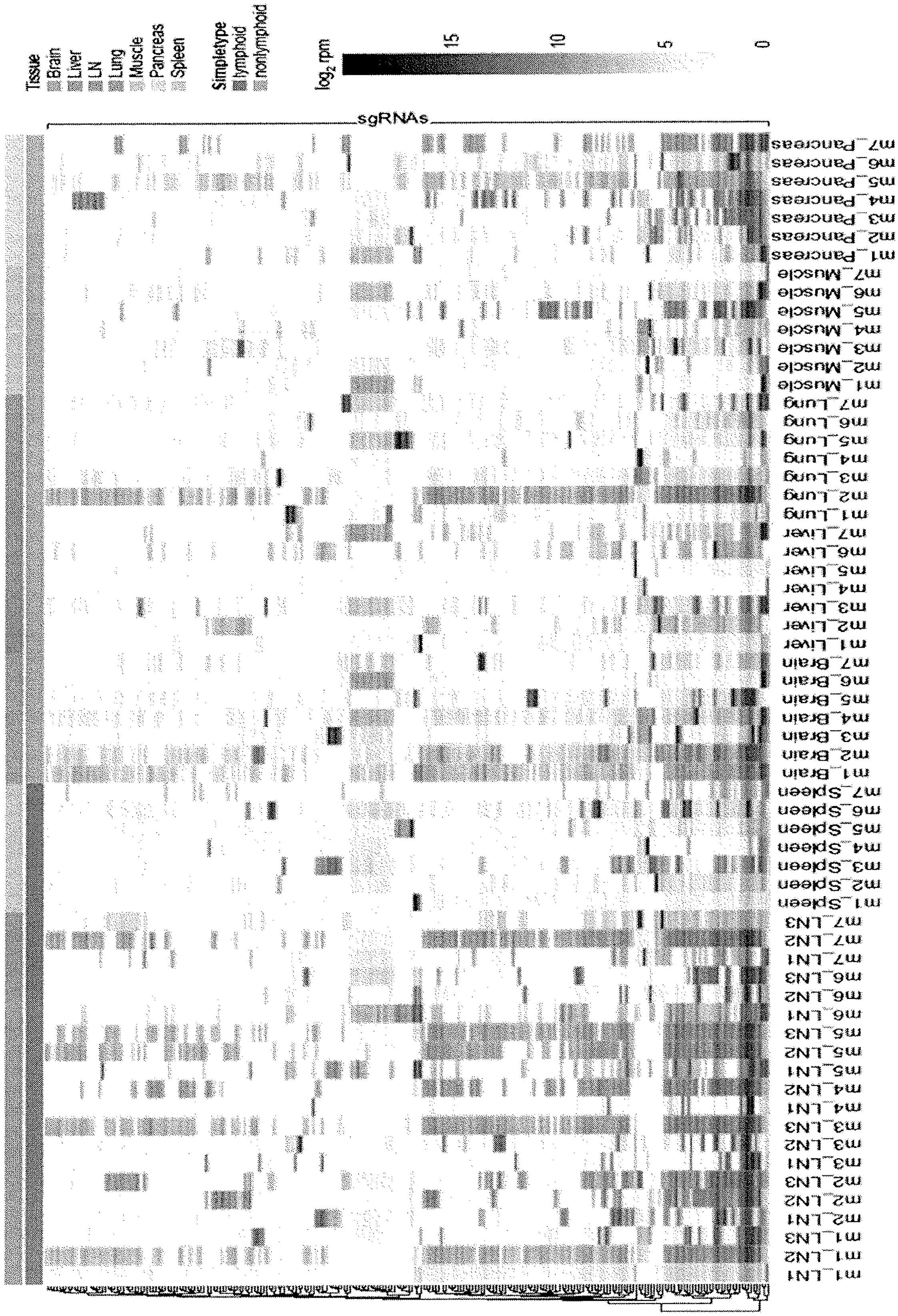
Figure 9A:
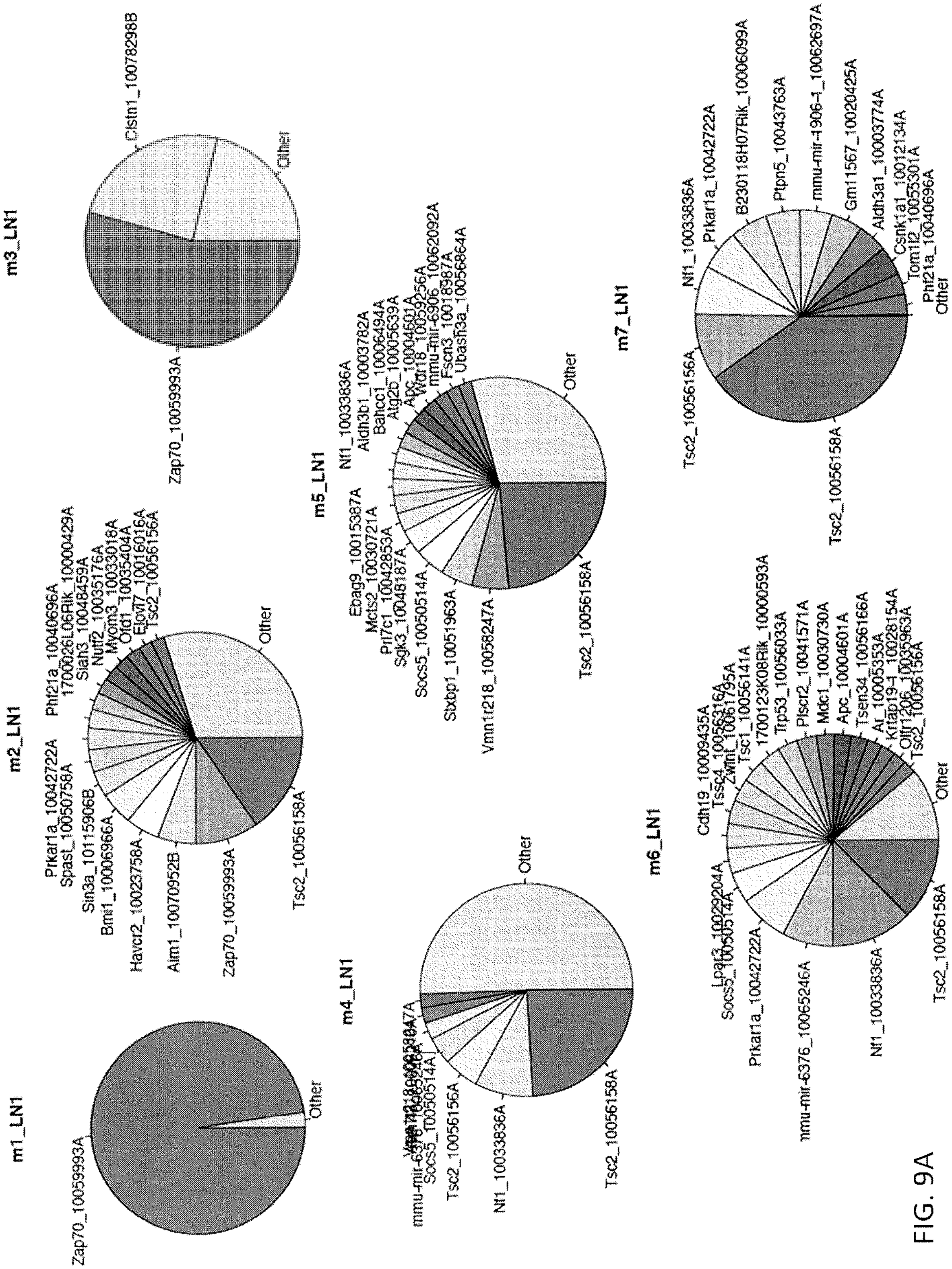
FIGS. 9A-9I are a series of pie charts showing results from analysis of genome-scale CRISPR screen of naive Cas9 $CD8^+$ $T_{eff}$ cell survival in WT mice (in 3 pages). All pie charts of sgRNA compositions in organ samples. SgRNAs that comprised≥2% of total reads for each sample are shown, with the remaining reads classified as "Other.
Figure 9B:
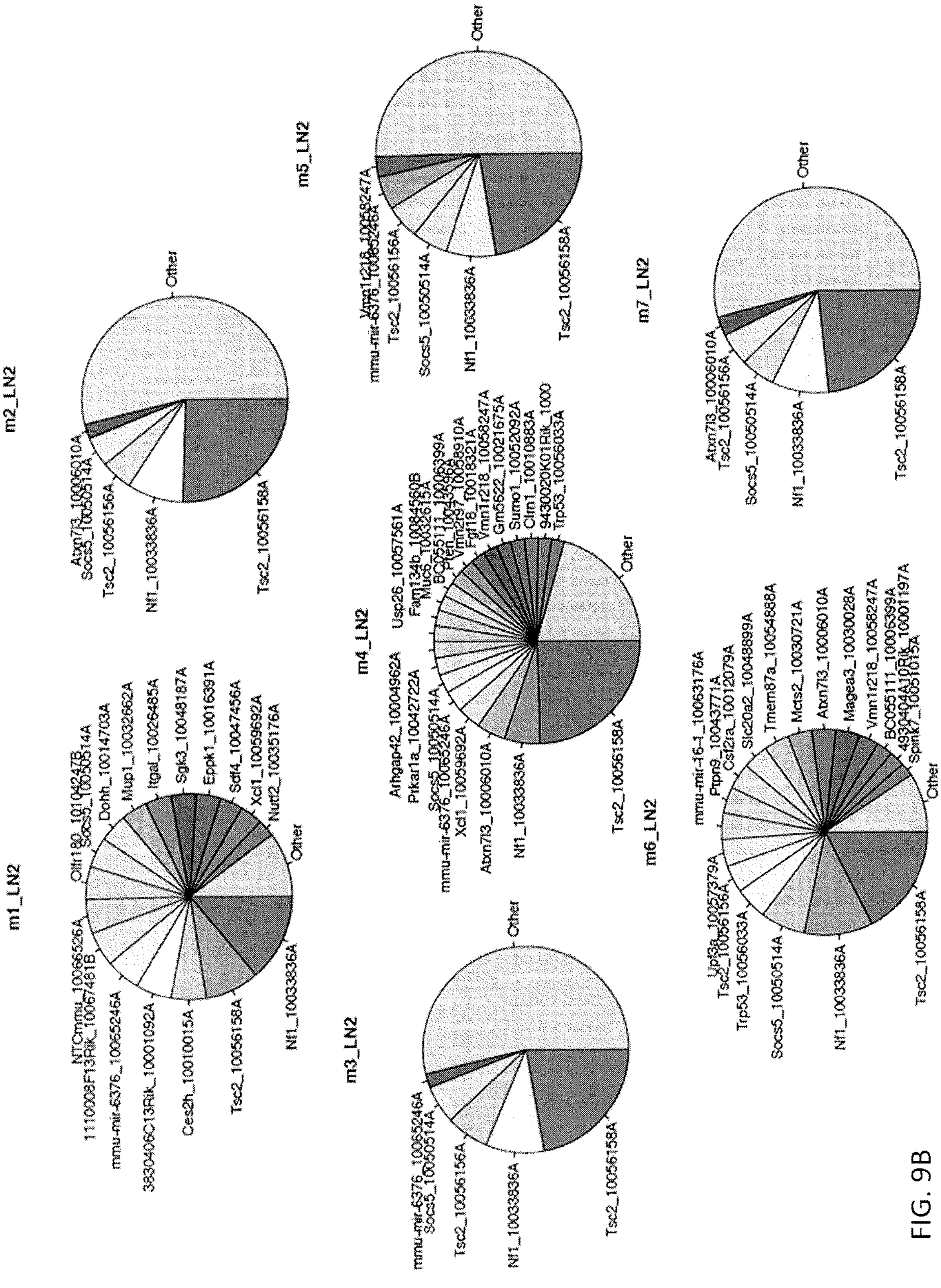
Figure 9C:
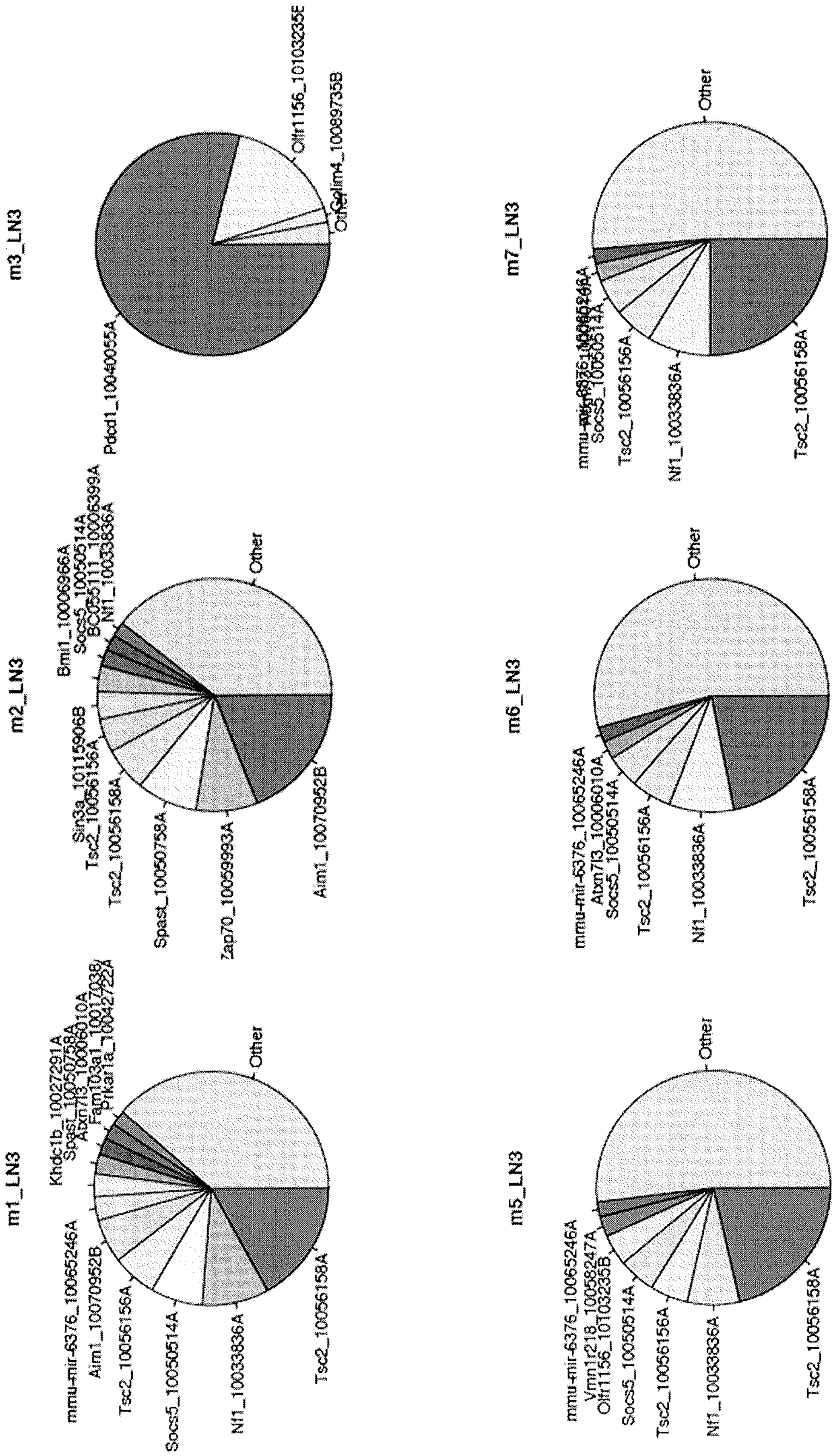
Figure 9D:
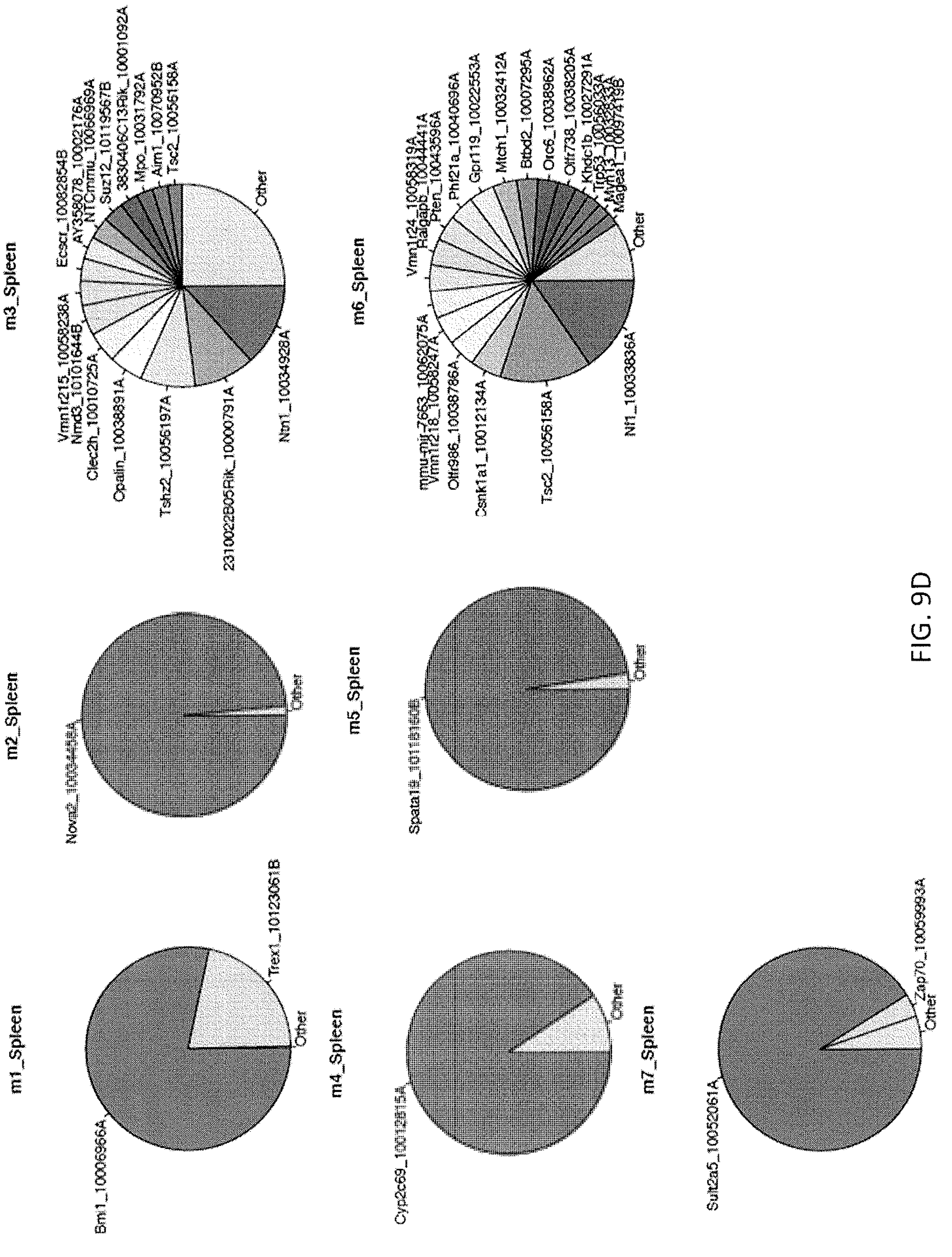
Figure 9E:
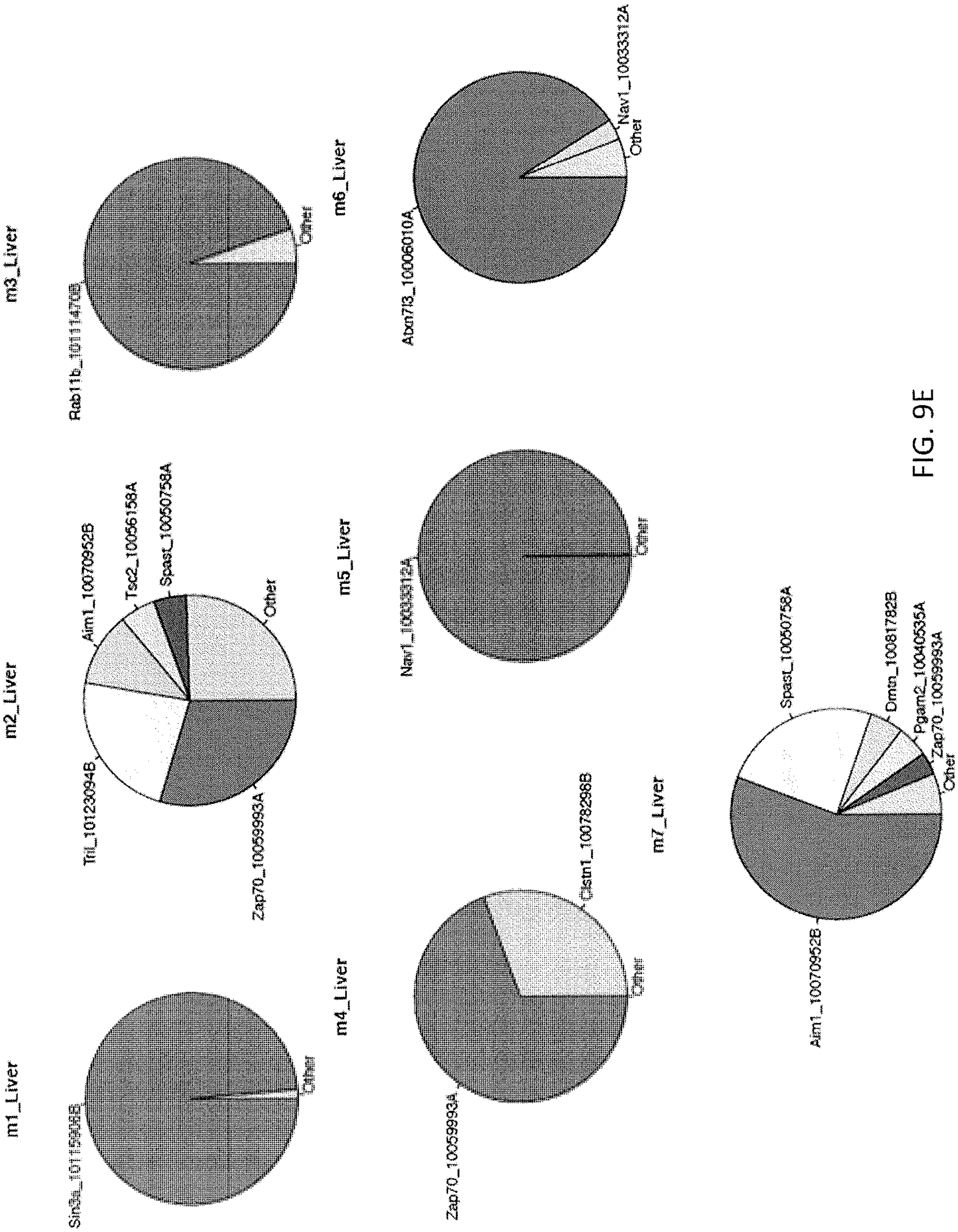
Figure 9F:
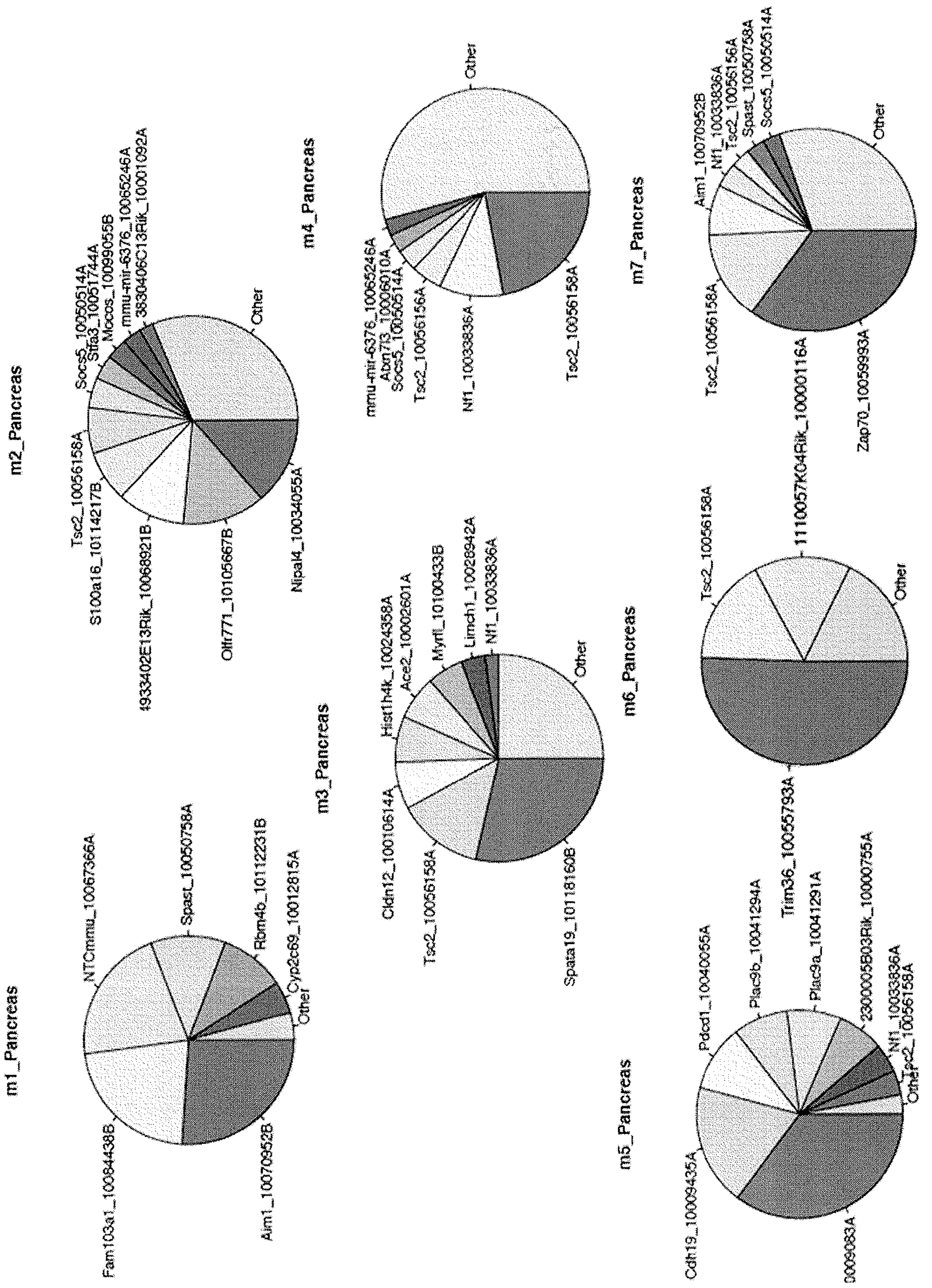
Figure 9G:
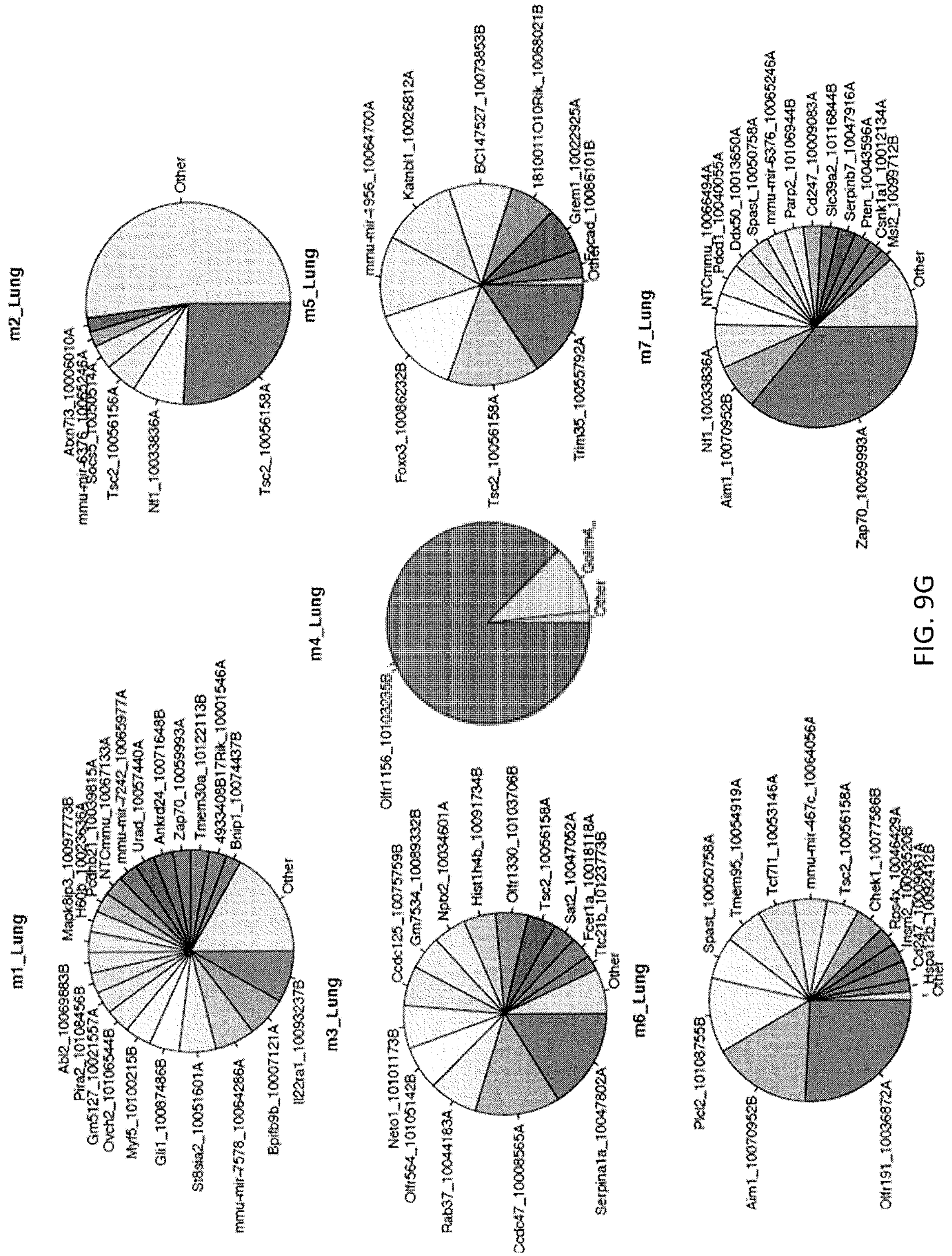
Figure 9H:
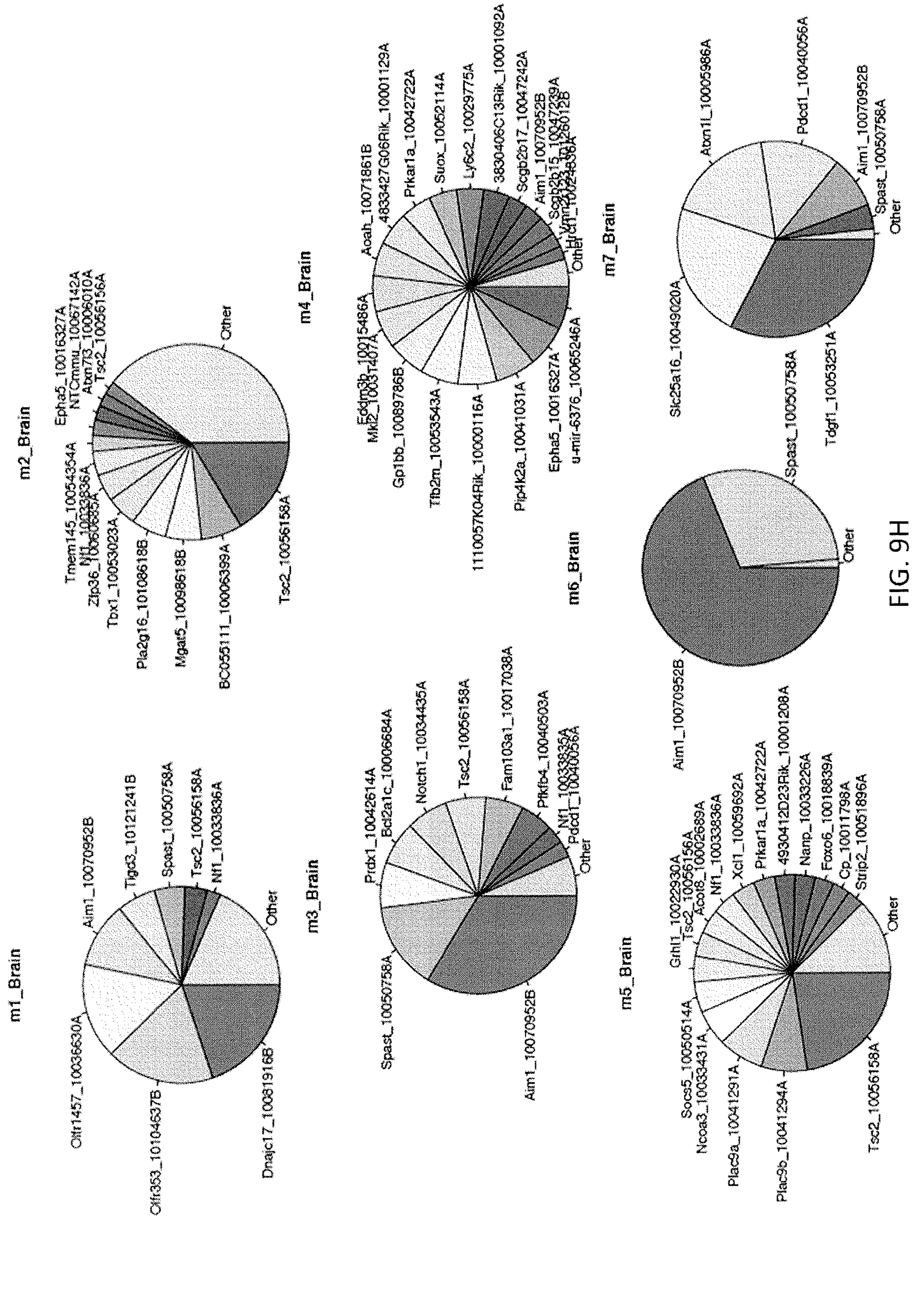
Figure 9I:
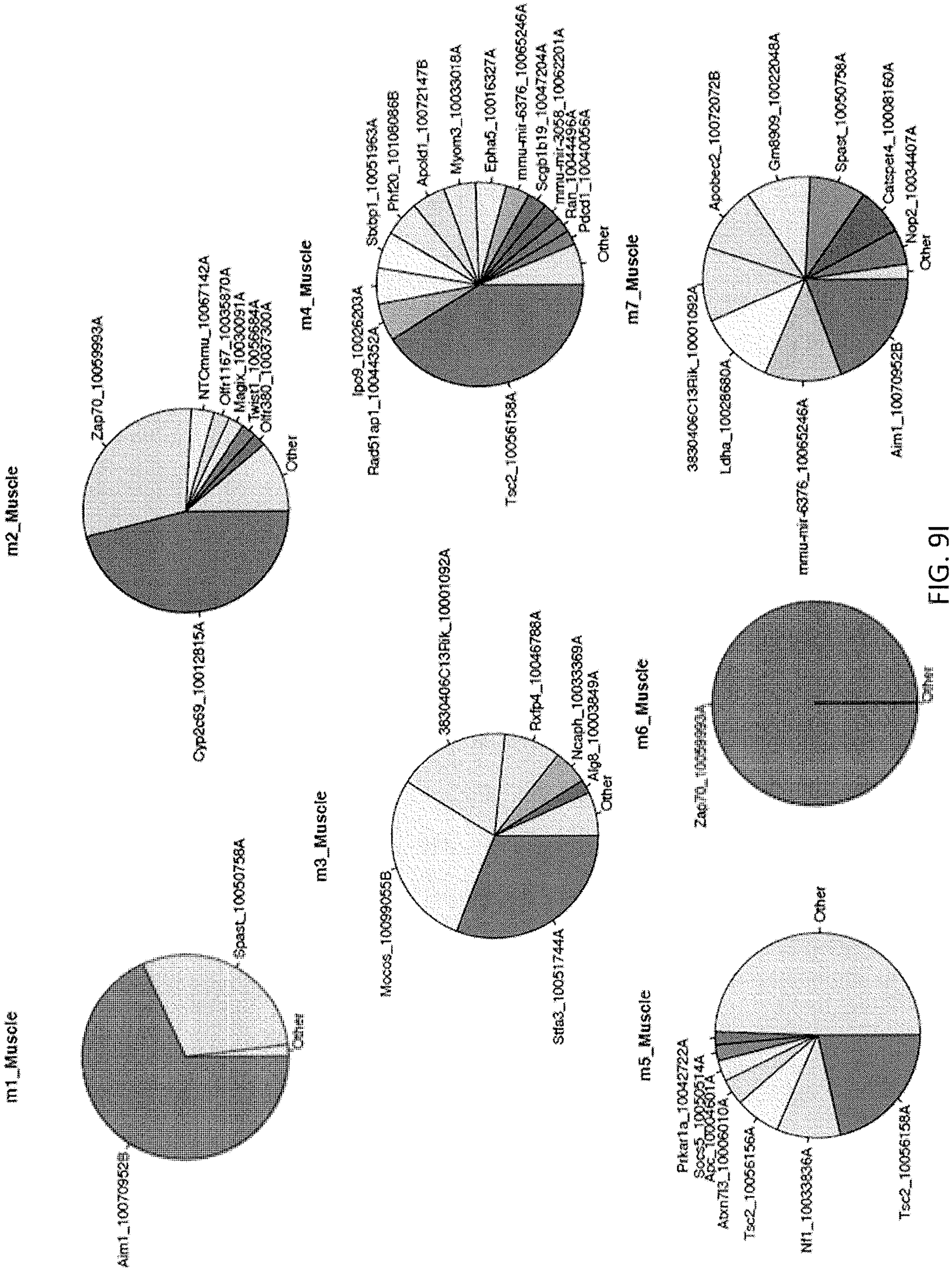
Figure 16A:
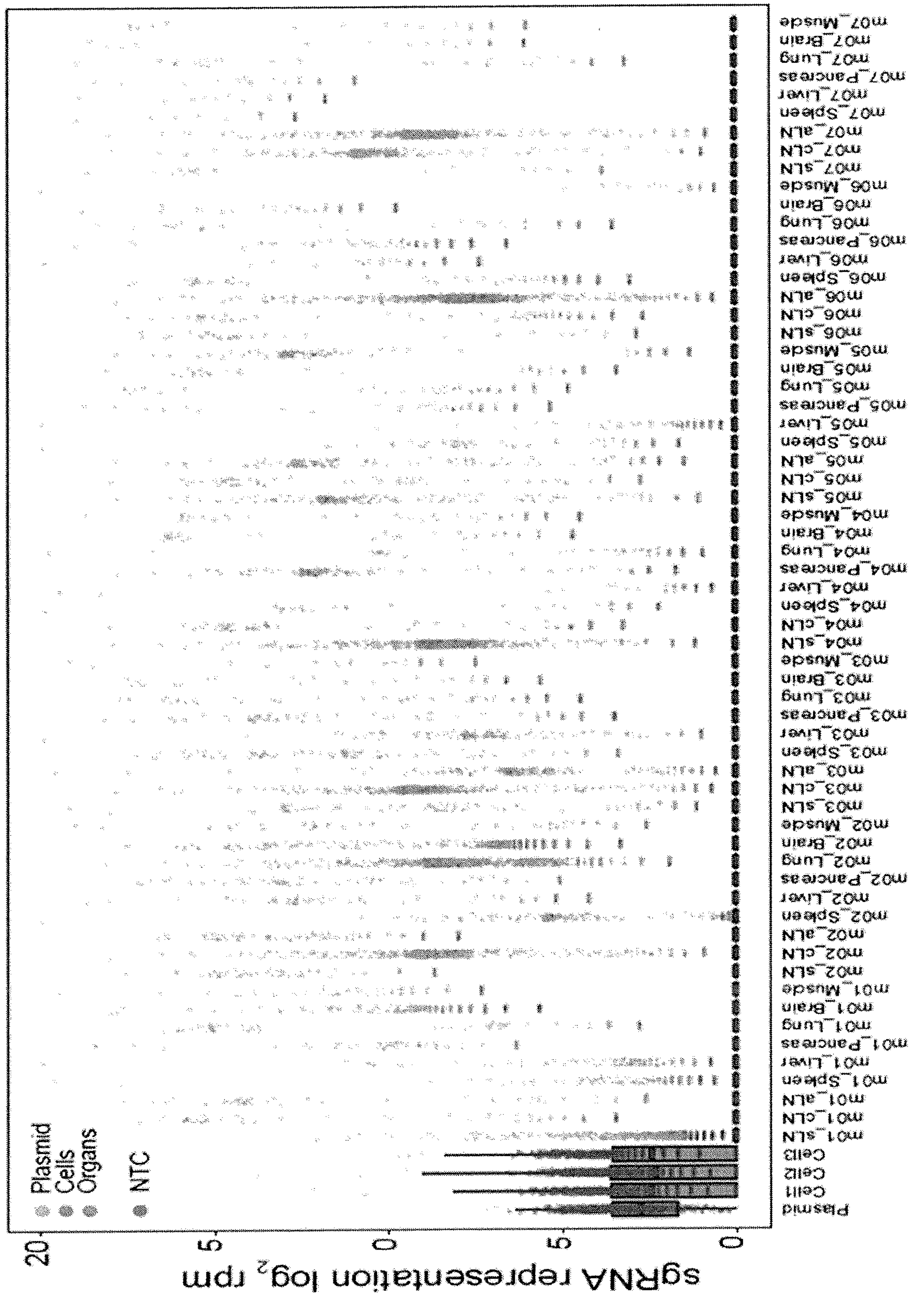
FIGS. 16A-16D are a series of plots illustrating additional analysis of genome-scale CRISPR $CD8^+$ T cell survival screens.
Figure 16B:
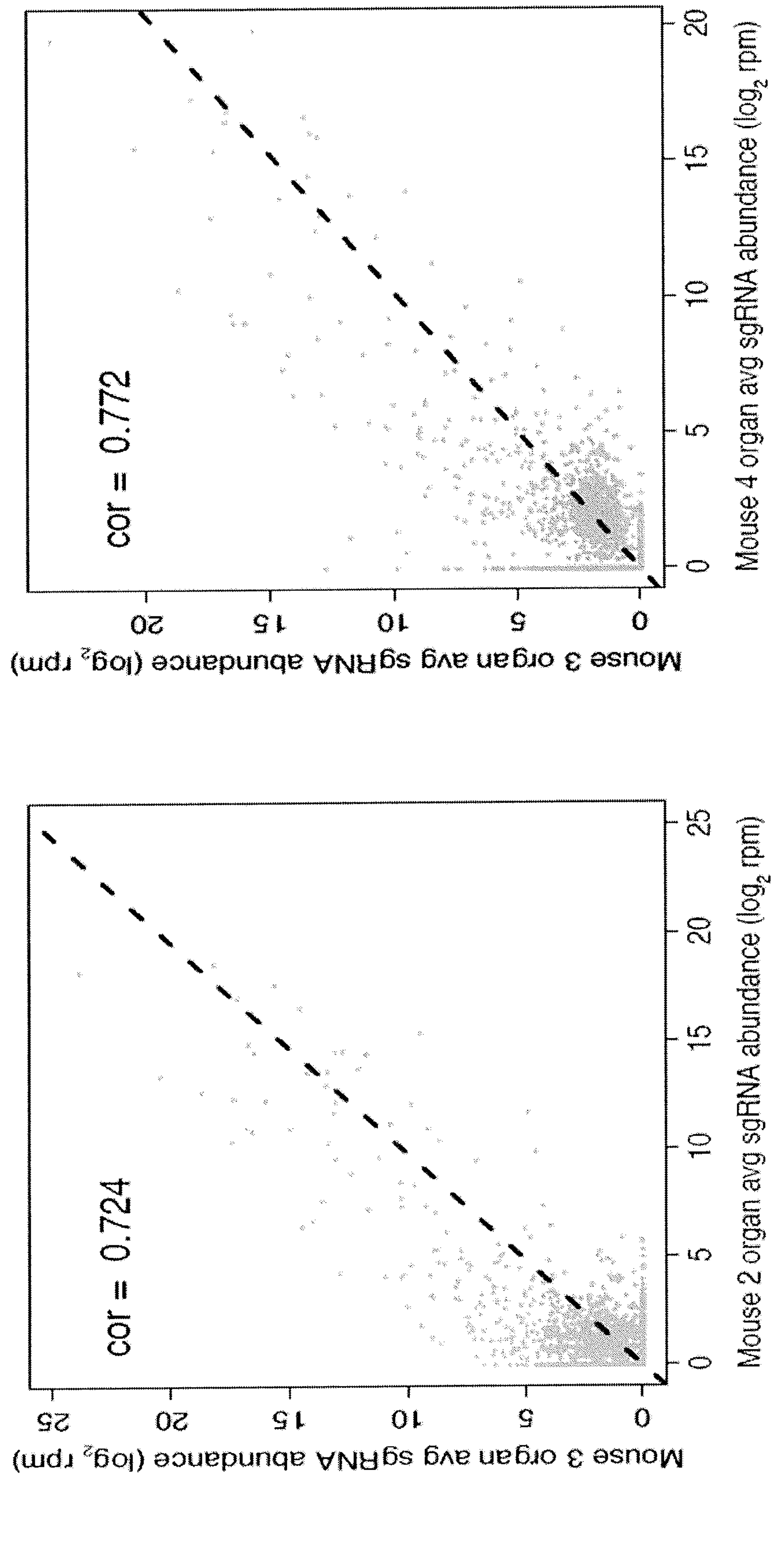

While the library representation of infected, pre-injected T cells followed a log-normal distribution for both gene-targeting sgRNAs (GTS) and NTCs, the sgRNA representation in organs was characterized by the dominance of a small fraction of sgRNAs (FIGS. 1E-1G, FIGS. 9A-9I, FIG. 16A), a signature of clonal expansion of a subset of targeted T cells. While an organ can be dominated by one or a few T cell mutants (e.g. a $CD8^+$ T cell clone with an sgRNA targeting Program cell death protein 1 (PD-1/Pdcd1) dominated LN3 sample in mouse 3) (FIG. 1E), it can also consist of multiple highly abundant, but not dominating clones (FIG. 1E, FIGS. 9A-9I). Monoclonal (one major clone with >=90% of total reads), oligoclonal (3 to 10 major clones each with >=2% of total reads) and polyclonal (more than 10 clones with 2% or more reads) compositions of T cell variants existed in both lymphoid and non-lymphoid organs (FIG. 1E, FIGS. 9A-9I). At the individual mouse level, the sgRNA representation between different mice were correlated with each other (FIG. 16B). All these enriched sgRNAs across all 62 organ samples showed a highly heterogeneous landscape of enrichment pattern, with many sgRNAs shared between multiple organs (FIG. 8D). These data revealed a global landscape of organ survival for mutant $CD8^+$ T cells with a diverse TCR repertoire, and showed that a small subset of the variants from the MKO $CD8^+$ T cell pool became enriched in vivo after trafficking and survival in a new host for 7 days.

Figure 2B:
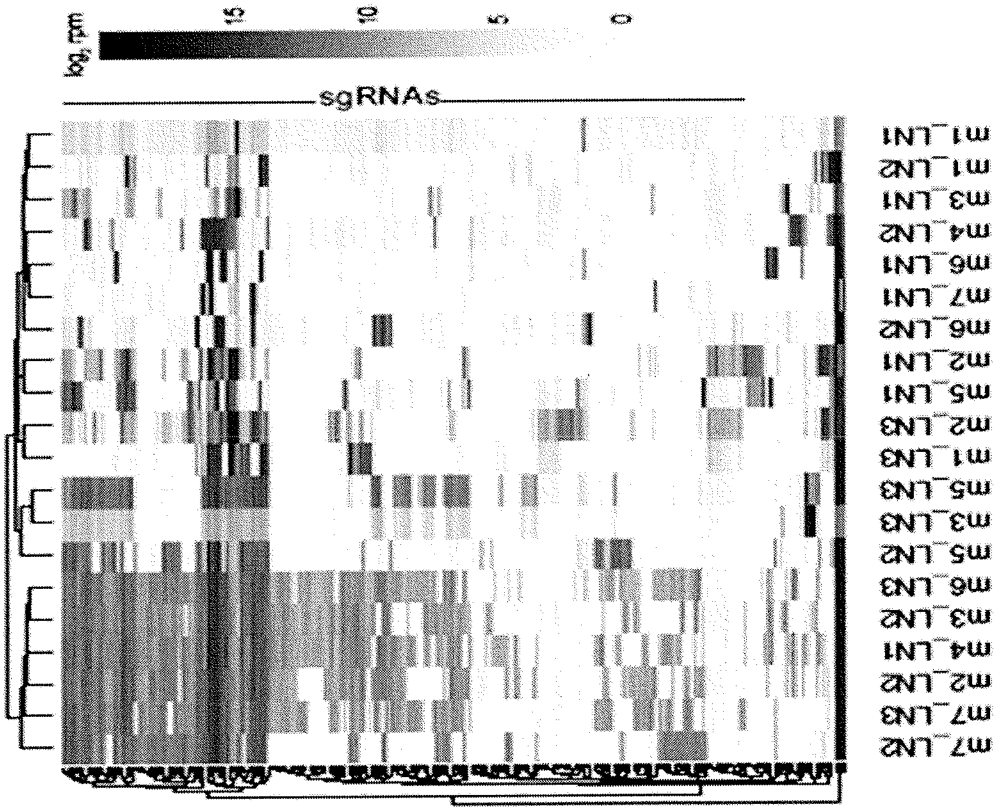
FIGS. 2A-2G are a series of plots and images illustrating significantly enriched sgRNAs and genes of MKO infected CD8+ T cells in wildtype mice.
Figure 2A:
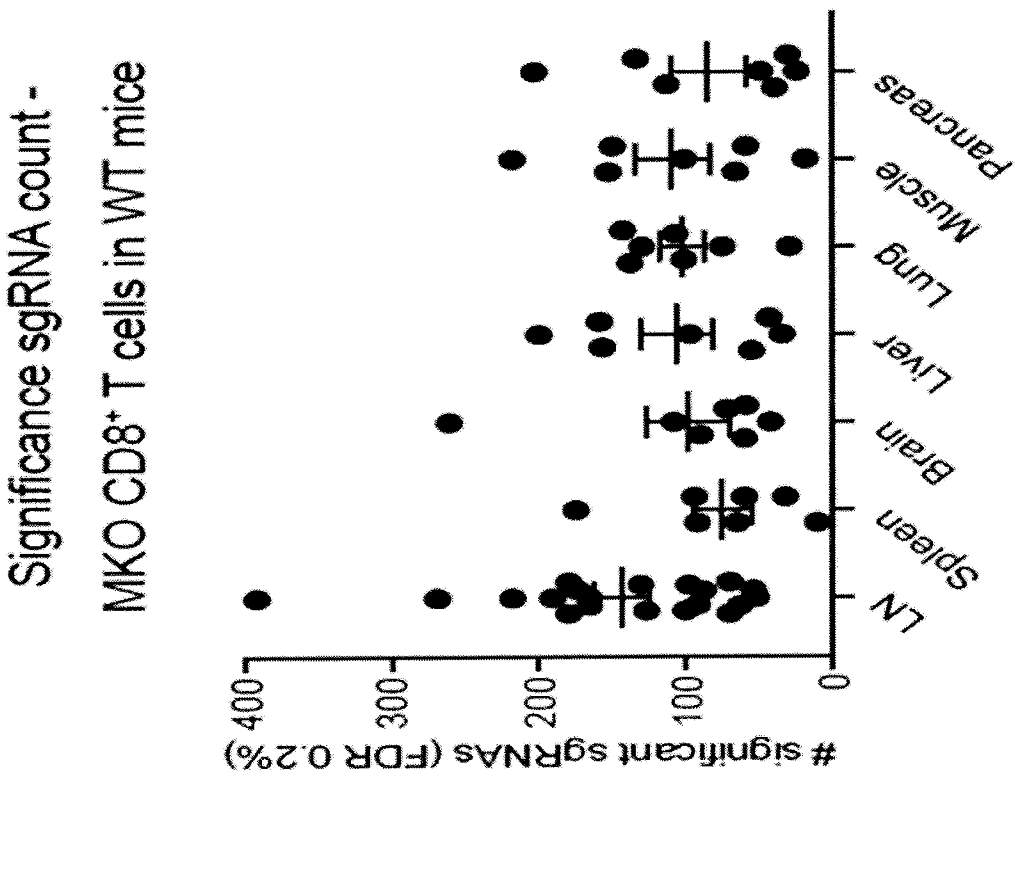

The library representation within each sample was analyzed to find enriched sgRNAs compared to the 1,000 NTC sgRNAs. To identify genes whose perturbation might result in enhanced ability of $CD8^+$ $T_{eff}$ cells to survive in differential organs in vivo, the sgRNAs and genes represented in the MKO library were ranked using multiple statistical metrics. At a false discovery rate (FDR) of 0.5% or lower, a set of significantly enriched sgRNAs were identified in each organ (FIG. 2A, FIG. 8C). In all 62 organs across 7 mice surveyed, an average of 112±9 (mean±s.e.m.) sgRNAs were found as significantly enriched (FIG. 8D). Although the numbers of significant sgRNAs were largely similar between organs, LNs on average (96±9) had the highest number compared to all other organs (two-sided unpaired t-test, p=0.03) (FIG. 2A, FIG. 8D). All these enriched sgRNAs across all 62 organ samples showed a highly heterogeneous landscape of enrichment pattern (FIG. 2B, FIG. 8D). These data revealed a highly dynamic map of mutant $CD8^+$ T cell clonal selection within internal organs after adoptive transfer.

Figure 1I:
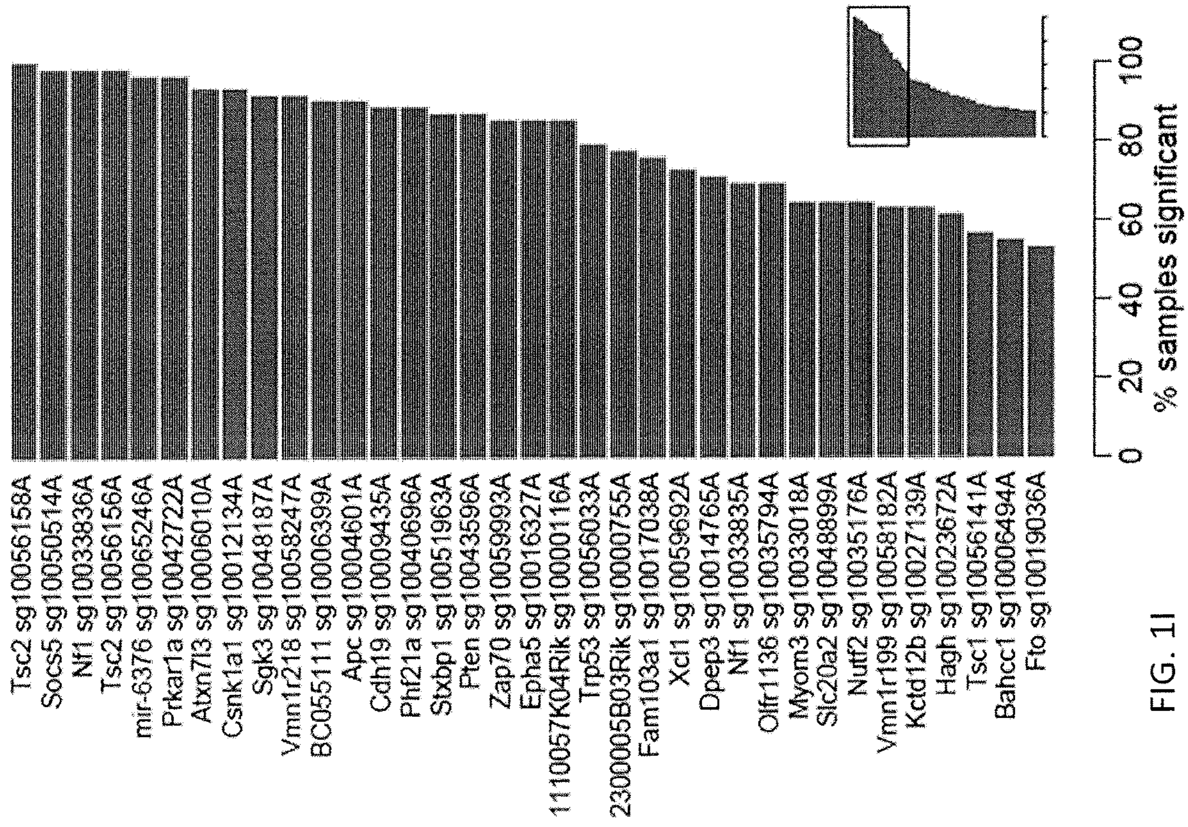
Figure 1J:
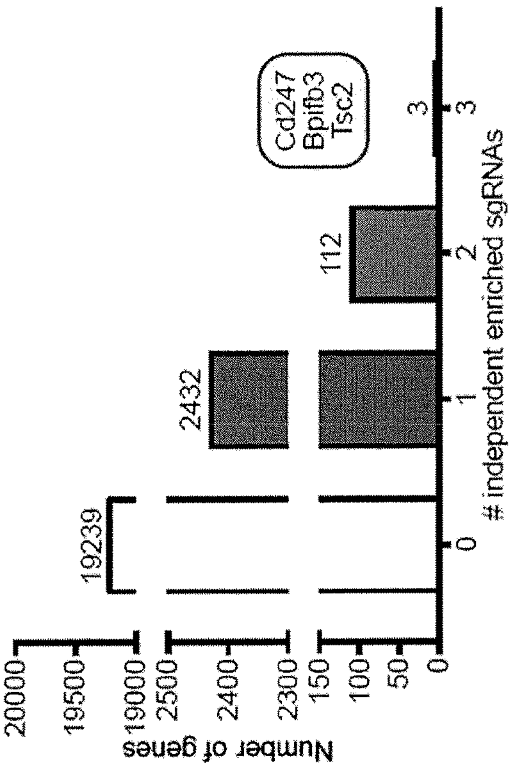
Figure 1K:
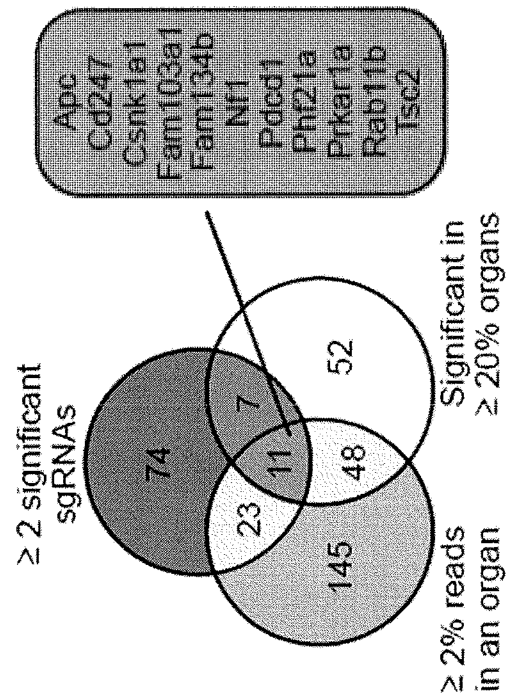
Figure 2C:
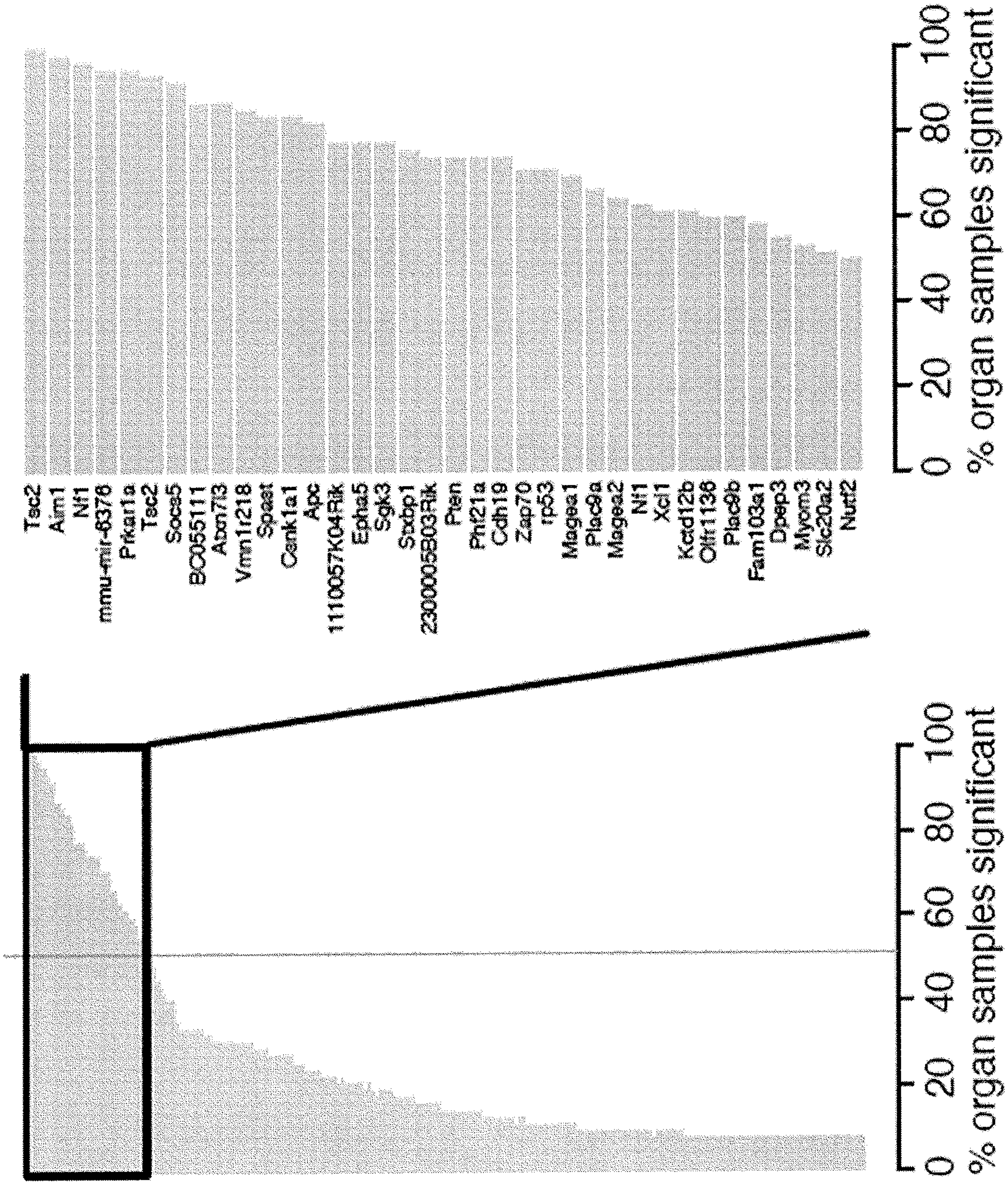
Figure 2E:
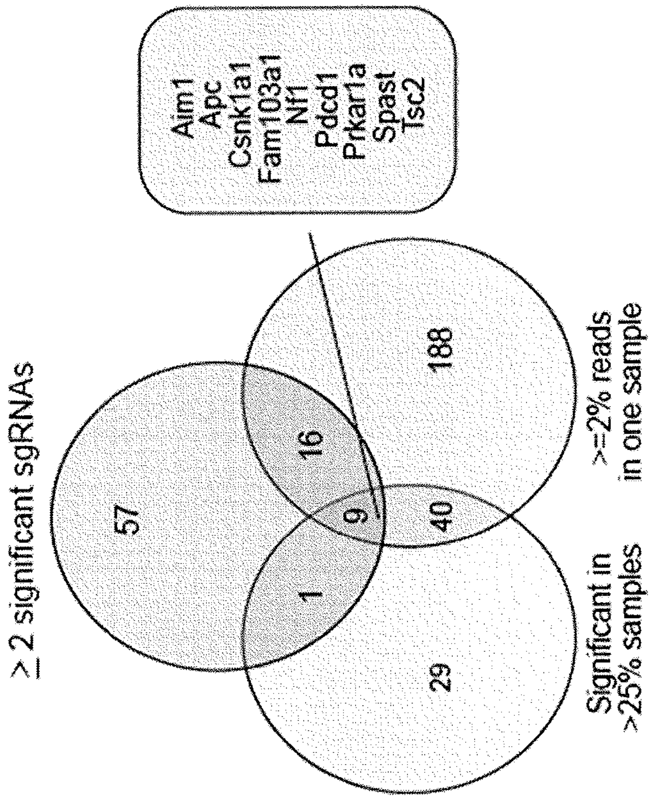
Figure 2D:
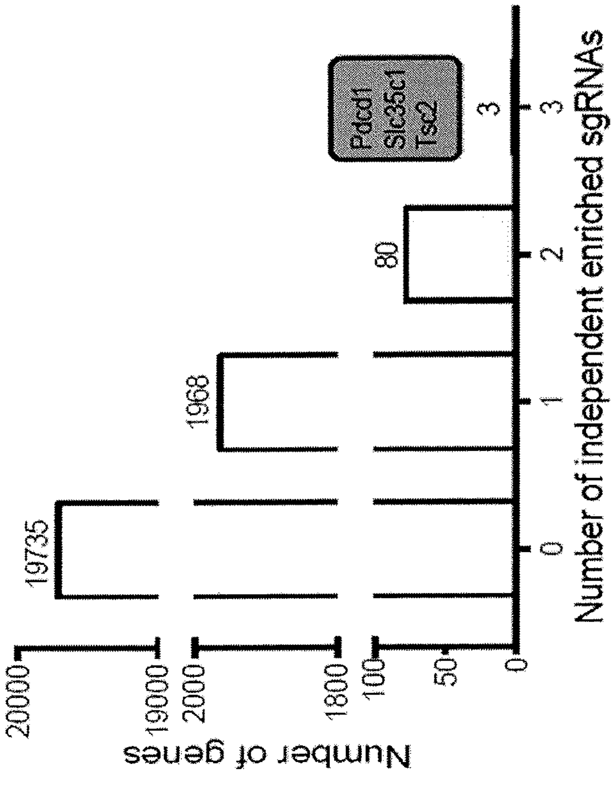
Figure 2G:
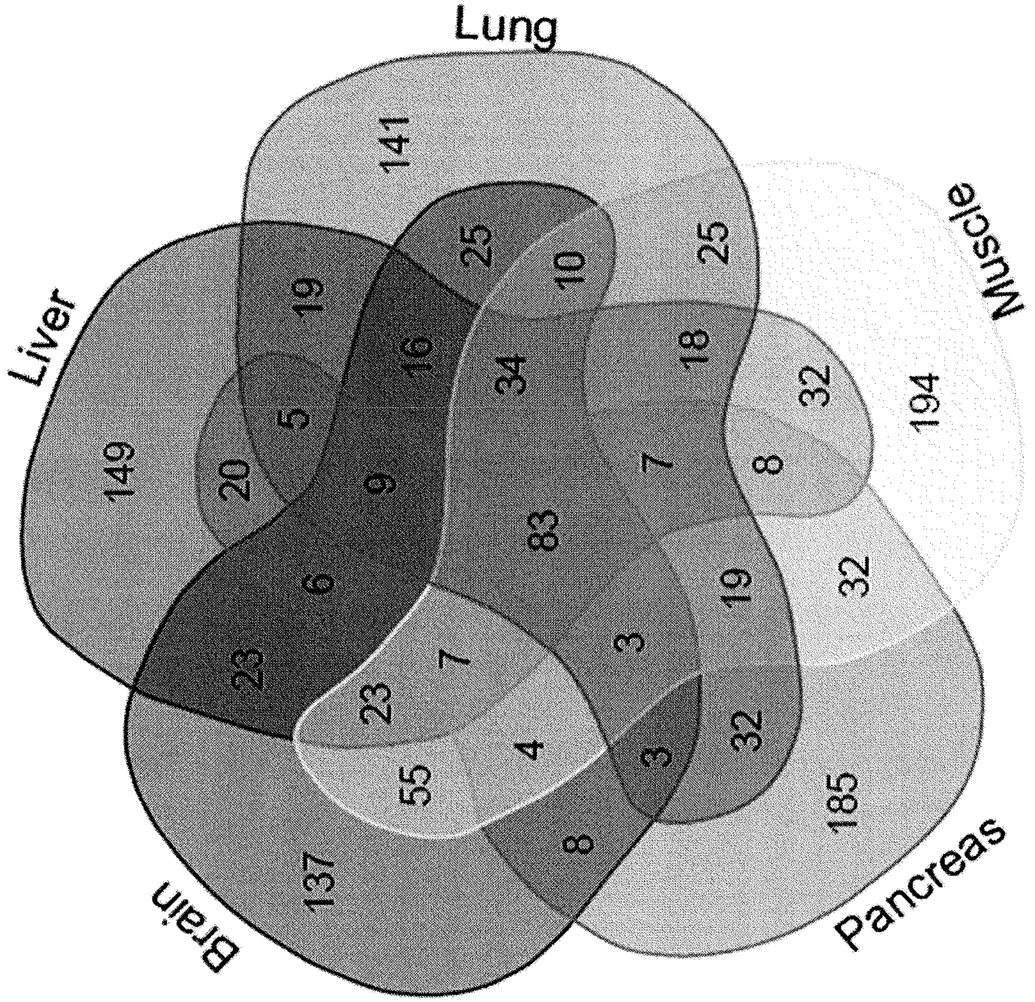
Figure 2F:
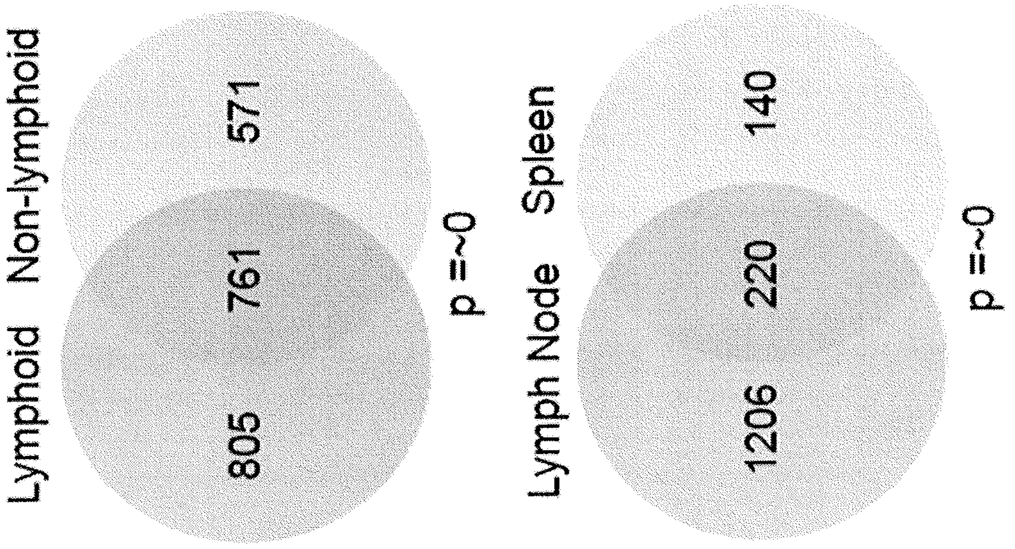
Figure 17A:
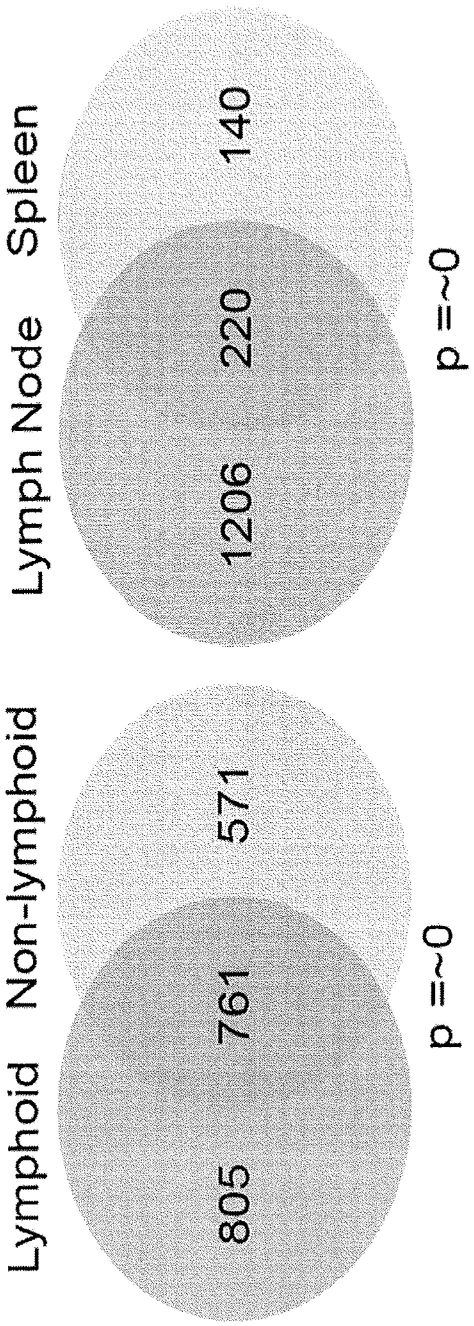
FIGS. 17A-17C are as series of plots and images illustrating analysis of sgRNA library representation by organ types.
Figure 17B:
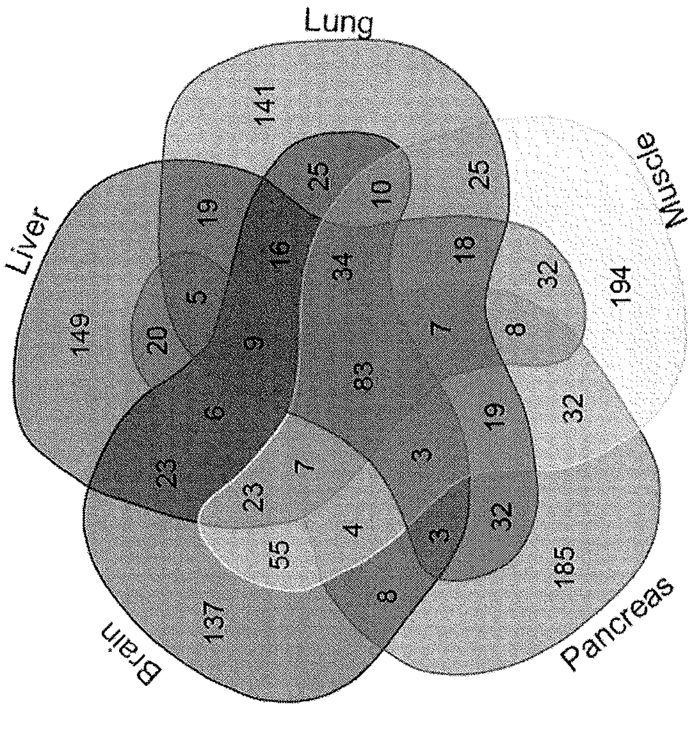
Figure 17C:
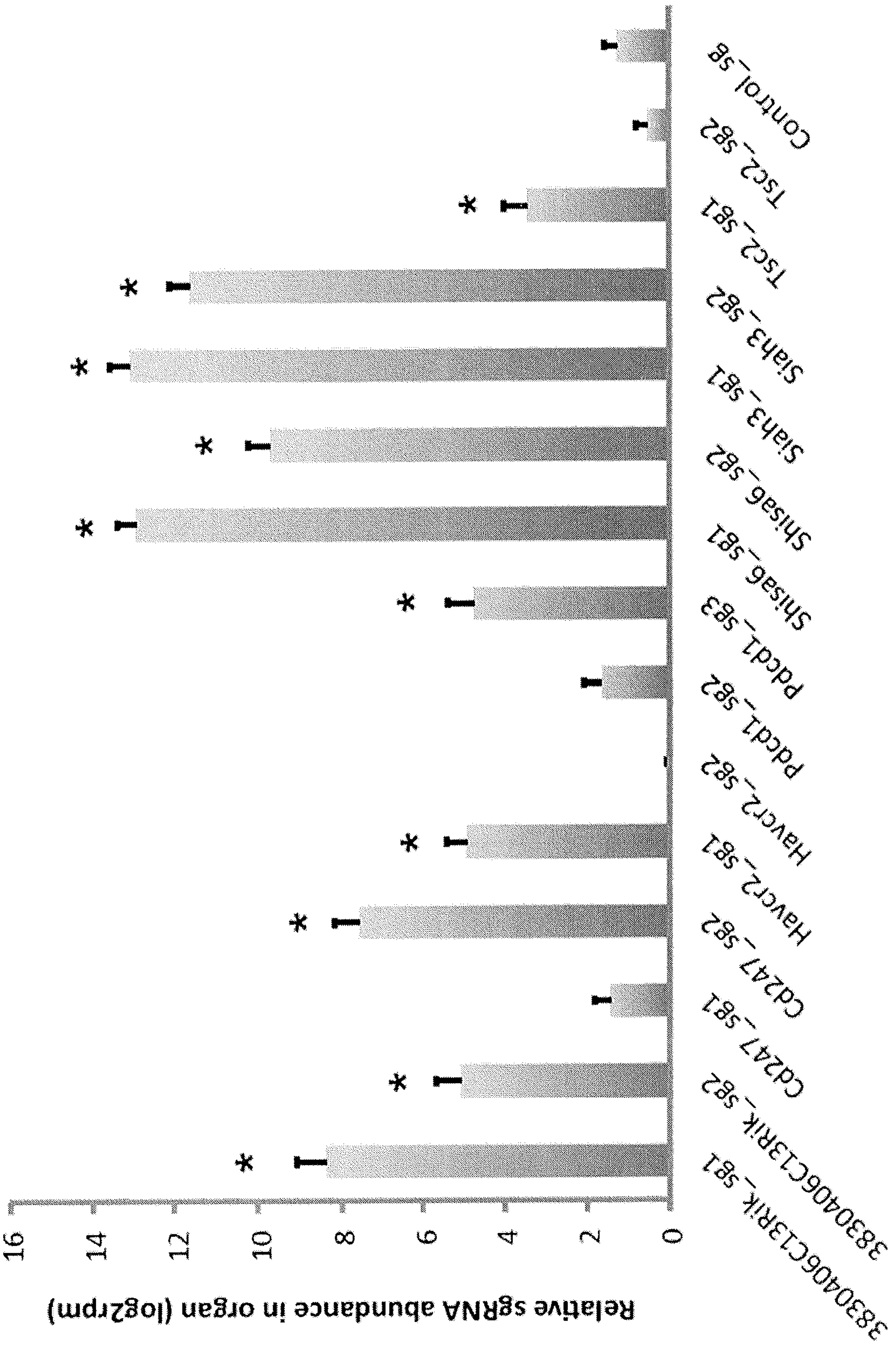

Example 4: Significantly Enriched sgRNAs Targeted Immune Genes and Genes with Diverse Functions To identify genes whose perturbation might result in enhanced ability of $CD8^+$ $T_{eff}$ cell to survive in differential organs in vivo, the sgRNAs and genes represented in the MKO library were ranked using multiple statistical metrics. By comparing the set of enriched sgRNAs between organs, it was discovered that lymphoid organs significantly overlapped with non-lymphoid organs (hypergeometric test, $p\approx0$) (FIG. 17A), although there are substantial sets of sgRNAs unique to each organ type (FIG. 17A), reflected by the set of significantly differentially enriched sgRNAs in lymphoid compared to non-lymphoid organs. Among lymphoid organs, LNs and spleen also significantly overlapped ($p\approx0$) (FIG. 17A). Within non-lymphoid organs, the set of all significant sgRNAs in each of the five organs (brain, liver, lung, muscle and pancreas) significantly overlapped with each other ($p<1\times10^{-5}$ for all pairwise comparisons) (FIG. 17B). Ranking sgRNAs by their prevalence (frequency of being enriched in an organ) (FIG. 1I), or by their overall average abundance in organs as compared to cells (FIG. 8E), revealed dominant signatures of three types of genes: (1) immune genes (such as Lexm/BC055111, Socs5, Zap70), consistent with their role in T cells; (2) genes regulating general cell growth and proliferation (e.g. tumor suppressor genes such as Tsc2, Nf1, Aim1, Pten, and Trp53); as well as (3) genes with undocumented functions in $CD8^+$ T cells or largely uncharacterized genes (such as Sgk3, Fam103a, Phf21a, and 1110057K04Rik) (FIG. 2C, FIG. 8E, FIG. 1I). Ranking sgRNAs by the number of independent enriched sgRNAs also revealed these three types of genes, with the top three genes representing three different categories (Cd247—immune, Tsc2—growth, and Bpifb3—unknown) (FIG. 1J). In conjunction with a third criteria, in which a given sgRNA must comprise≥2% of the reads in a single sample, a total of 11 genes are significantly enriched across all three criteria, again representing immune (Pdcd1, Cd247), growth (Apc, Nf1, Tsc2) and unknown (Csnk1a1, Fam103a1, Fam134b, Phf21a, Prkar1a, and Rab11b) genes (FIG. 1K). Pdcd1, also known as PD-1, is a well-established immune checkpoint regulator expressed on T cells, and a major target of checkpoint blockade. The fact that Pdcd1 passed all three criteria and emerged as a robust hit provided strong evidence for the validity of this approach. Many of the significantly enriched genes are membrane proteins involved in the immune system. Minipool validation experiments were performed, and as a result, 10/14 sgRNAs (71.4%), covering all 7/7 genes (100%), were validated in the in vivo minipool survival experiment. Specific gene-targeting sgRNAs were more abundant as compared to NTC in organs, including those targeting 3830406C13Rik, Cd247, Havcr2, PD-1, Shisa6, Siah3 and Tsc2 (FIG. 17C). Together, these data suggest that perturbation of these genes by CRISPR allows $CD8^+$ $T_{eff}$ cells to better survive in lymphoid and non-lymphoid organs in vivo.

Figure 18A:
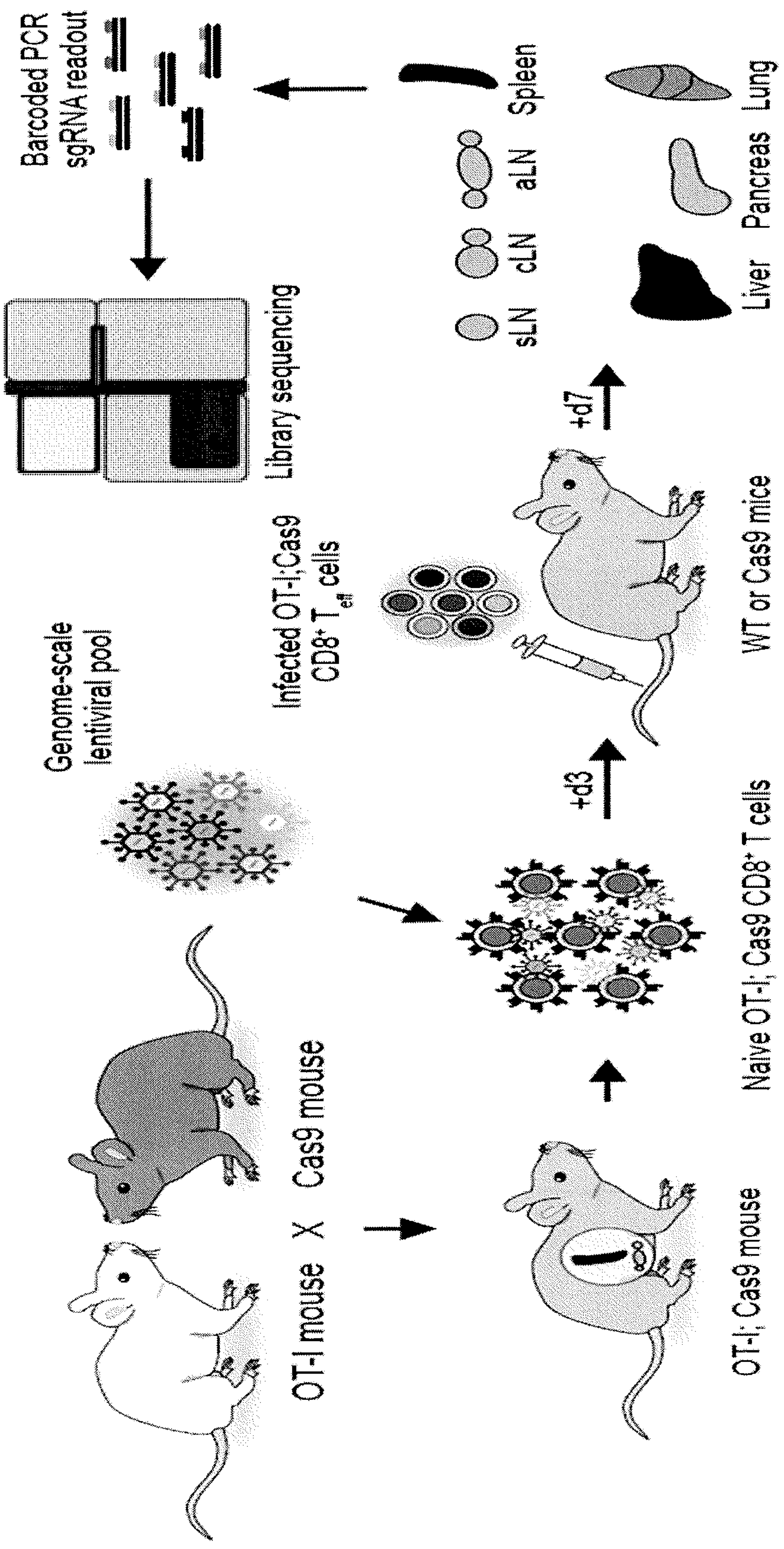
FIGS. 18A-18G are a series of plots and images illustrating a genome-scale screen for trafficking and survival with effector CD8+ T cells with transgenic, clonal TCR.
Figure 19A:
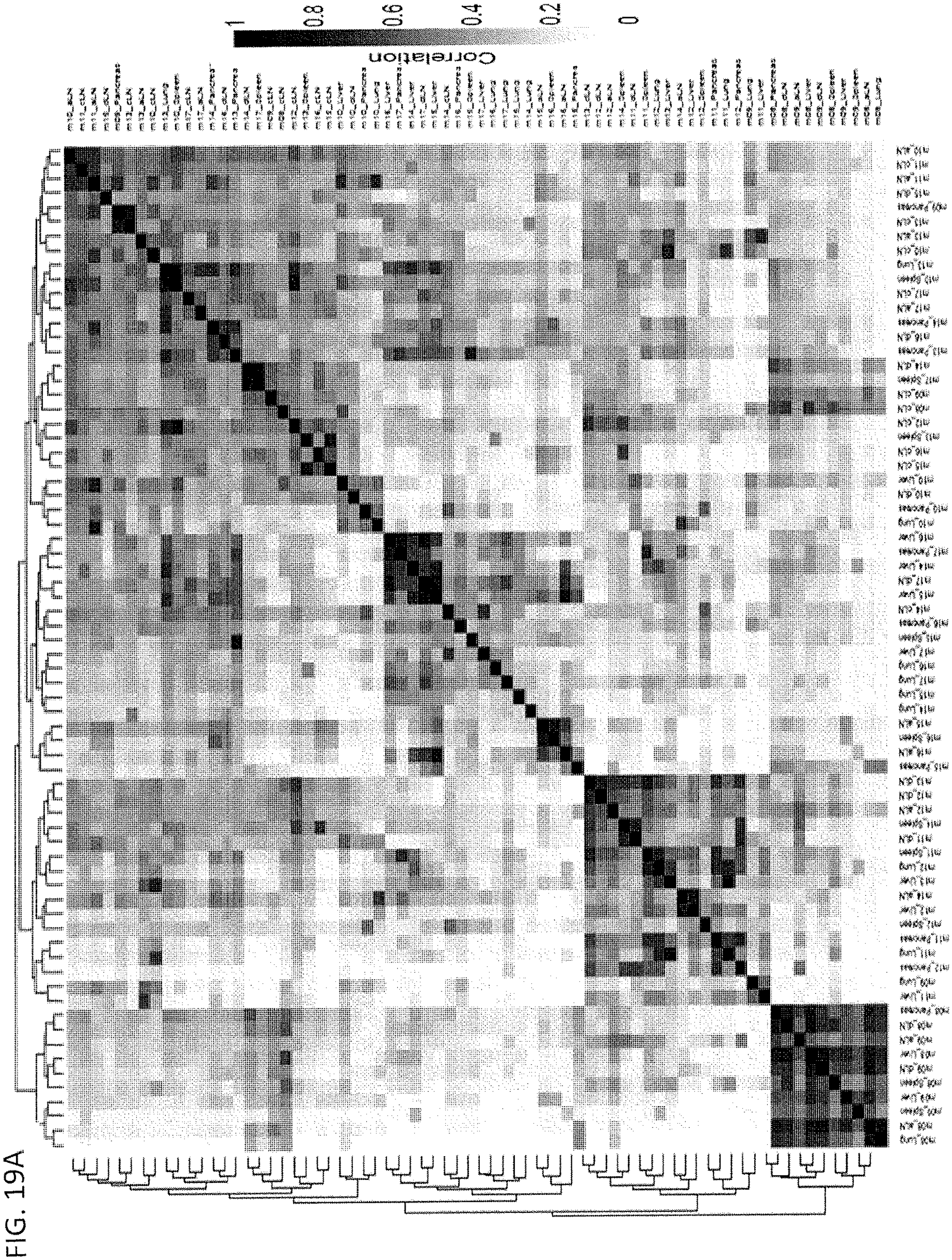
FIGS. 19A-19B are a set of plots illustrating analysis of genome-scale CRISPR CD8+ T cell survival screens with OT-I; Cas9 CD8+ T cells.
Figure 19B:
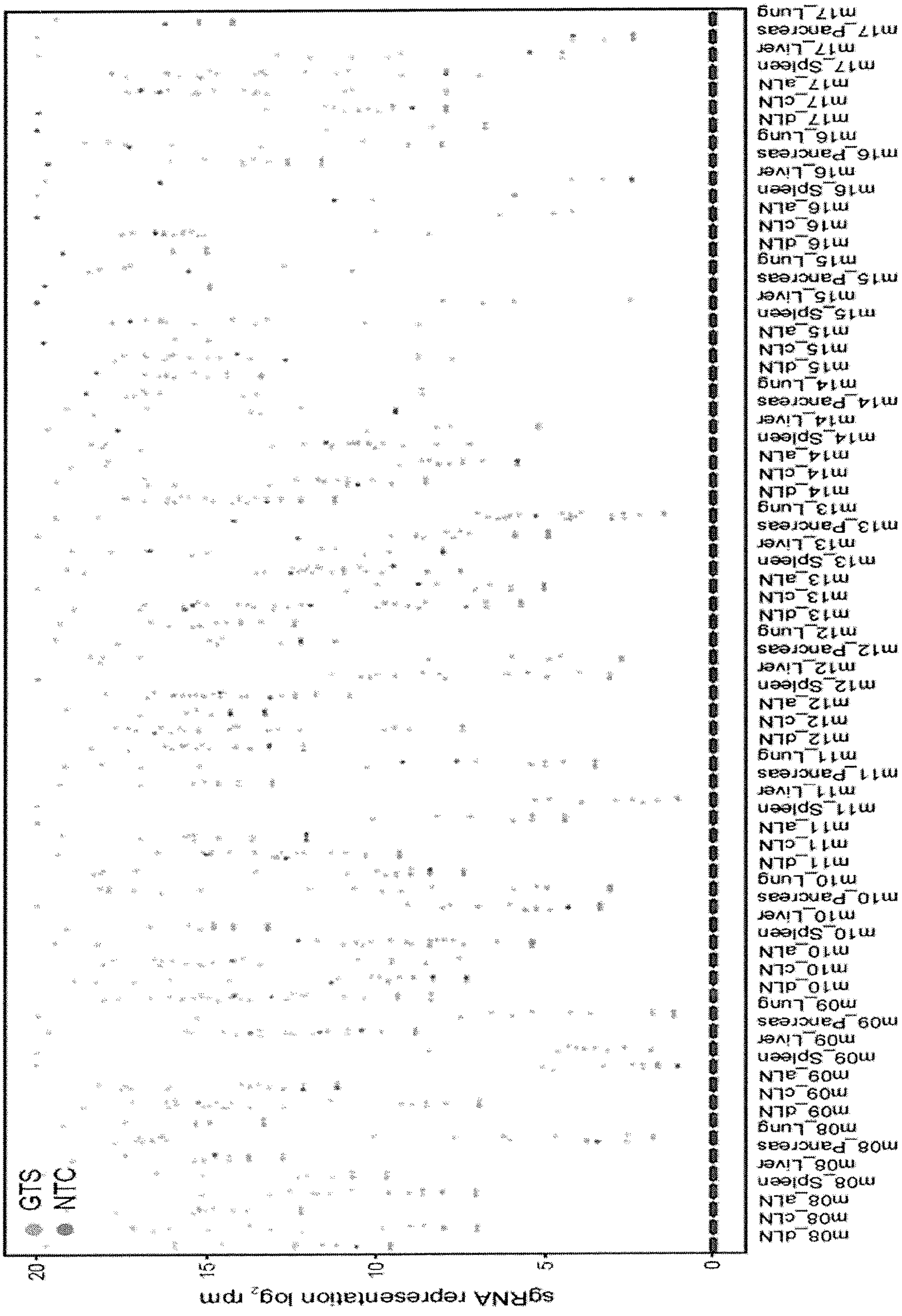

Example 5: Genome-Scale Screen for Trafficking and Survival with Effector $CD8^+$ T Cells with Transgenic, Clonal TCR Due to the diversity of the TCR repertoire in Cas9 mice, certain genetic effects may be masked by the heterogeneity of the TCR pool. To address this issue and thereby provide a parallel picture in an isogenic setting, the genome-scale CRISPR screen was repeated with a homogenous pool of $CD8^+$ $T_{eff}$ cells that expressed the transgenic OT-I TCR, which specifically recognizes the SIINFEKL peptide of chicken ovalbumin (cOVA) presented on $H\text{-}2K^b$, a haplotype of MHC-I. Through genetic crosses, a mouse strain (OT-I; Cas9 mice) was generated that expresses both Cas9 and the OT-I transgenic TCRs (FIG. 18A). With these mice, the aim was to identify genes whose perturbation might result in enhanced ability of $T_{eff}$ cells to survive in different organs in vivo following trafficking starting from clonal TCRs. Similarly, naive OT-I; Cas9 $CD8^+$ T cells were isolated, the MKO lentiviral library introduced with 3 infection replicates, and adoptively transferred into wildtype B6 (n=5) or Cas9 (n=5) recipient mice (n=10 total) (FIG. 18A). Seven days post adoptive transfer, the mice were euthanized and relevant lymphoid and non-lymphoid organs collected. Illumina sequencing was performed to readout the sgRNA library representation. The sgRNA library representation revealed a global landscape of organ survival for mutant $T_{eff}$ cells with clonal TCR in vivo (FIGS. 19A-19B).

Figure 18C:
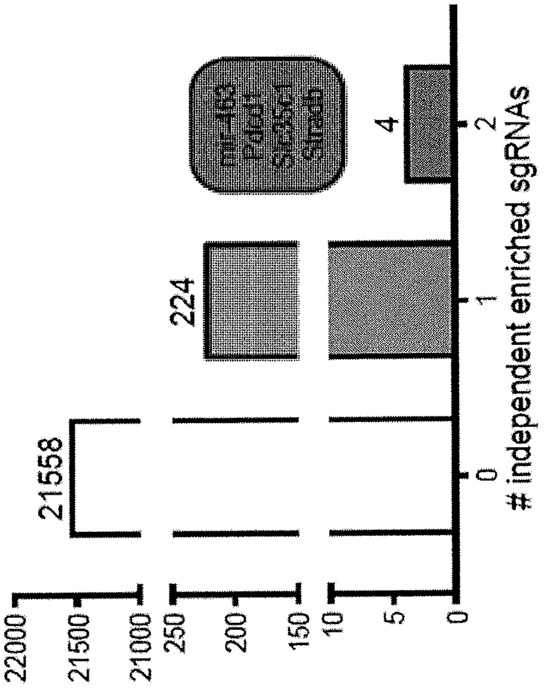
Figure 18D:
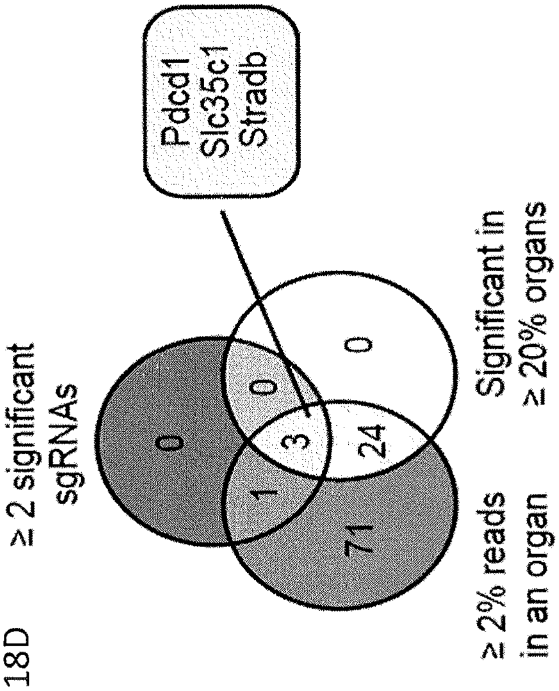
Figure 18B:
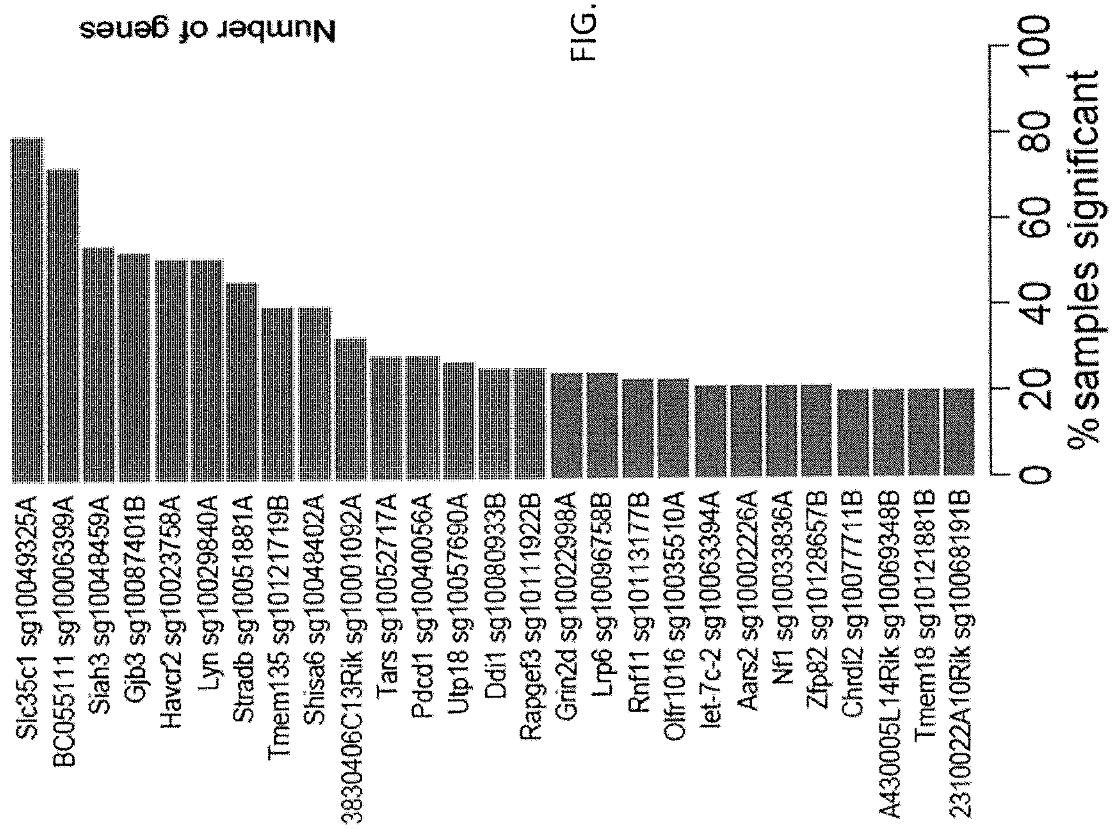
Figure 18F:
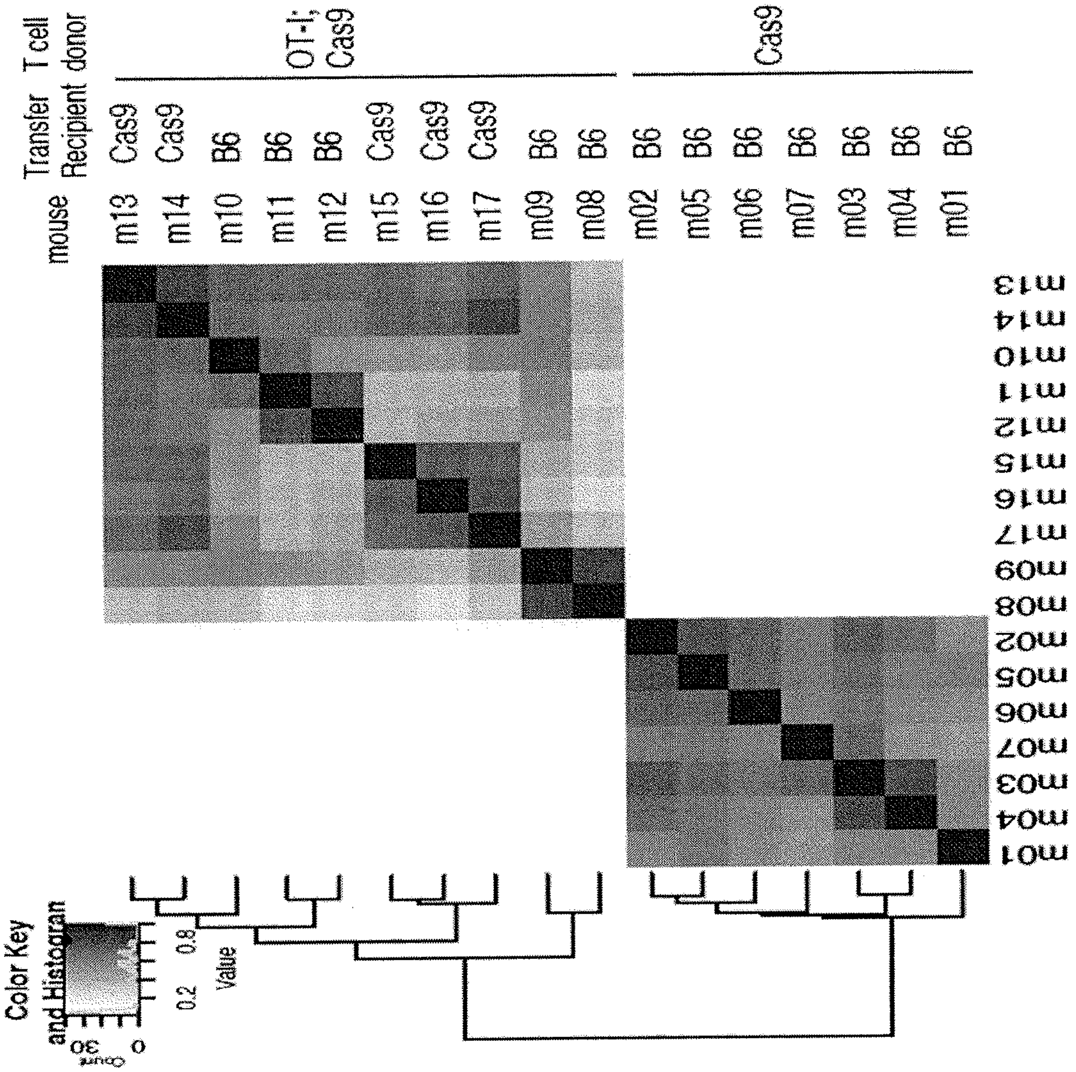

To identify genes modulating trafficking and survival of OT-I; Cas9 $CD8^+$ $T_{eff}$ cells, sgRNAs and genes represented in the MKO library were ranked using multiple statistical metrics. Ranking sgRNAs by their prevalence (frequency of being enriched in an organ) (FIG. 2*b*) again revealed dominant signatures of three types of genes: (1) immune genes (e.g. BC055111, Hacvr2, Lyn and Pdcd1); (2) growth regulators (e.g. Nf1), although fewer compared to the previous screen; as well as (3) genes with undocumented functions in $CD8^+$ T cells or largely uncharacterized genes (e.g. Slc35c1, Siah3, Gjb3, Tmem135 and Shisa6) (FIG. 18B). Havcr2, also known as Tim-3, is a well-established immune checkpoint regulator expressed on T cells, and currently an active target for immunomodulation. Ranking sgRNAs by the number of independent enriched sgRNAs revealed 4 genes with multiple enriched sgRNAs (mir-463, Pdcd1, Slc35c1, and Stradb) (FIG. 18C). In conjunction with the sgRNA abundance criteria (≥2% of total reads in a sample) a total of 3 genes are significantly enriched across all three criteria (Pdcd1, Slc35c1, and Stradb) (FIG. 18D). These data together suggest that the CRISPR targeting of these genes allows TCR-clonal OT-I; $CD8^+$ $T_{eff}$ cells to better survive in lymphoid and non-lymphoid organs in vivo.

Figure 16C:
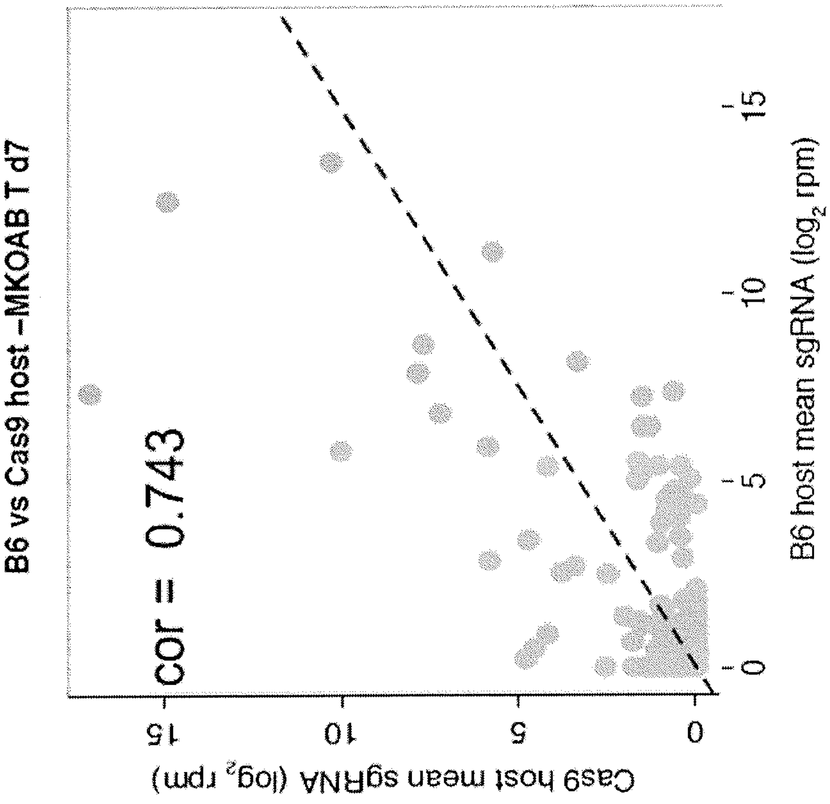
Figure 16D:
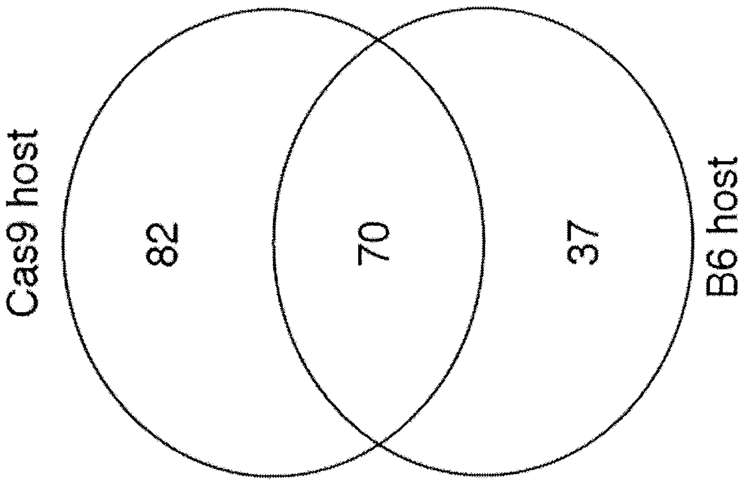
Figure 18E:
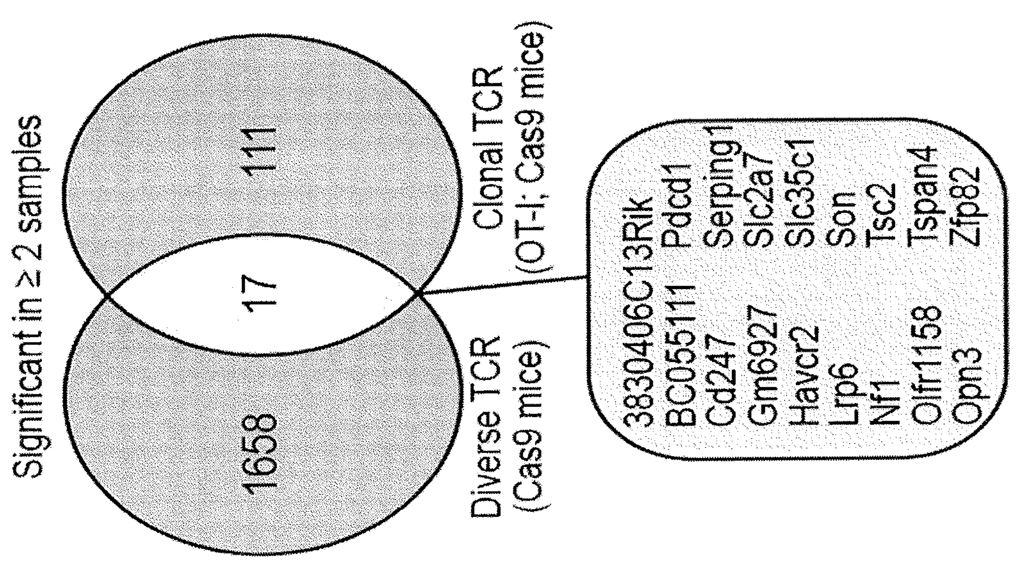
Figure 20B:
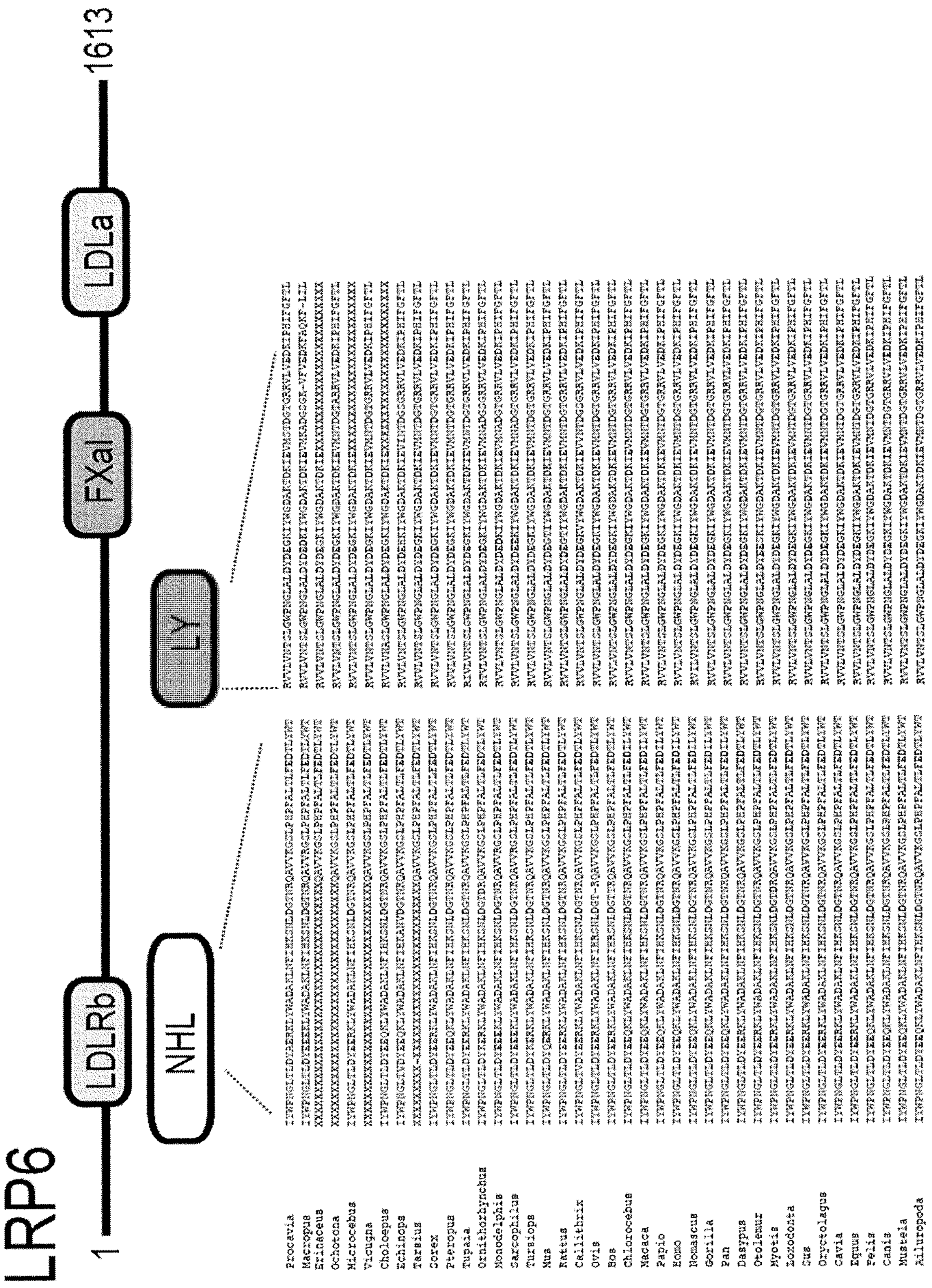

An integrated analysis was performed using both screens with diverse TCR and clonal TCR settings as a whole. To find which candidate genes can modulate T cell function in both diverse (Cas9 $CD8^+$ T cells) and clonal TCR (OT-I; Cas9 $CD8^+$ T cells), the gene sets from these two screens were directly compared. A total of 17 genes were identified in both screen as common hits (FIG. 18E), which again included immune genes (BC055111, Cd247, Hacvr2, and Pdcd1), tumor suppressors (Nf1 and Tsc2), and unknown or uncharacterized genes in T cells (e.g. Gm6927, Slc35c1, Slc2a7, Lrp6, and 4.82). Several of these shared hits encode highly conserved surface proteins, which are either well-established immune regulators/immunotherapy targets (Cd247, Hacvr2, Pdcd1), or are potentially directly targetable with monoclonal antibodies (Slc35c1, Slc2a7, Lrp6). These proteins have highly conserved functional domains across multiple mammalian species (FIGS. 20A-20C). Between the two recipient hosts, C57BL/6 or Cas9 syngeneic, the overall sgRNA representations significantly correlated with each other (FIG. 16C), and screens in both share a large set of hits (p<1e5) (FIG. 16D). Thus, in this case, host choice did not affect the result of the in vivo survival screen.

Figure 18G:
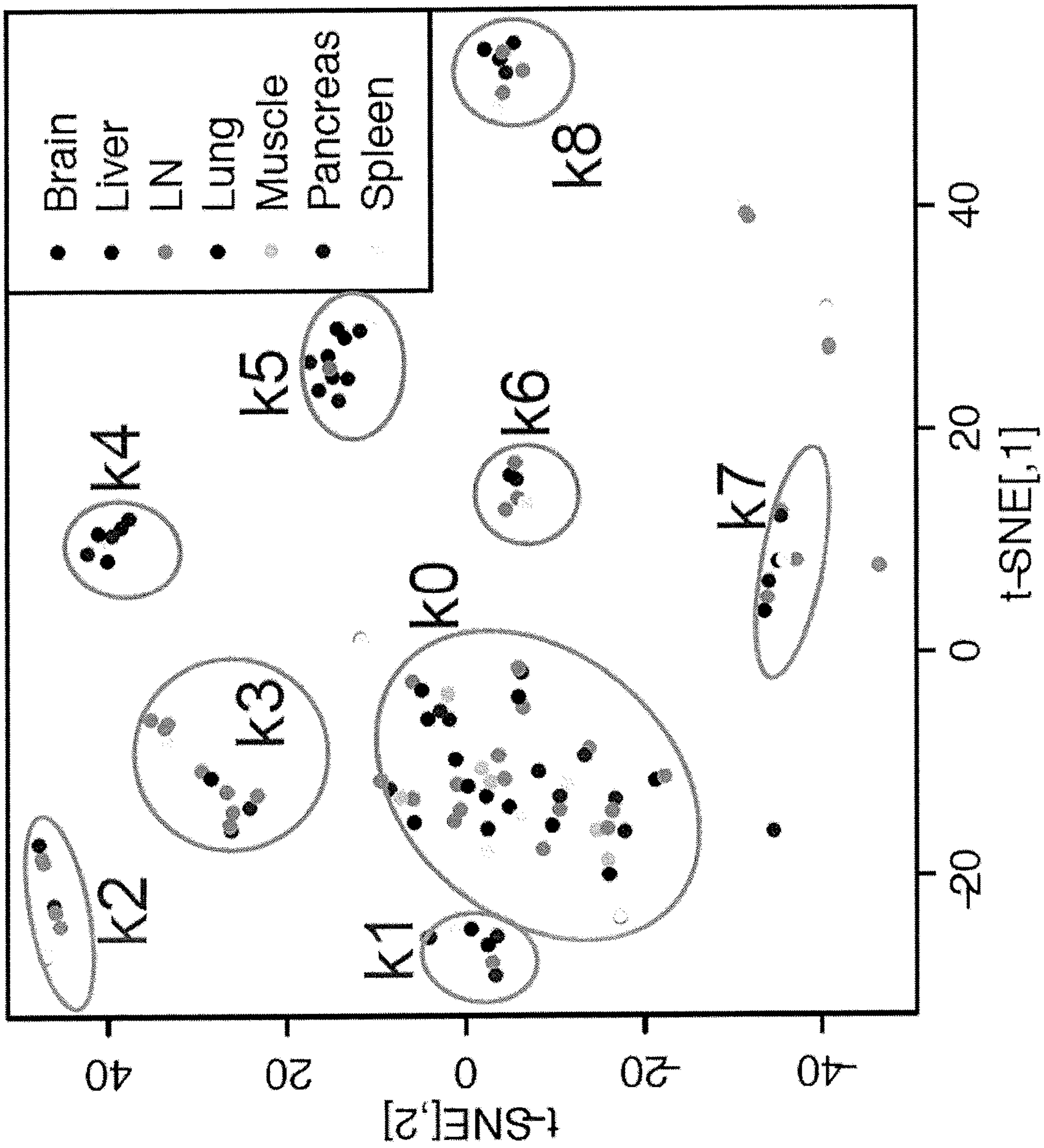

Using dimension reduction methods such as t-SNE, clustering patterns of samples were observed purely based on the sgRNA representations in the tissue-infiltrated T cell population (FIG. 18G). There was a large cluster (k0) containing virtually all organ types (including brain, liver, LN, lung, muscle, pancreas and spleen), while there were 8 smaller clusters (k1-k8) that each consisted of 4 to 6 organ types, with several organs as outliers (FIG. 18G). The emergence of multiple immune genes as mutual top hits, in both diverse TCR and clonal TCR settings, further validated the rigor of this approach, gaining higher confidence for the phenotypes of the unknown genes or those previously not associated with T cell function.

Figure 3A:
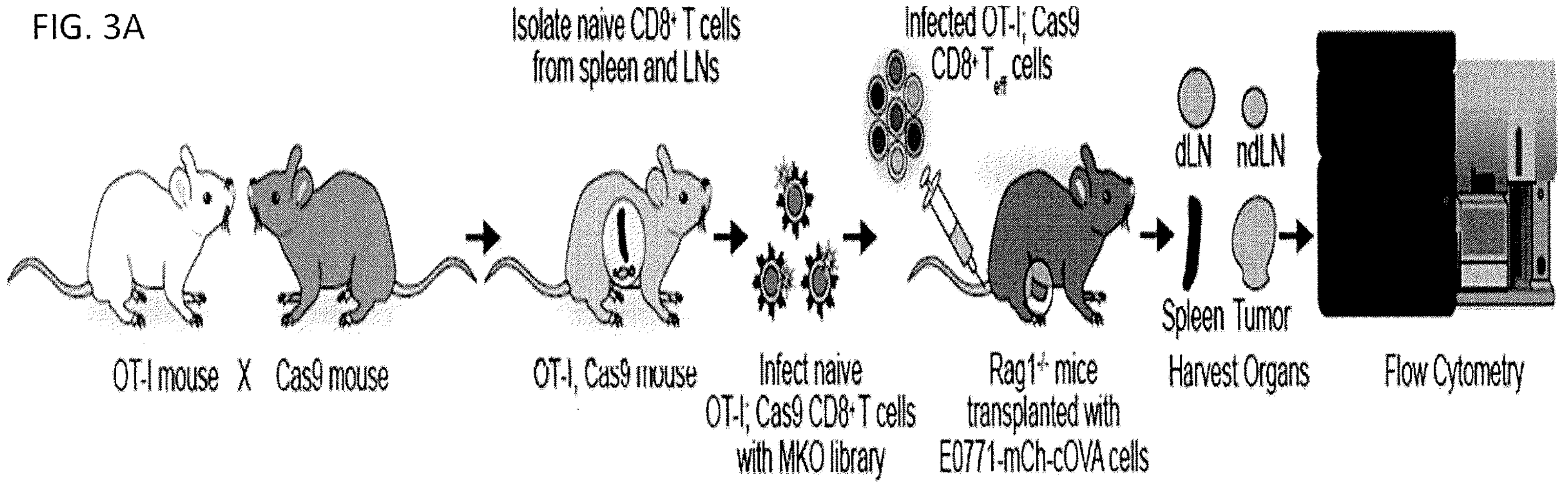
FIGS. 3A-3F are a series of plots and images illustrating flow cytometry analysis of in vivo survival of MKO mutagenized OT-I; Cas9 $CD8^+$ $T_{eff}$ cells in $Rag1^{-/-}$ mice with transplanted tumors expressing cOVA antigen.
Figure 3B:
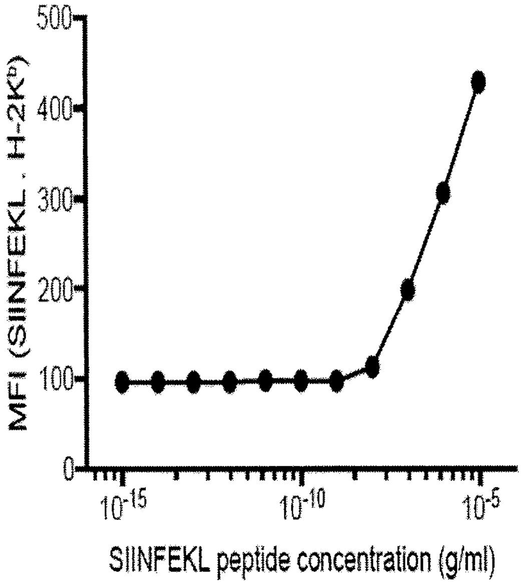
Figure 3C:
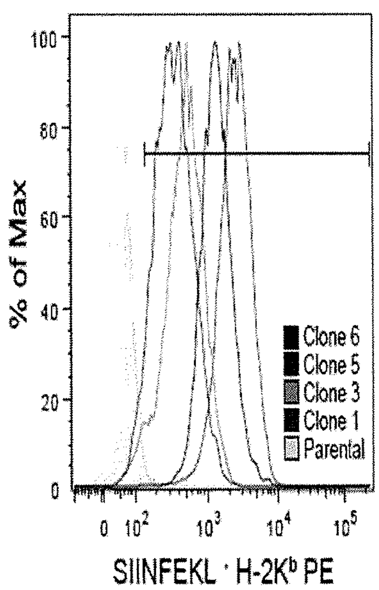

Example 6: In Vivo Genome-Scale Analysis of TCR-Engineered Effector $T_{eff}$ Cells in Mice with Tumors Expressing a Model Antigen In order to analyze in vivo $CD8^+$ $T_{eff}$ cell trafficking and survival in the context of antigen-recognition, an engineered TCR that specifically recognized a well-characterized model antigen, chicken ovalbumin (cOVA), was utilized. Through genetic crosses, a mouse strain (OT-I; Cas9 mice) was generated that expresses both Cas9 and the OT-I transgenic TCRs specific for an 8 amino acid peptide epitope (SIINFEKL) (SEQ ID NO: 129,210) of cOVA (FIGS. 3A and 10A-10F). Breast cancer cell line E0771 was pulsed with various concentrations of SIINFEKL peptides, and a dose-dependent antigen presentation on cell surface by MHC-I was observed using immunostaining for the peptide-protein complex (FIG. 3B). Clonal cell lines that present cOVA were generated, and it was confirmed that the antigenic SIINFEKL peptide was presented on surface $H\text{-}2K^b$, the haplotype of MHC-I recognized by OT-I TCR (FIG. 3C). Clone 3 of E0771-mCherry-cOVA (E0771-mCh-cOVA for short) cell lines presented SIINFEKL on $H\text{-}2K^b$ at a level similar to pulsing cells with $1\times10^{-5}$ g/ml peptide, and was chosen for in vivo study. This clonal cell line was transplanted into $Rag1^{-/-}$ mice with $5\times10^6$ cells per mouse, which subsequently grew as tumors within 10 days (FIGS. 3A, 3D, 10A, and 10F).

Figure 3D:
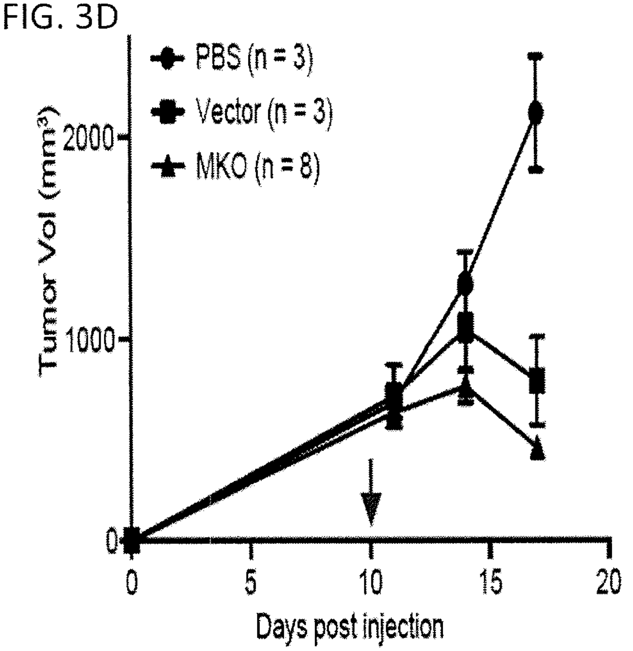
Figure 3E:
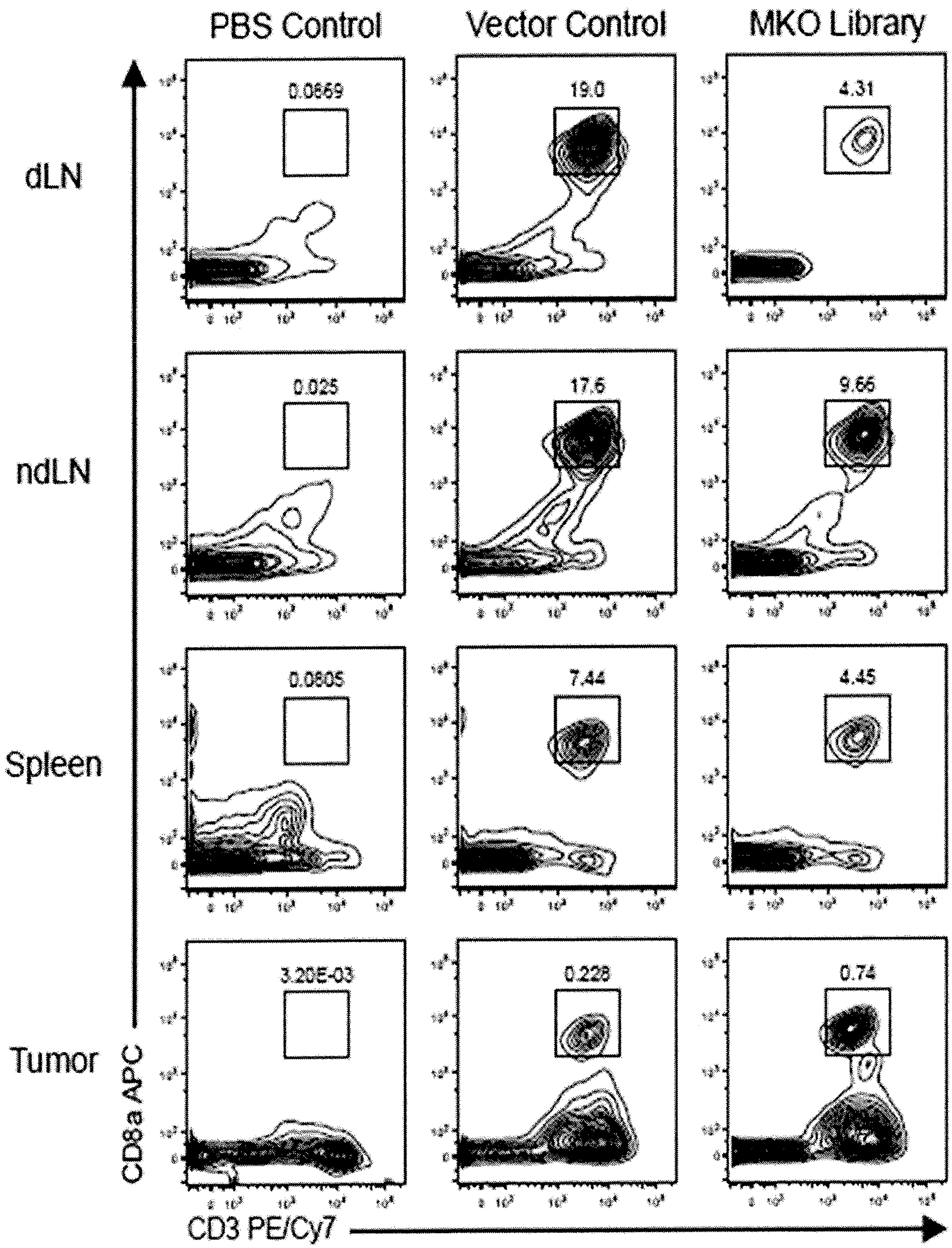
Figure 3F:
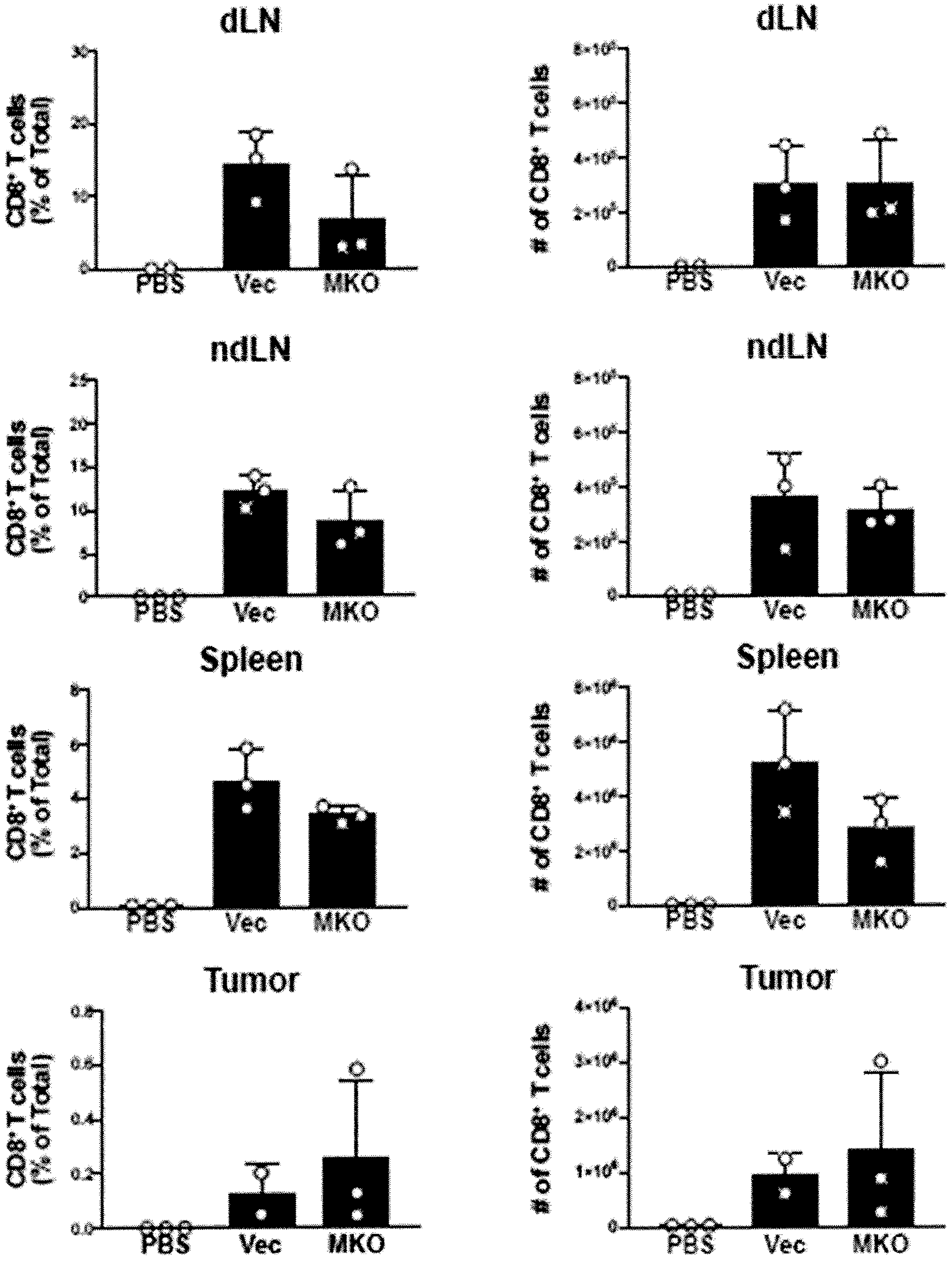
Figure 4A:
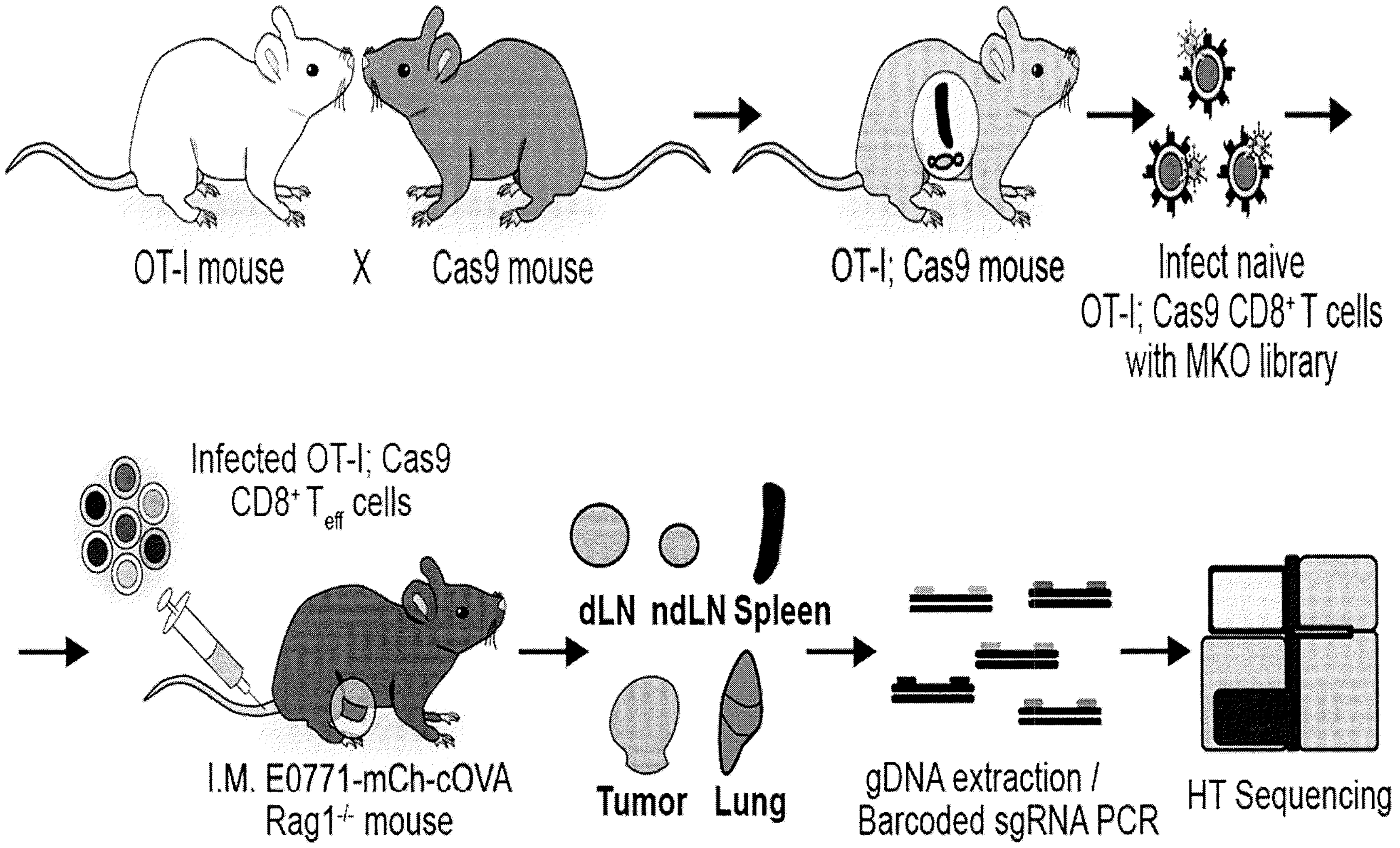
FIGS. 4A-4J are a series of plots and images illustrating sgRNA library sequencing analysis of in vivo survival of MKO mutagenized OT-I; Cas9 $CD8^+$ $T_{eff}$ cells in $Rag1^{-/-}$ mice with transplanted tumors expressing cOVA antigen.
Figure 10A:
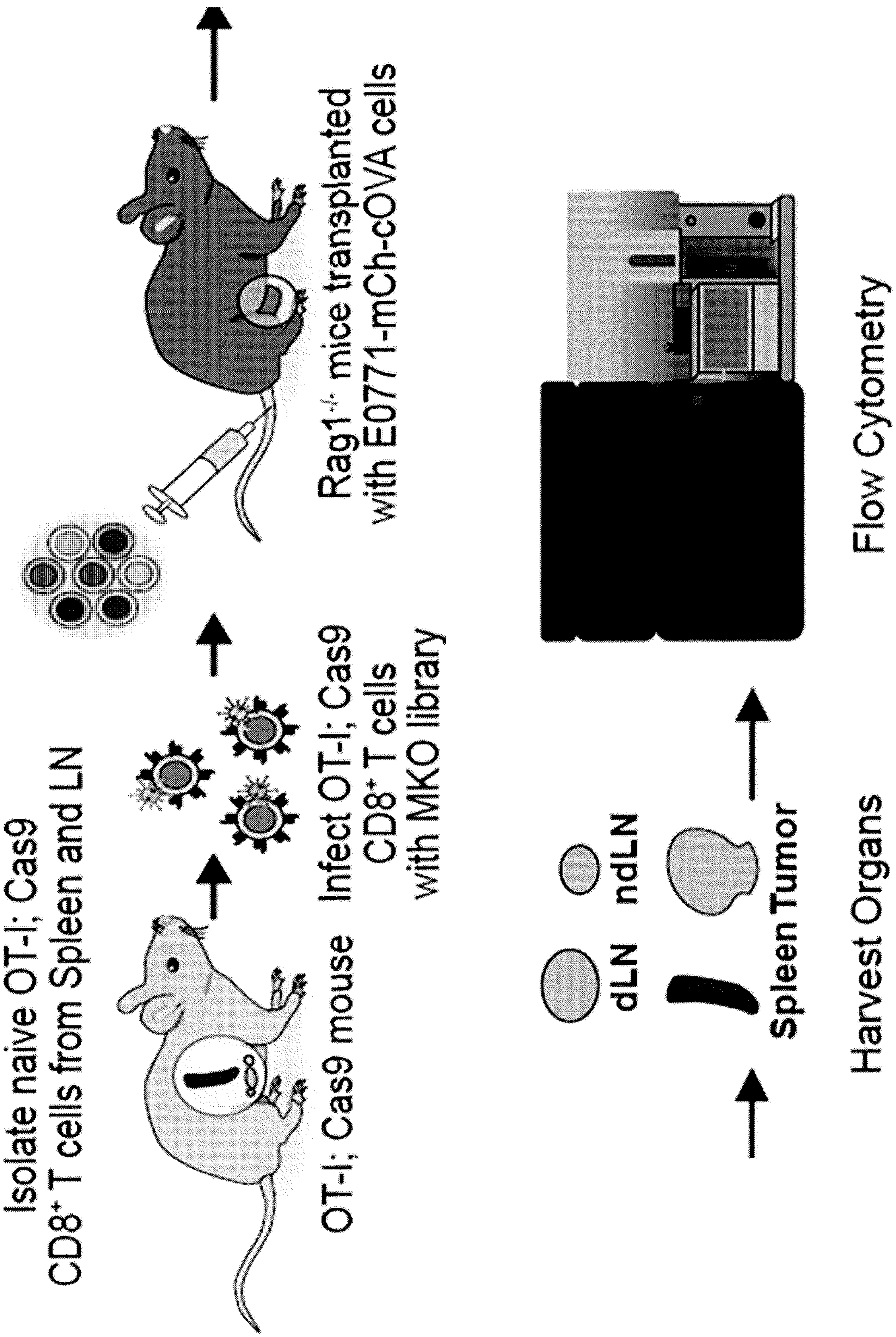
FIGS. 10A-10F are a series of plots and images depicting FACS data for setup experiments of MKO mutagenized activated OT-I; Cas9 $CD8^+$ $T_{eff}$ cells in $Rag1^{-/-}$ mice with transplanted tumors expressing cOVA antigen.
Figure 10B:
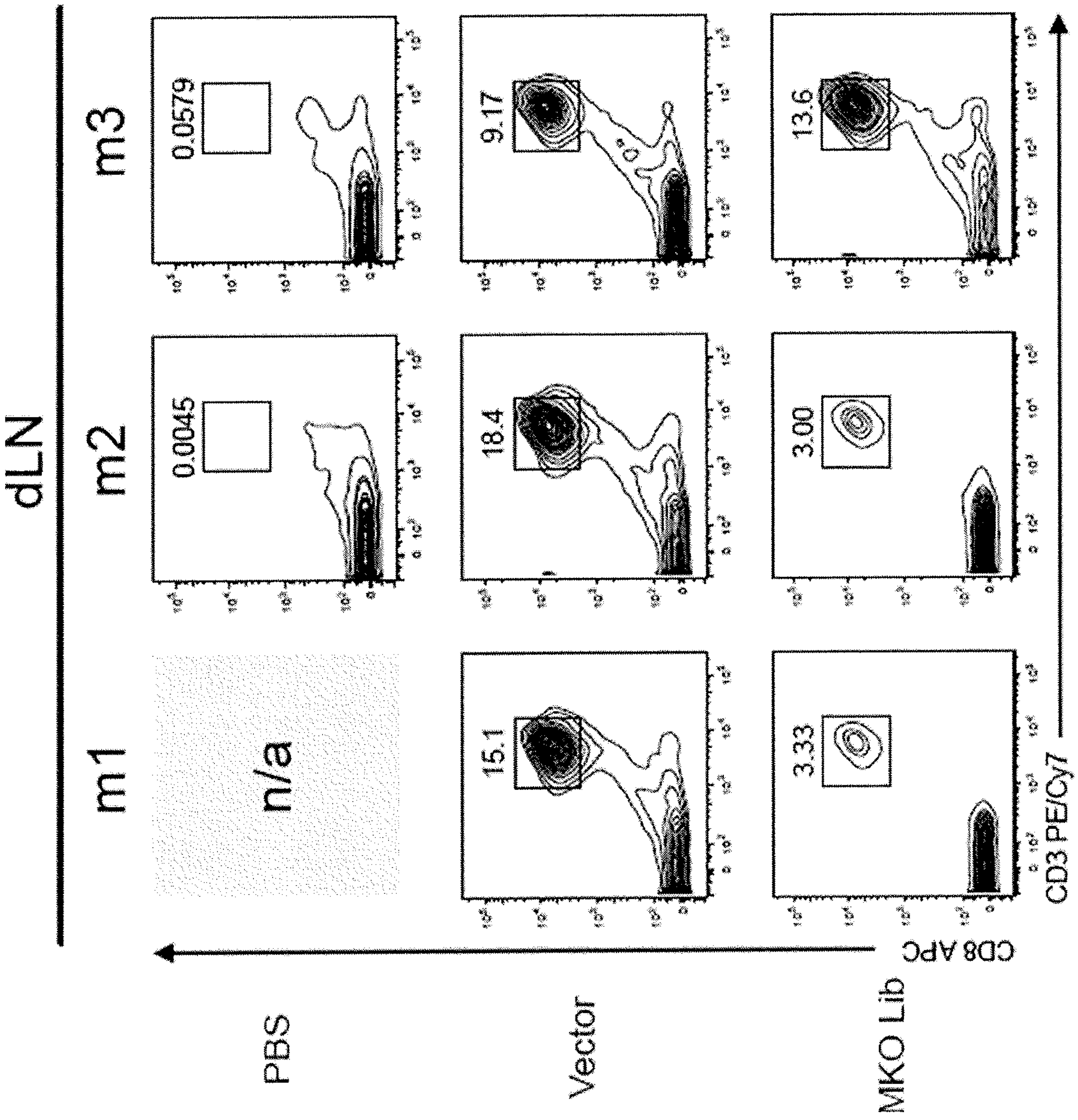
Figure 10C:
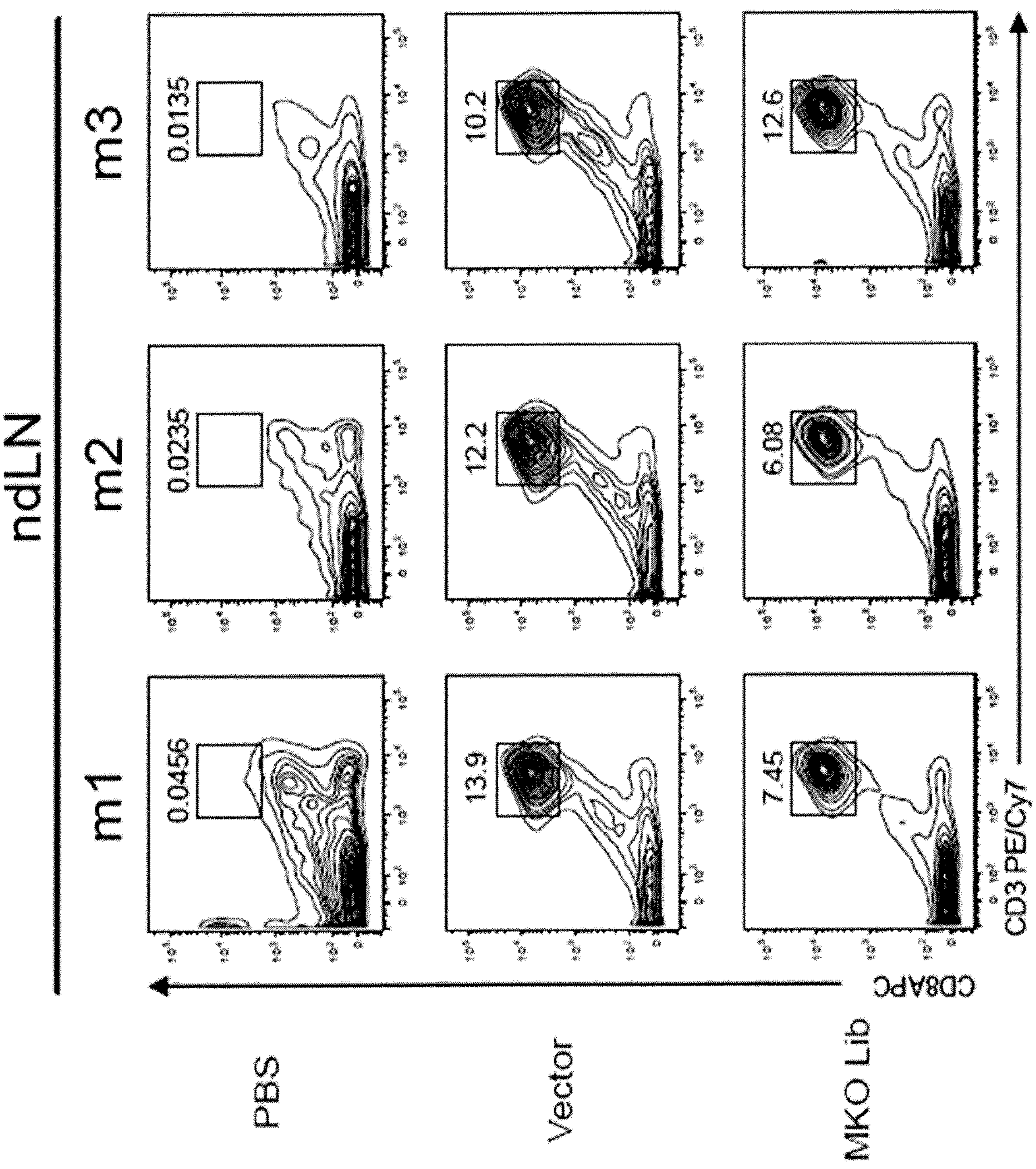
Figure 10D:
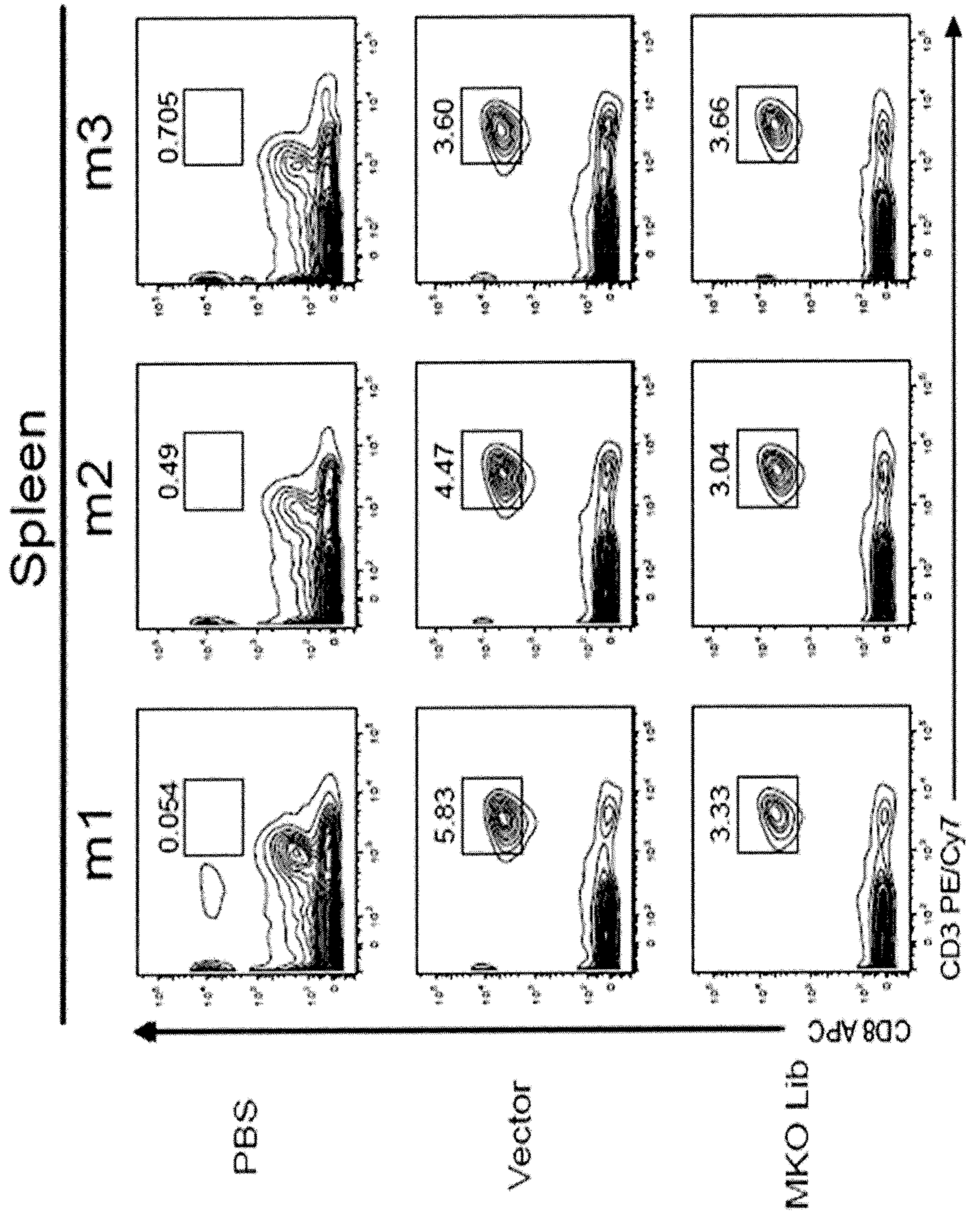
Figure 10E:
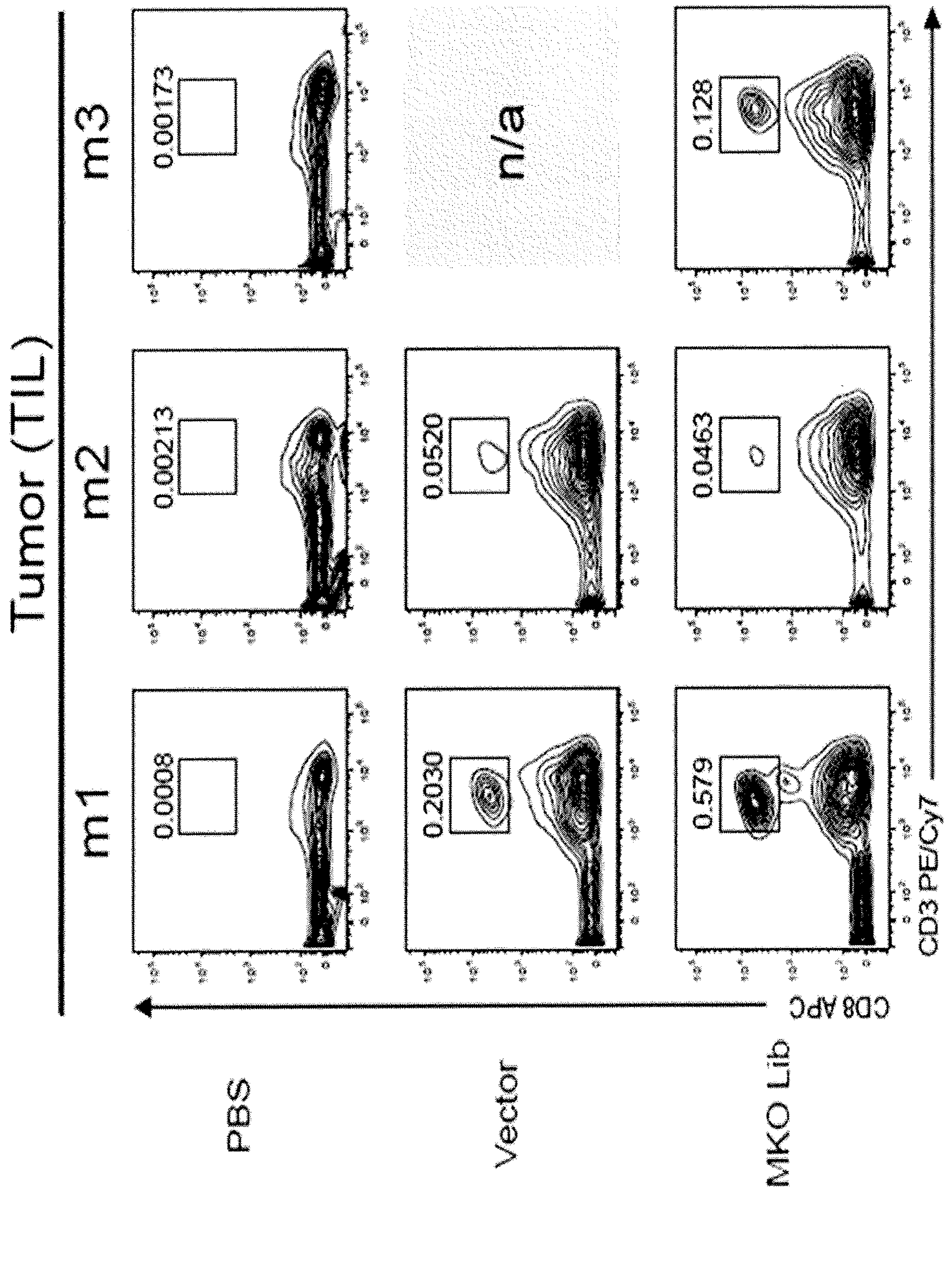
Figure 10F:
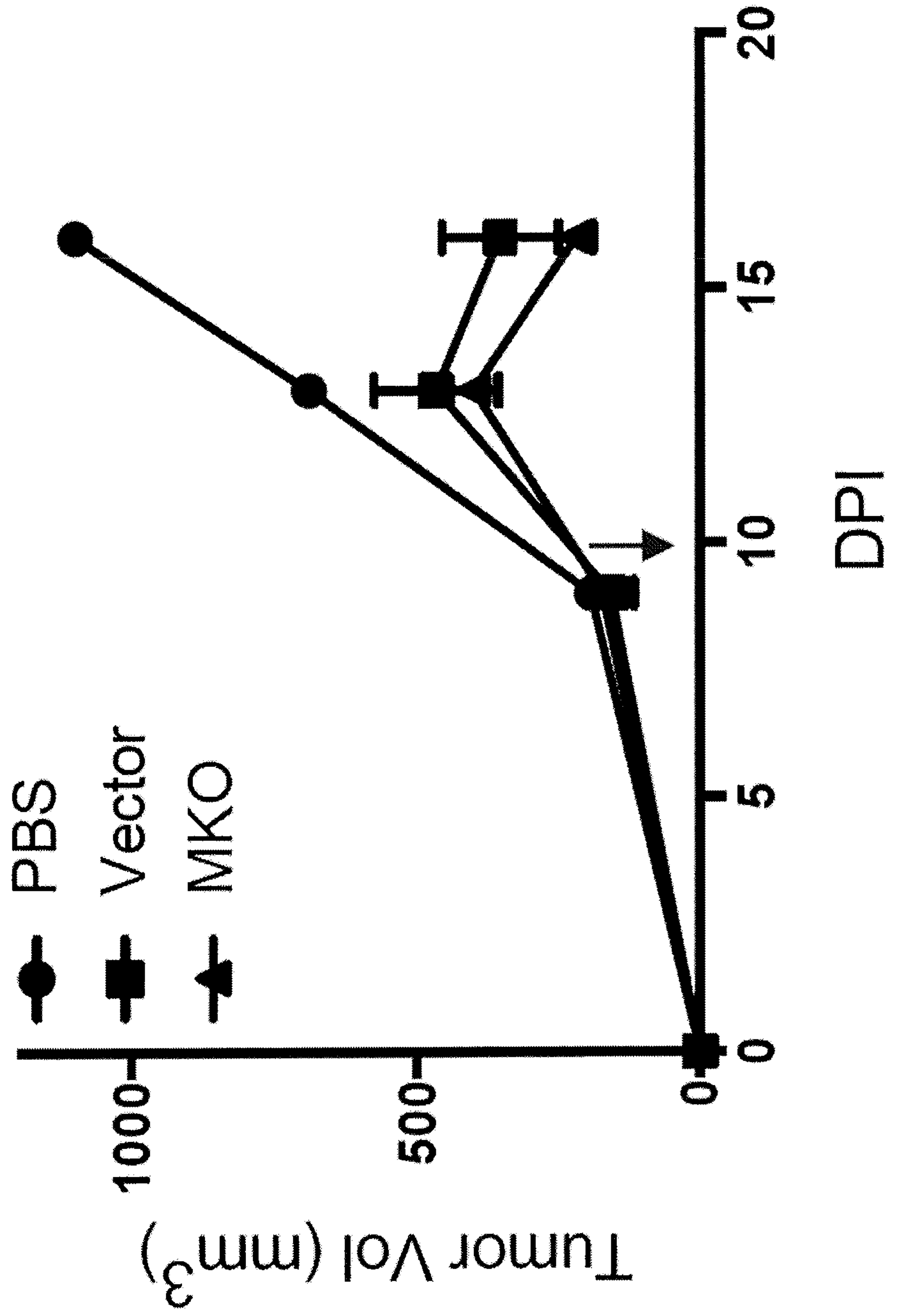
Figure 21A:
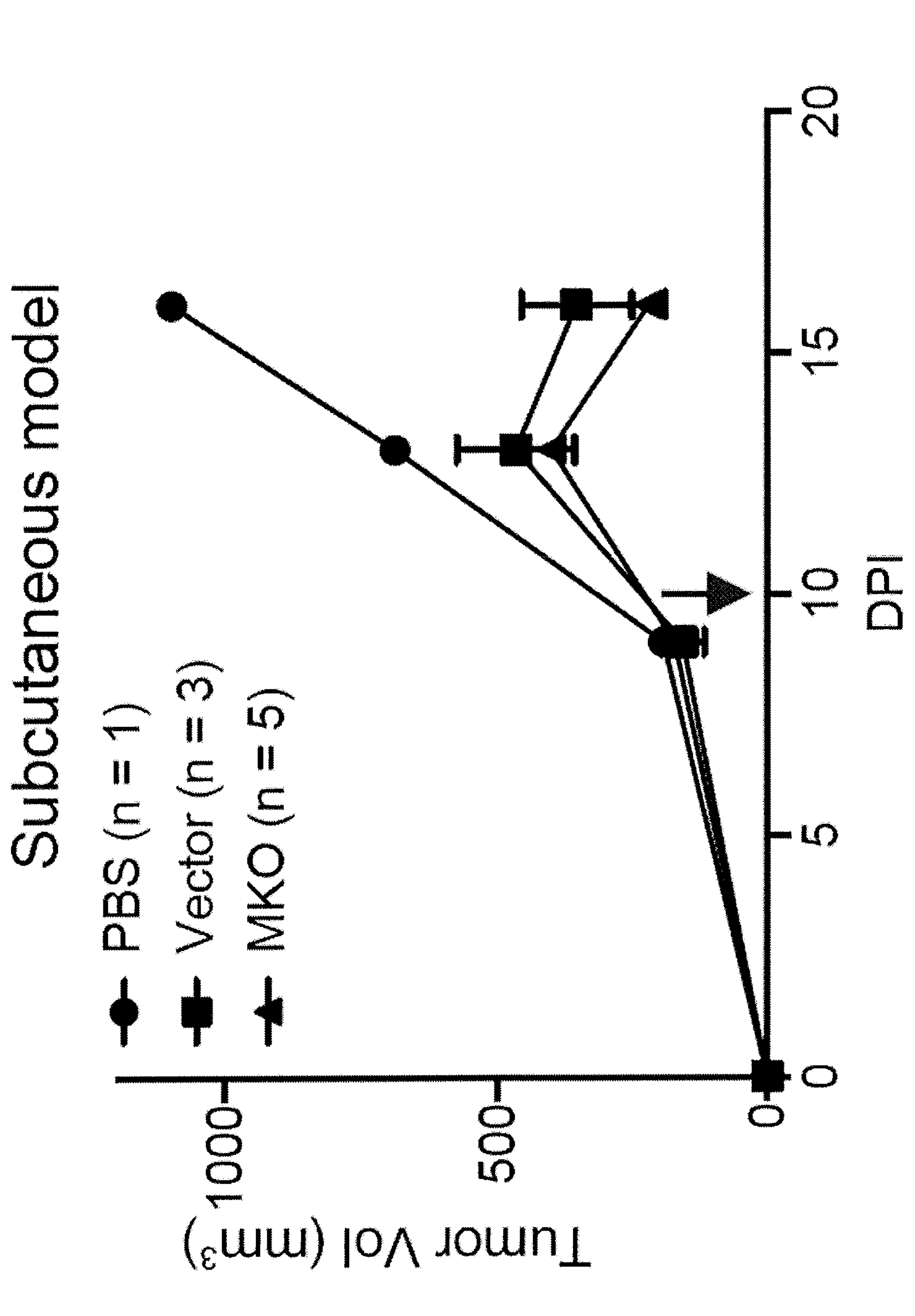
FIGS. 21A-21F are a series of plots and images illustrating additional experiments for adoptive transfer tumor infiltration screen.
Figure 21B:
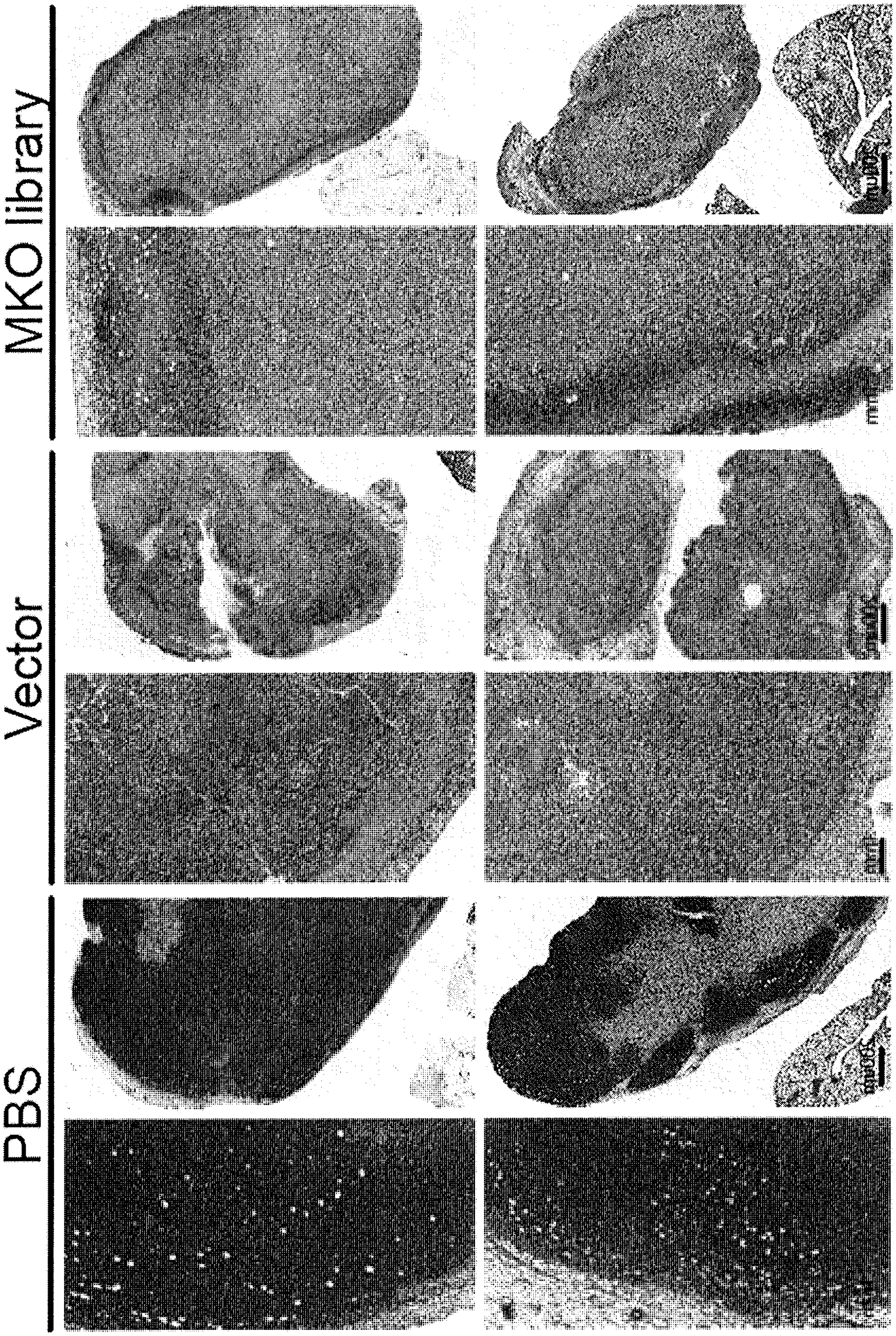
Figure 21C:
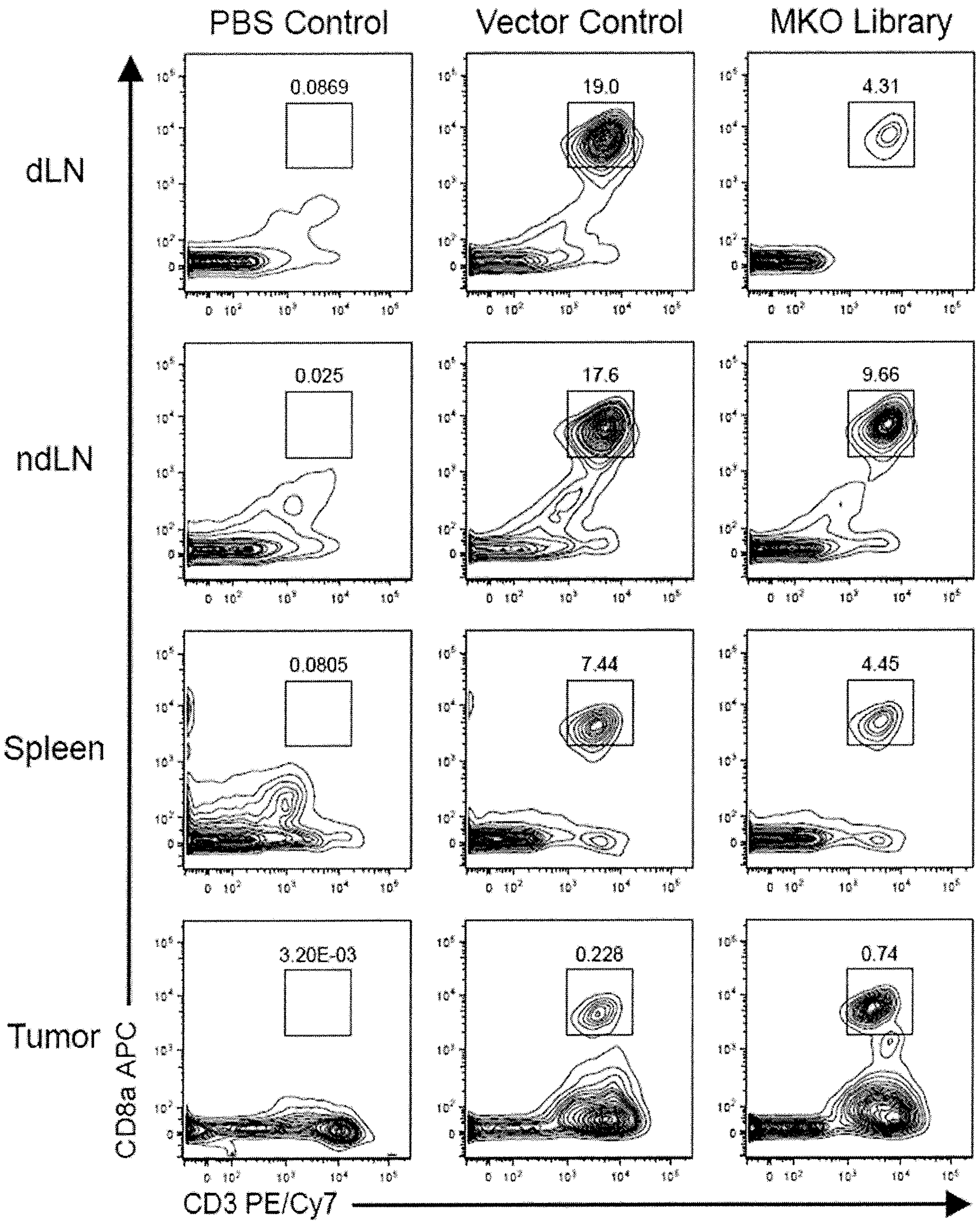
Figure 21D:
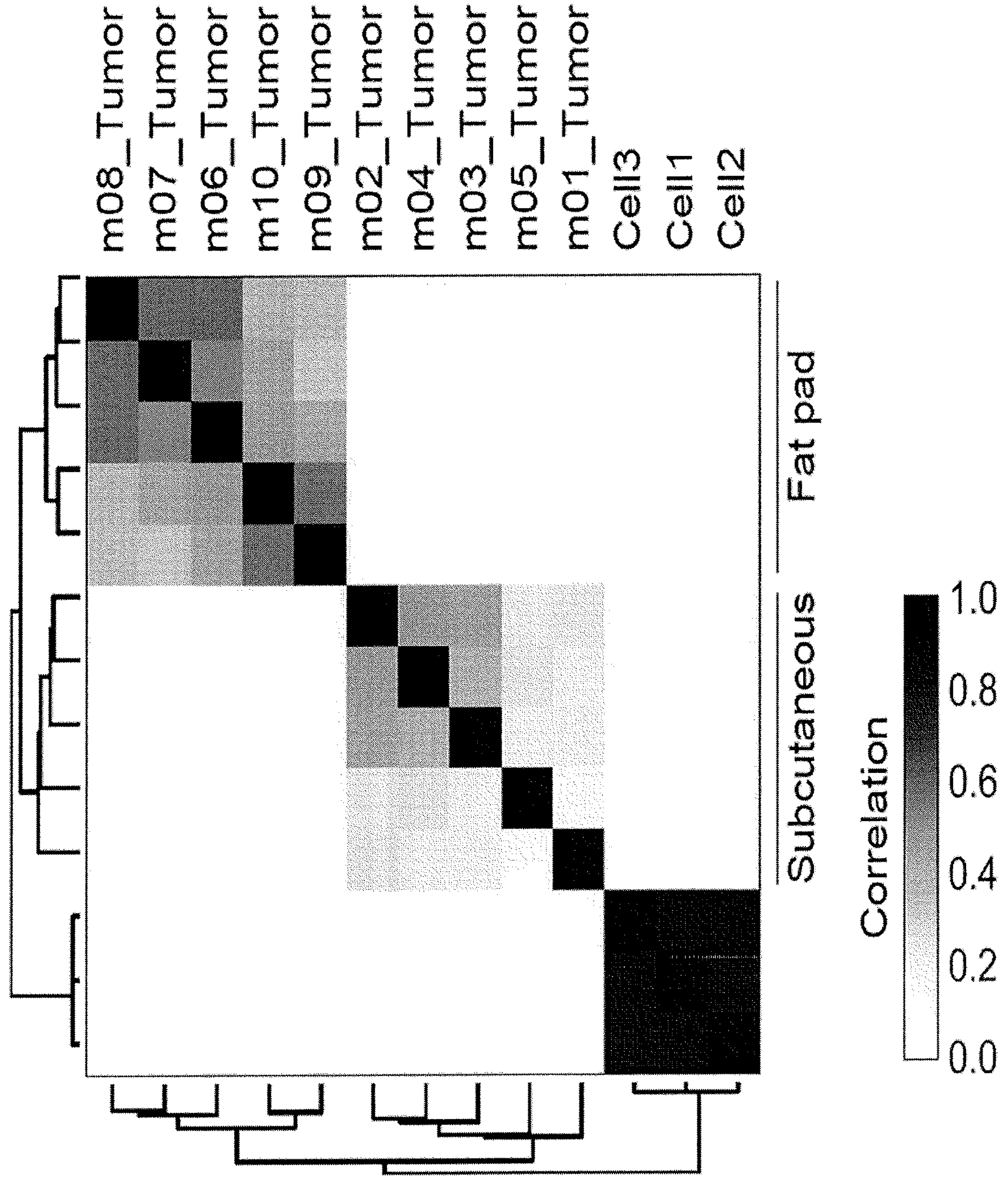

A T cell infiltration screen was performed in a mouse model of cancer. E0771 is a commonly used triple-negative breast cancer cell line that originated from C57BL/6 mice. Of note, although parental E0771 cells grew robustly as transplant tumors in a syngeneic C57BL/6 host (100% transplanted cells grew tumors on mice), all E0771-mCherry-cOVA clones tested were rejected by the same host (0% grew tumors), potentially caused by $CD4^+$/$CD8^+$ T cell mediated immune rejection of the antigenic cOVA. Thus, $5\times10^6$ clone 3 cells were transplanted into immunodeficient $Rag1^{-/-}$ mice, and rapid tumor formation was observed in 10 days (FIG. 3D, FIGS. 21A-21B). Naïve $CD8^+$ T cells were isolated from OT-I; Cas9 mice, mutagenized with the MKO sgRNA library, adoptively transferred $1\times10^7$ into $Rag1^{-/-}$ mice with tumors expressing cOVA antigen, and analyzed for trafficking to different organs and survival in vivo by flow cytometry and sgRNA library sequencing (FIG. 3A, FIG. 10A). Tumor size was measured throughout the experiment and it was discovered that T cell injections (either vector or MKO transduced) mitigated tumor growth, in sharp contrast with PBS (Endpoint tumor size vector vs PBS, unpaired two-sided t-test, p=0.02; MKO vs PBS, p<0.0001) (FIG. 3D). The MKO transduced population had a stronger therapeutic effect compared to vector controls (Endpoint tumor size MKO vs vector, unpaired two-sided t-test, p=0.03) (FIG. 3D). This anti-tumor effect also holds in a subcutaneous transplant model, although to a lesser extent (FIG. 21A). Seven days after adoptive transfer (17 days after cancer cell transplantation), the mice were sacrificed and the tumors, draining lymph nodes (dLNs) near the tumors, non-draining lymph nodes (ndLNs) and the spleens were isolated for analyses of $T_{eff}$ cell trafficking and survival in vivo. The tumors were also analyzed for tumor-infiltrating lymphocytes (TILs). Histological and pathological analysis revealed the existence of lymphocytes in the tumors from mice injected with vector and MKO $CD8^+$ $T_{eff}$ cells, but not in tumors of PBS treated mice (FIG. 21B). Flow cytometric analysis (n=3 mice) of single-cell suspensions of organs and tumors detected a large number of $CD8^+$ $T_{eff}$ cells in $Rag1^{-/-}$ mice receiving T cell injections but not those receiving PBS (FIGS. 3B-3C, FIGS. 10B-10E), indicating that the $CD8^+$ $T_{eff}$ cells present in these samples were adoptively transferred. Representative lymphoid organs (dLNs, ndLNs and spleens), nonlymphoid organs (lungs) and tumors from a parallel cohort of mice were subjected to high-throughput sgRNA library sequencing (FIG. 4A), which revealed the sgRNA representations of MKO mutagenized OT-I; Cas9 $CD8^+$ $T_{eff}$ cells before injection as well as in all the in vivo samples (FIG. 4B, FIG. 4G, FIG. 11A, FIG. 21D).

Figure 4B:
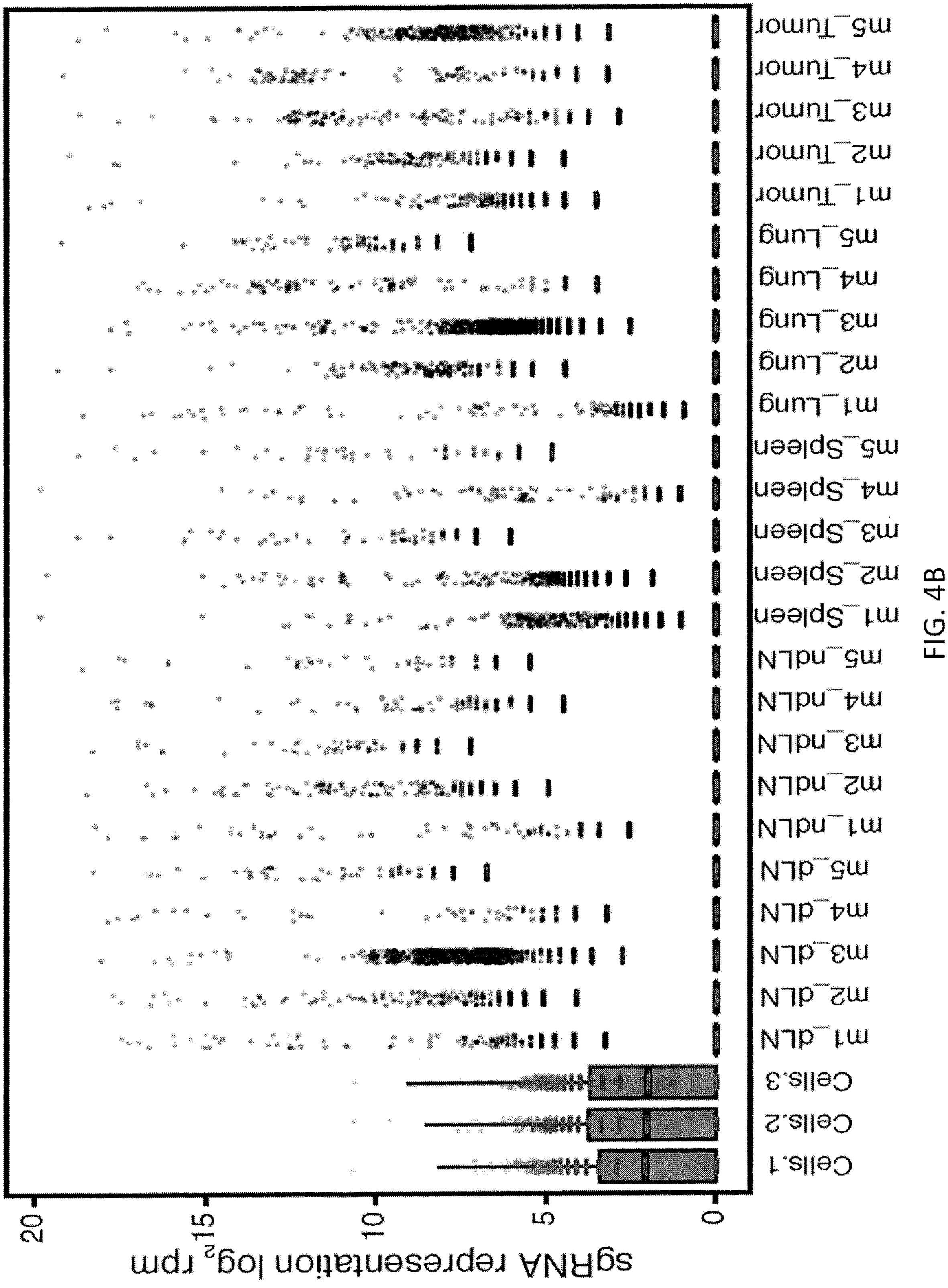
Figure 4C:
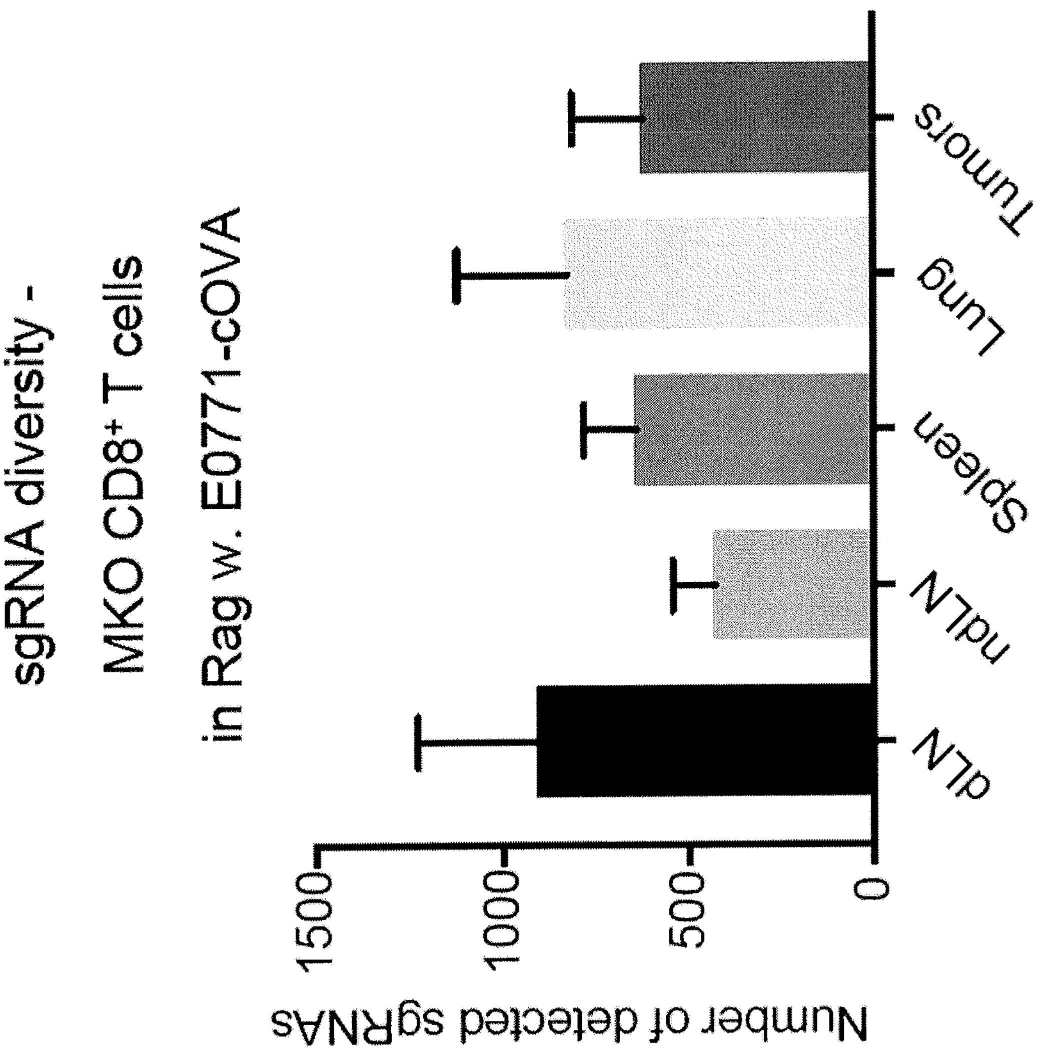
Figure 4D:
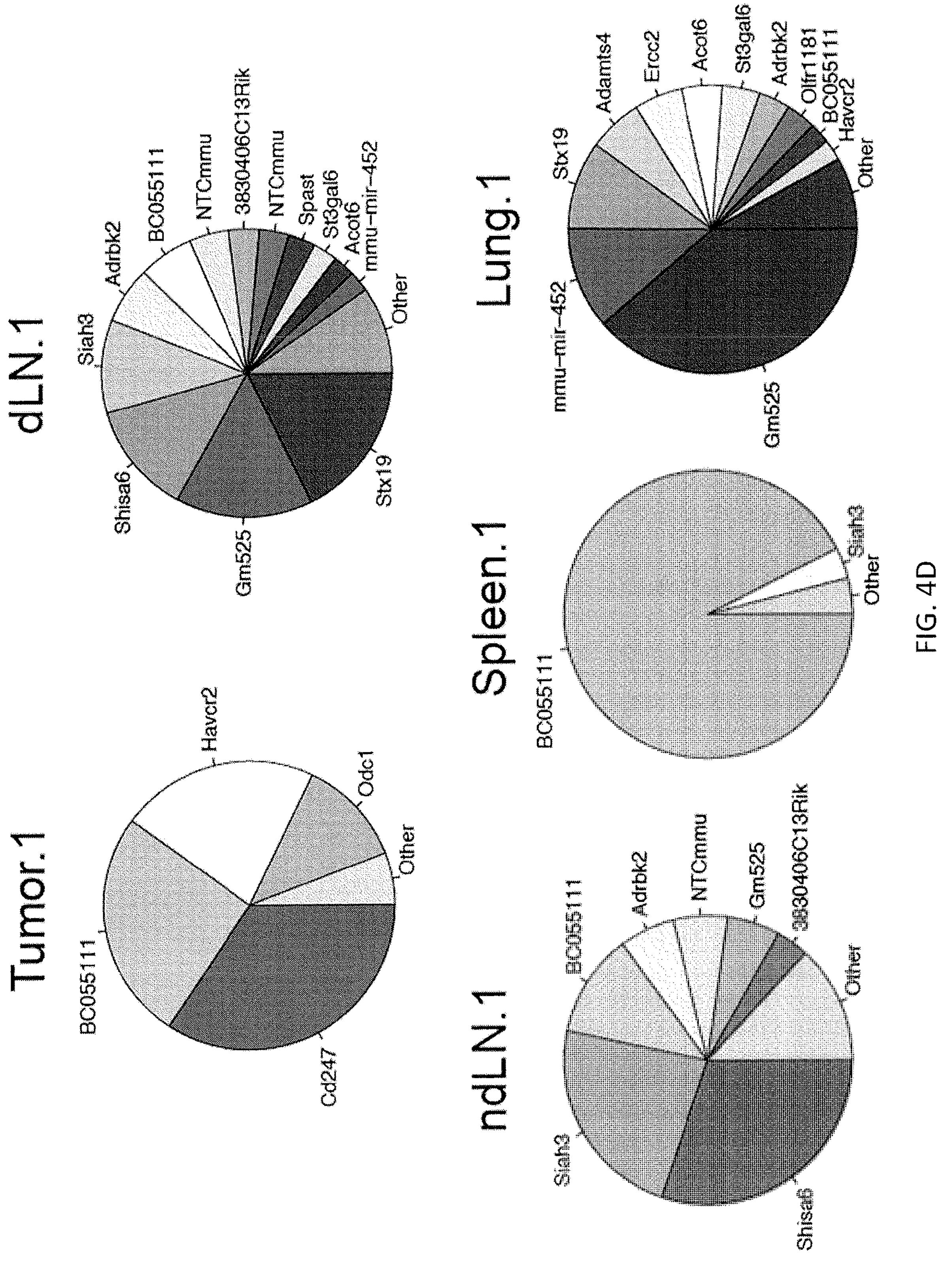
Figure 4E:
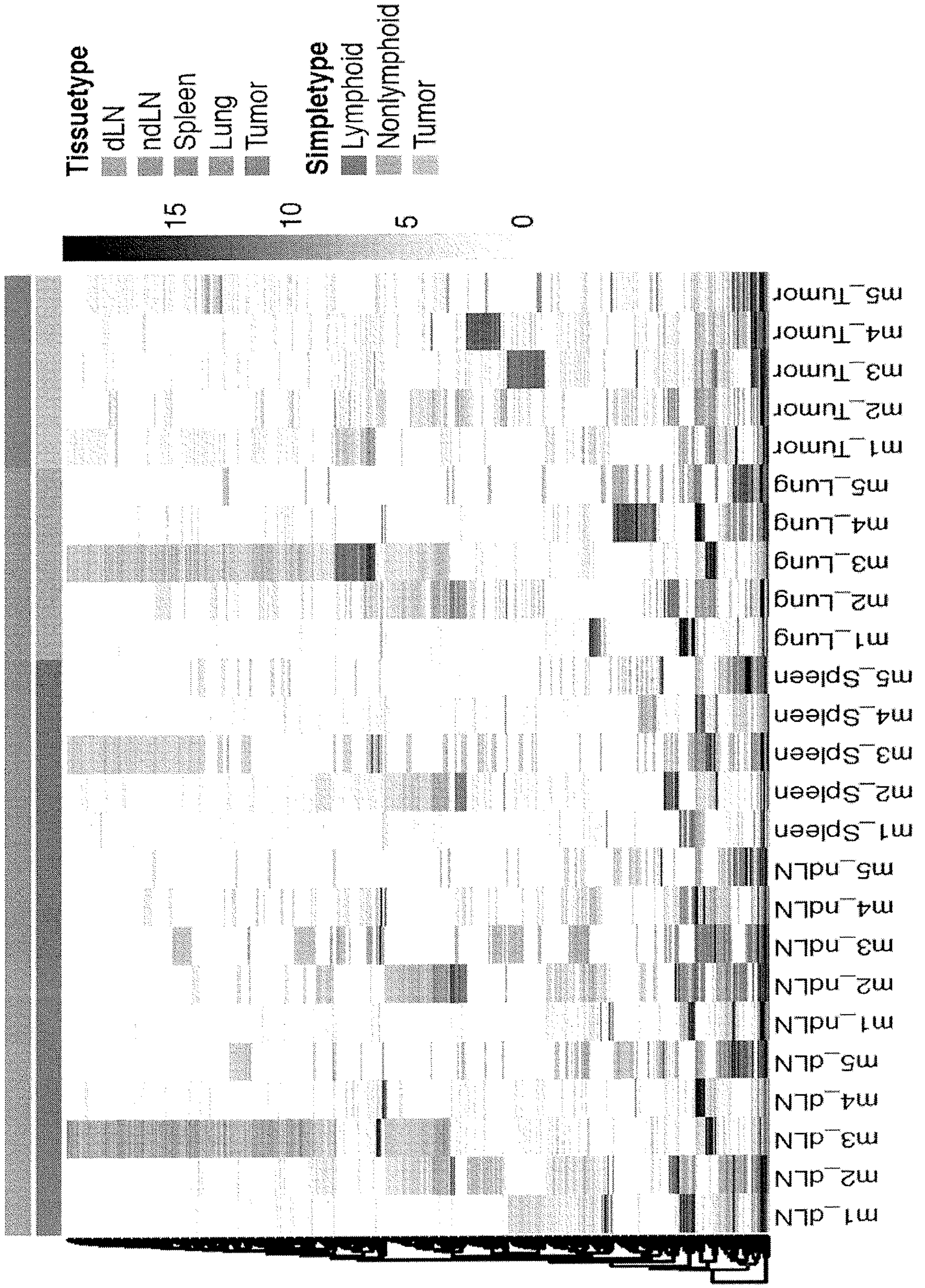
Figure 4F:
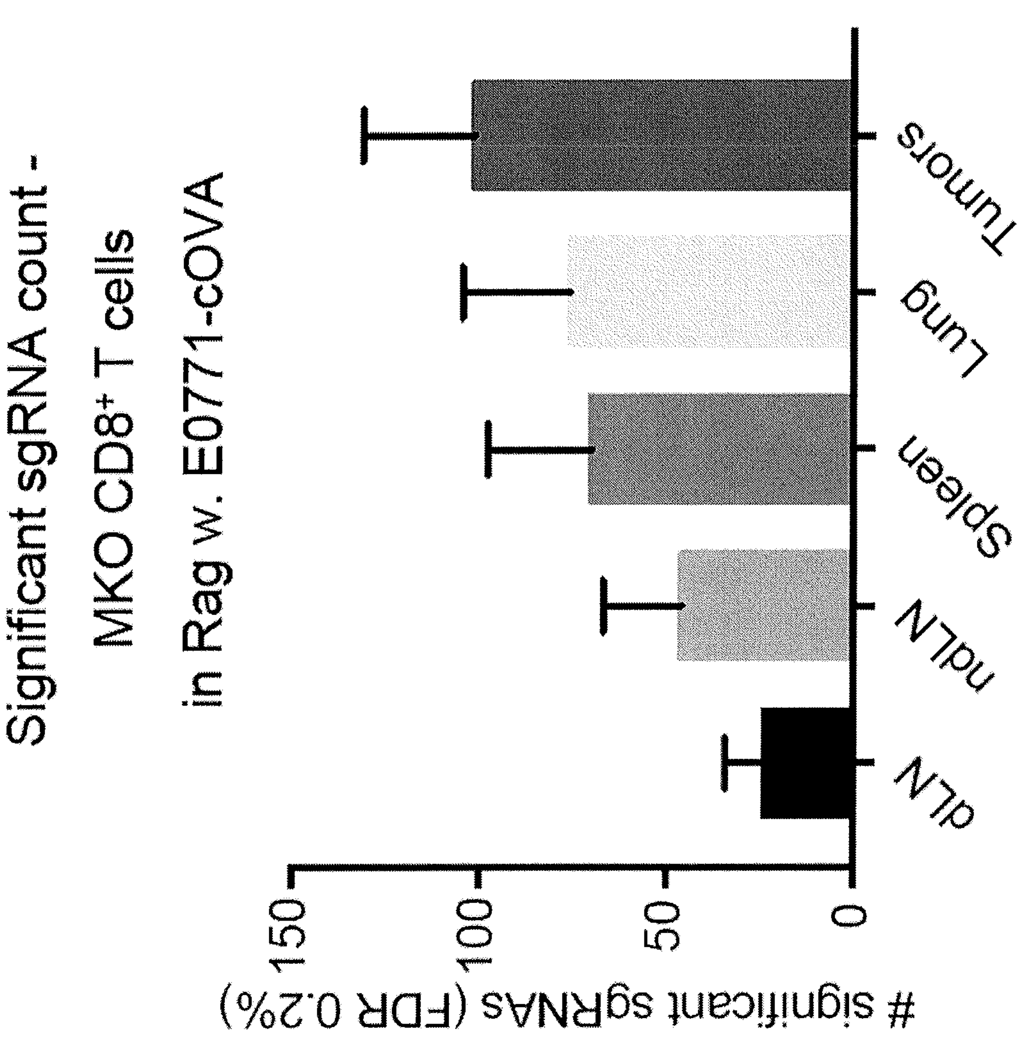
Figure 4G:
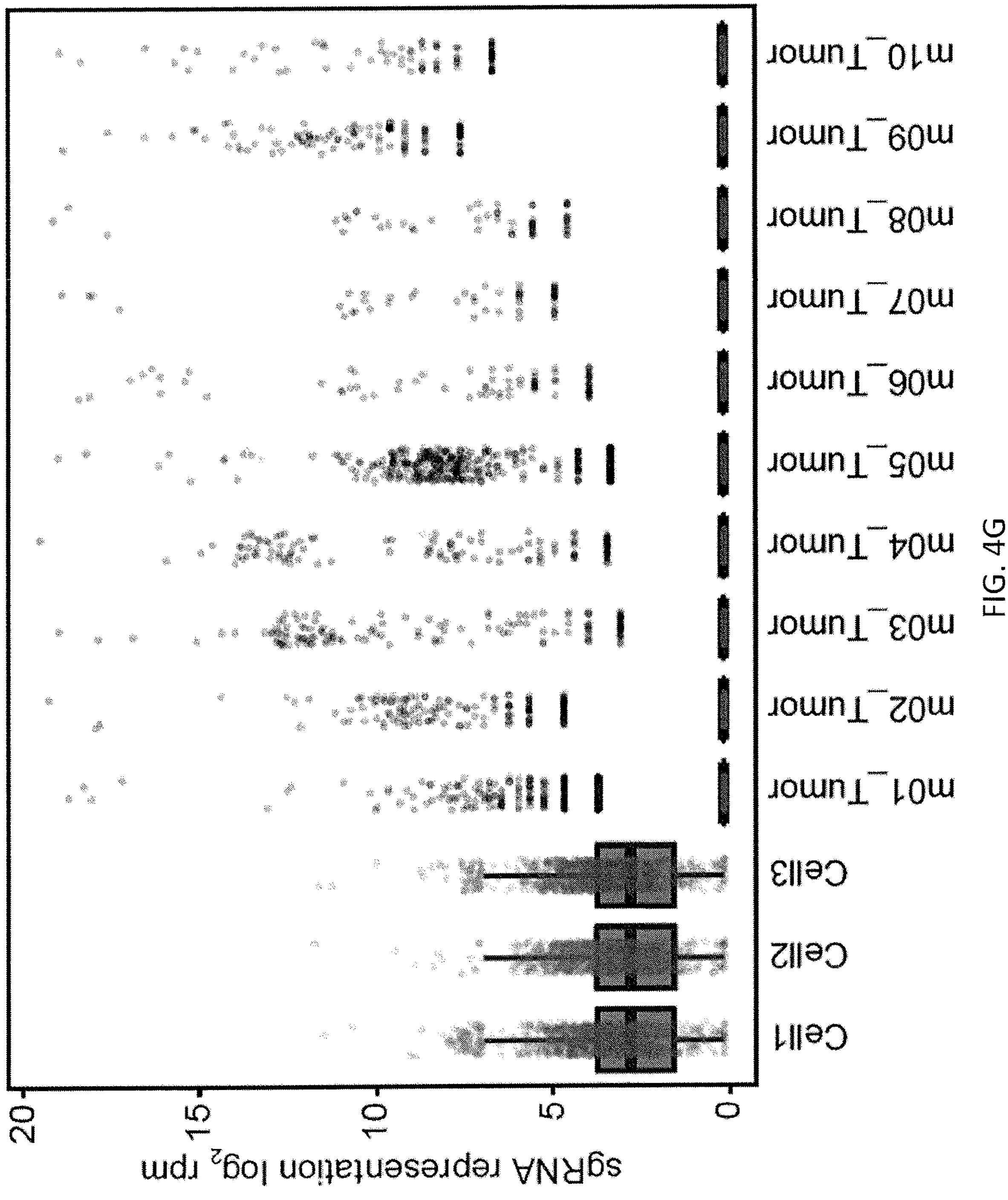
Figure 11A:
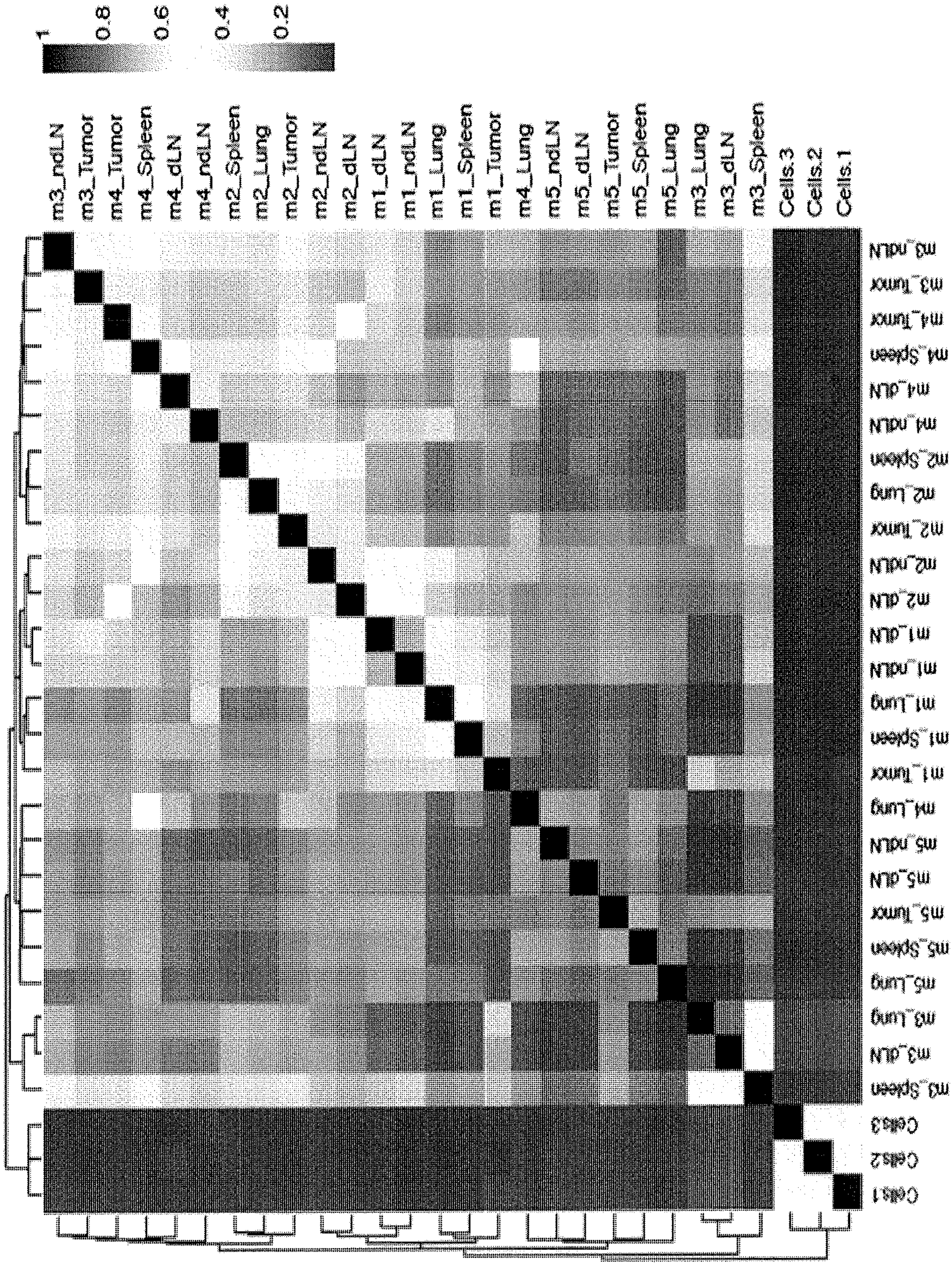
FIGS. 11A-11D are a series of plots illustrating overall sgRNA quantification for the analysis of MKO mutagenized OT-I; Cas9 $CD8^+$ $T_{eff}$ cells in $Rag1^{-/-}$ mice with transplanted tumors expressing cOVA antigen.
Figure 11C:
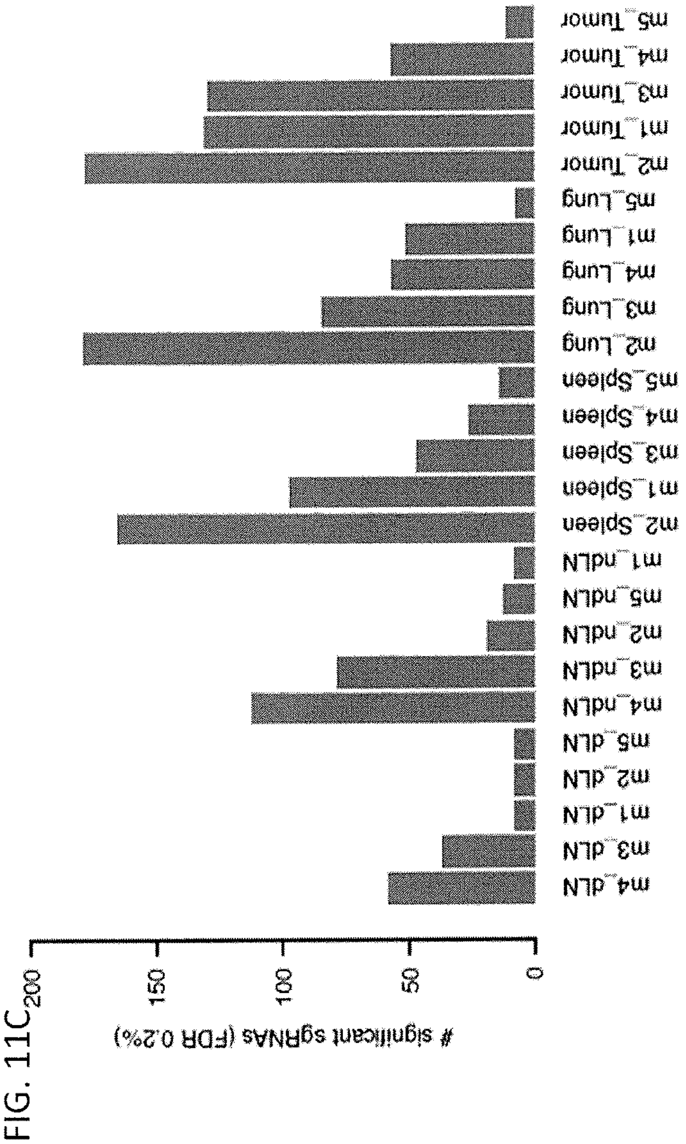
Figure 11D:
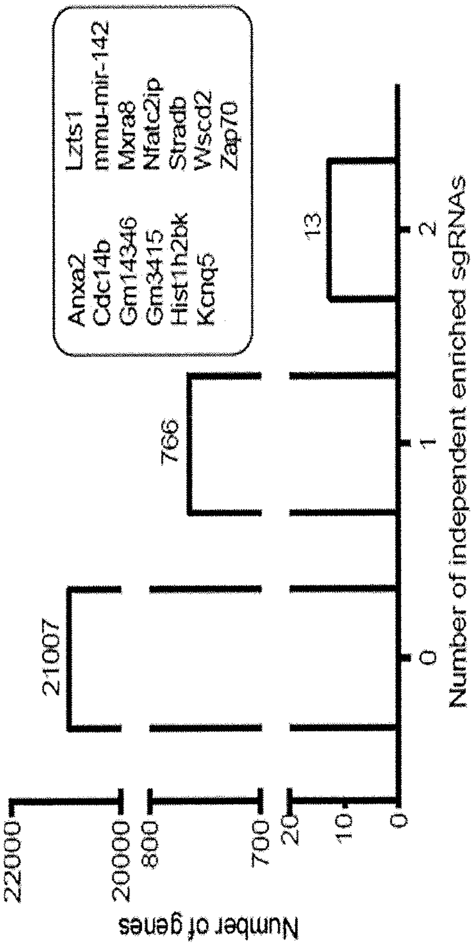
Figure 11B:
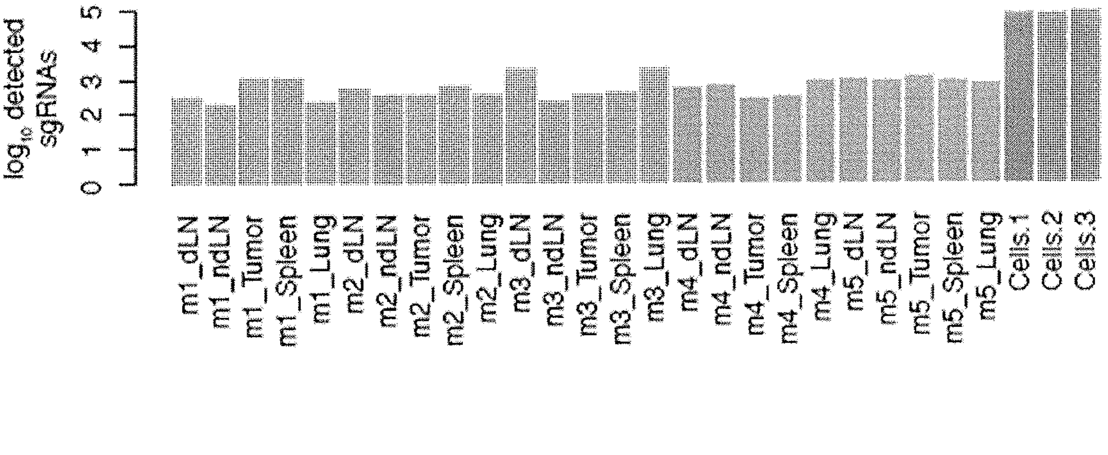
Figure 12A:
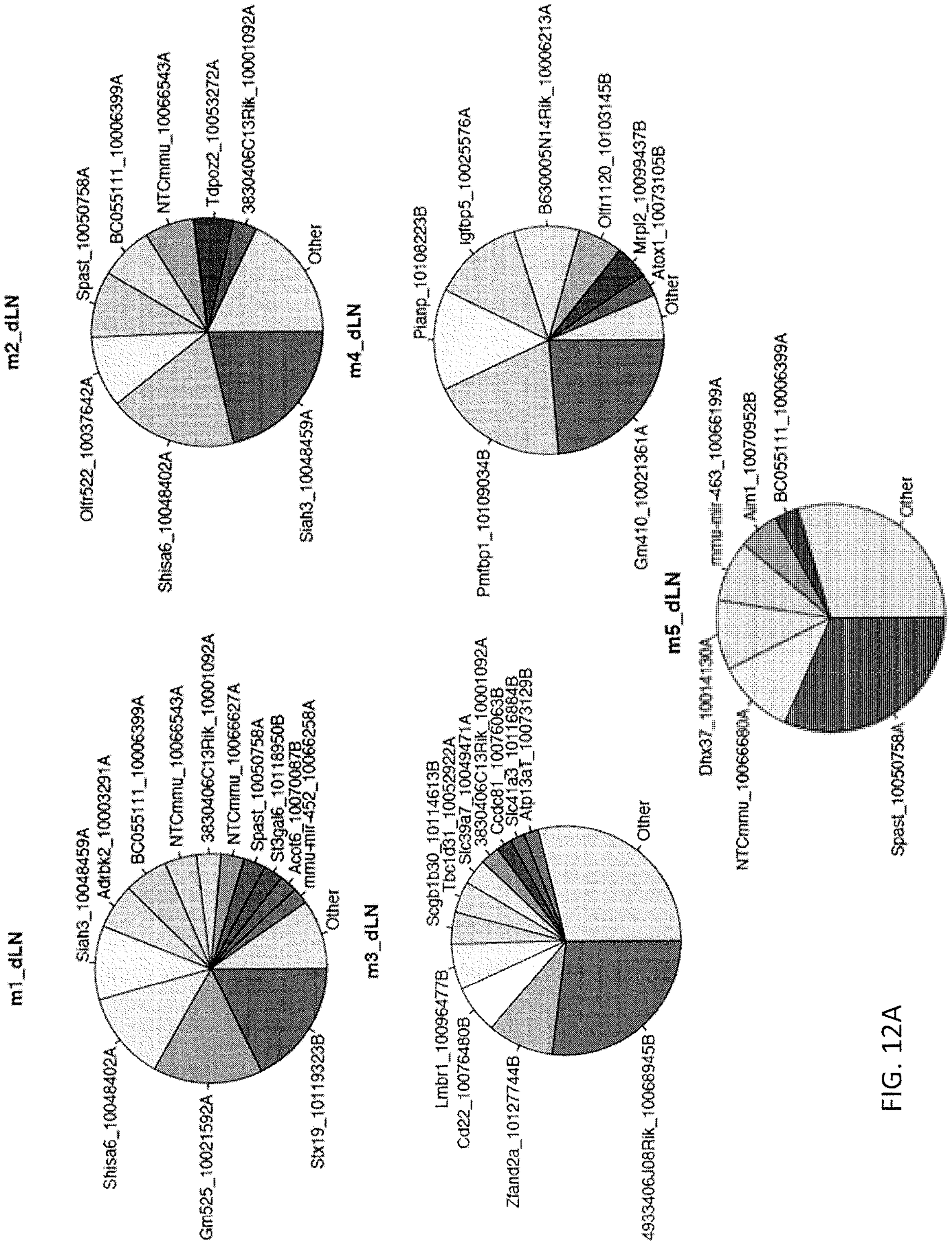
FIGS. 12A-12E are a series of pie charts depicting the analysis of MKO mutagenized OT-I; Cas9 $CD8^+$ $T_{eff}$ cells in $Rag1^{-/-}$ mice with transplanted tumors expressing cOVA antigen. All pie charts of sgRNA compositions in organ samples are depicted. SgRNAs that comprised≥2% of total reads for each sample are shown, with the remaining reads classified as "Other.
Figure 12B:
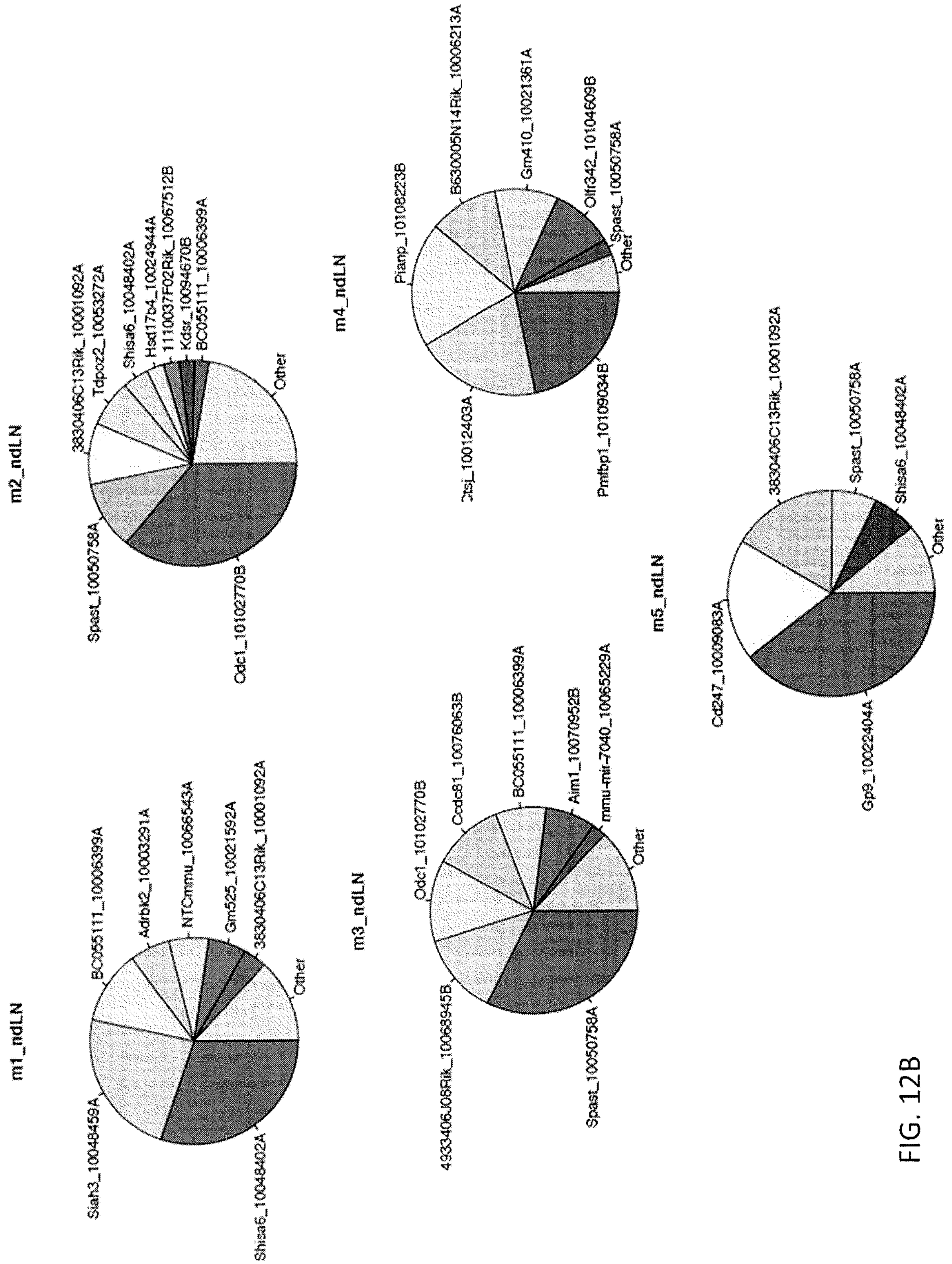
Figure 12C:
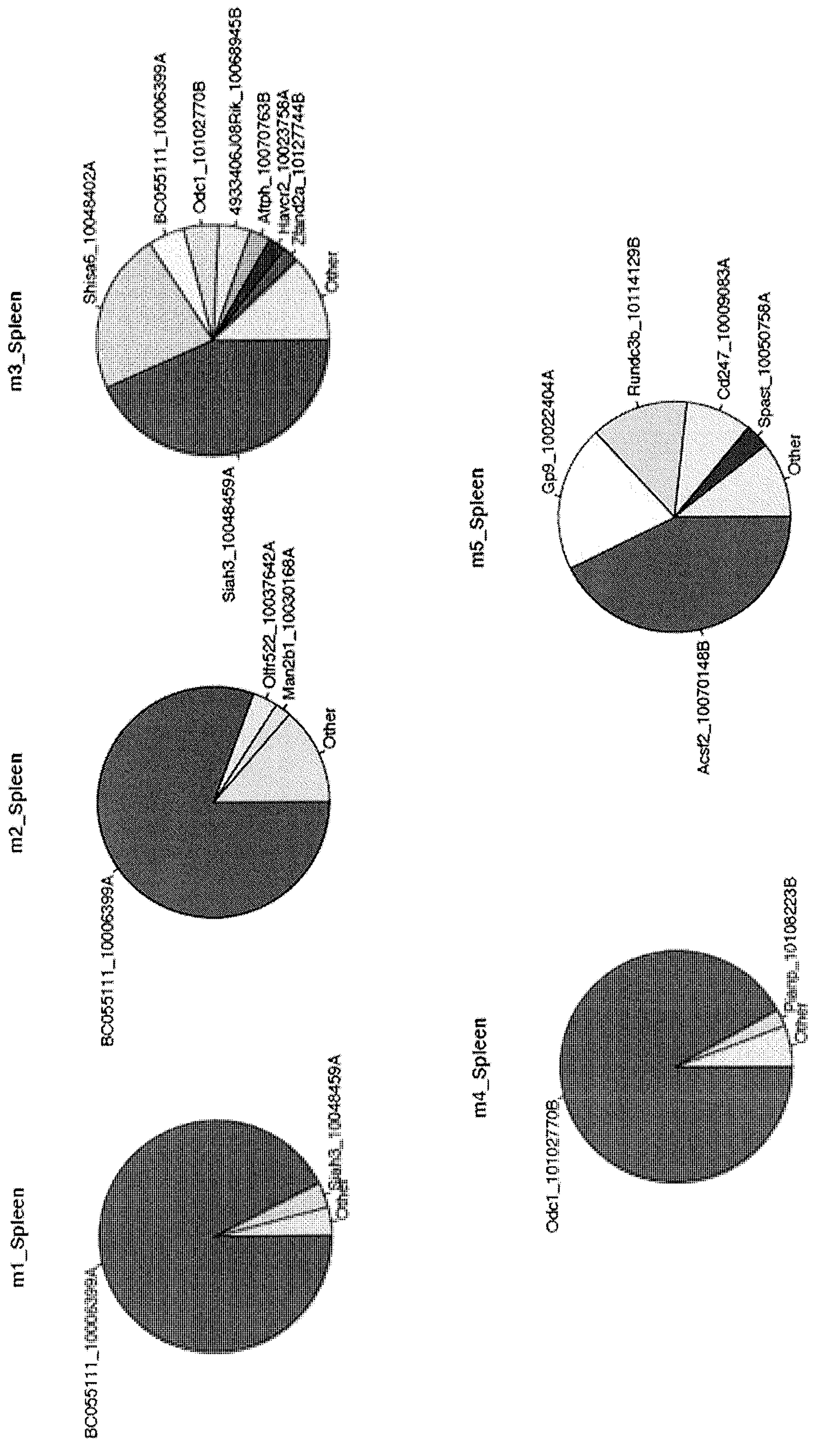
Figure 12D:
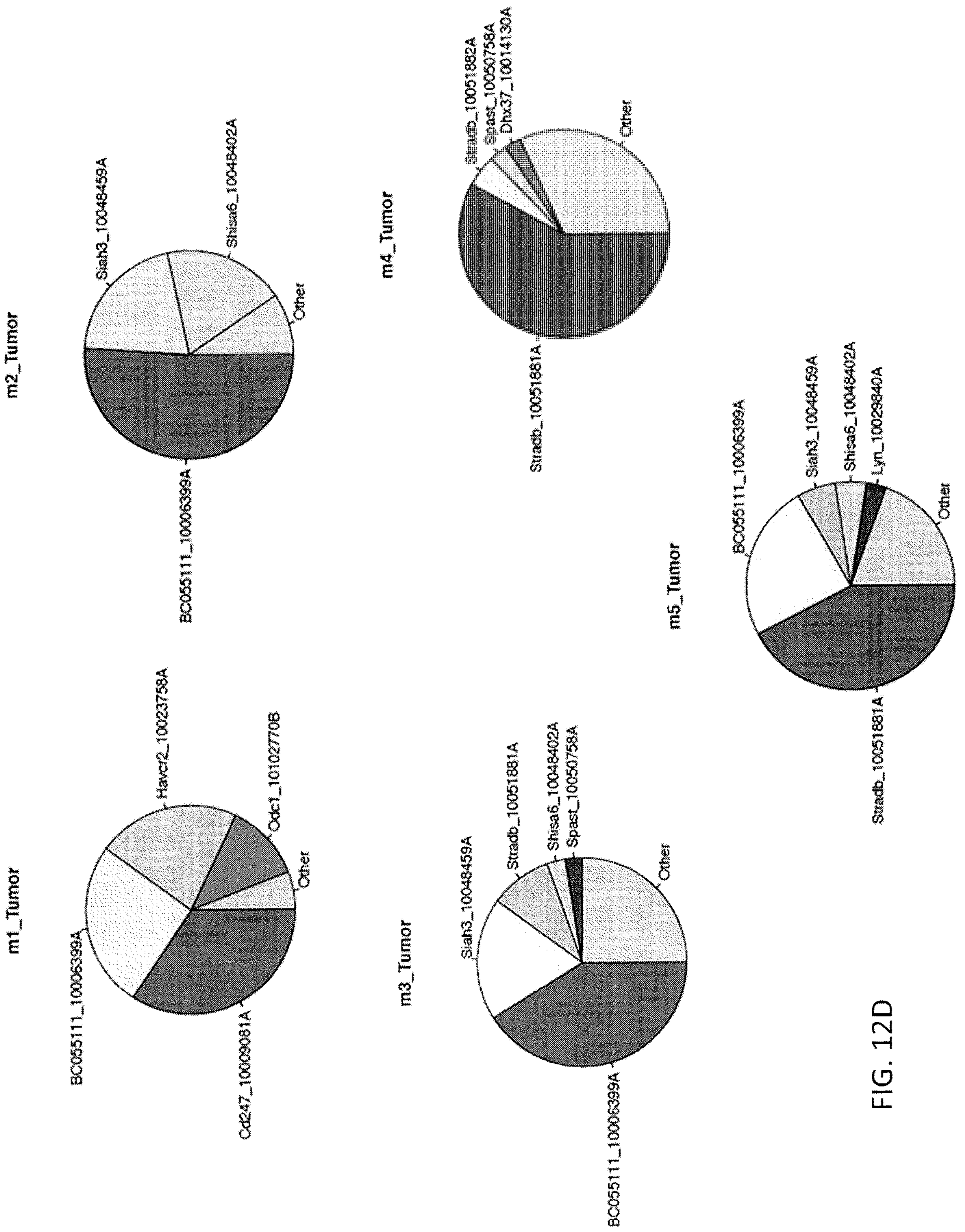
Figure 12E:
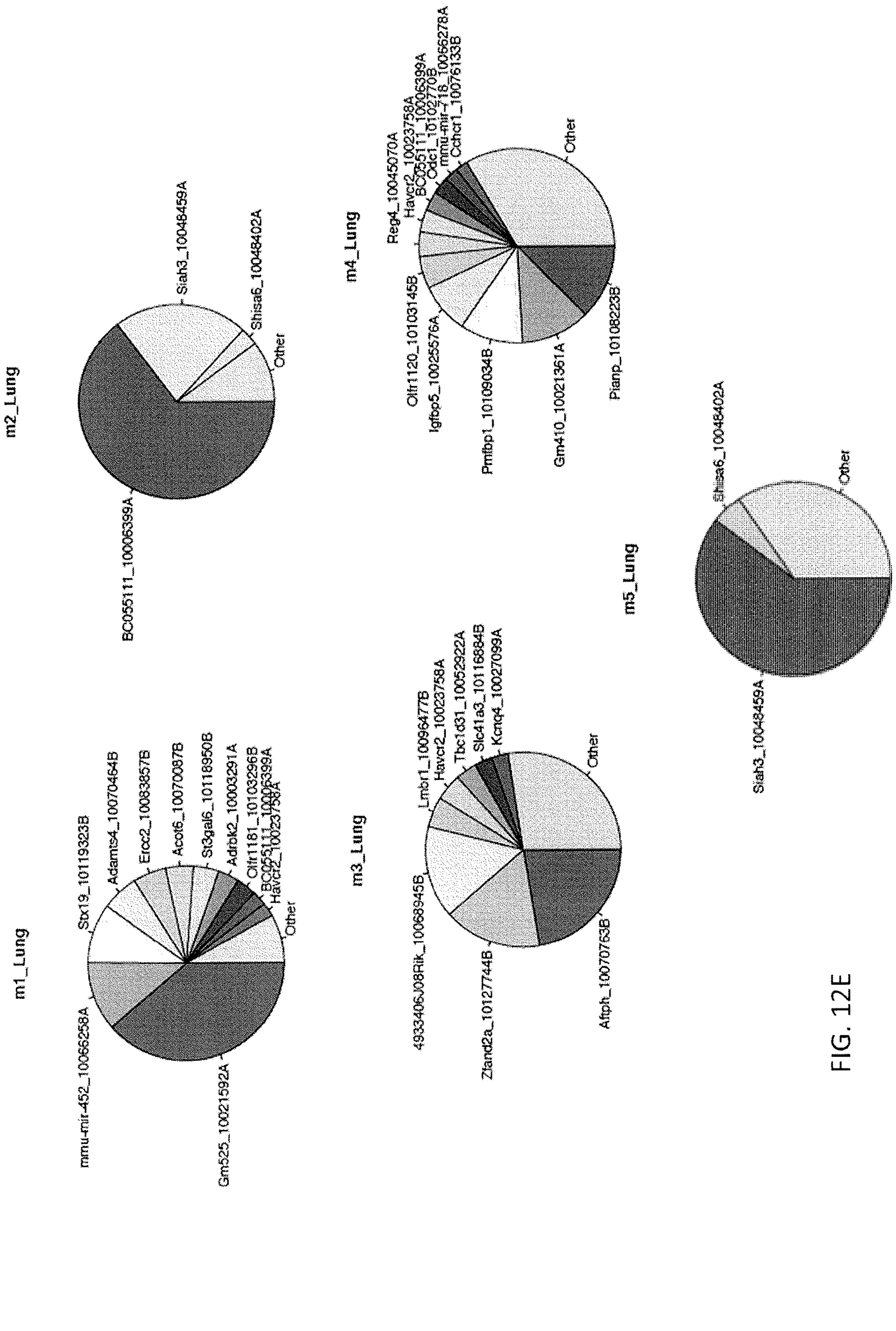

Similar to the first screen, the sgRNA library representation was characterized by a high level of diversity in the pre-injected $CD8^+$ T cell population (FIGS. 4B & 11B). Among the organ samples, the dLN group had the highest number of detected sgRNAs (FIG. 4C). On the contrary, the ndLN group had lowest number of detected sgRNAs, while tumors had the second lowest number of detected sgRNAs (FIG. 4C). Monoclonal, oligoclonal and polyclonal compositions of mutant $CD8^+$ $T_{eff}$ cells were observed in lymphoid, non-lymphoid organs and tumors (FIGS. 4D & 12A-12E). Using the same criteria (FDR<0.2%), significantly enriched sgRNAs were identified in each organ or tumor (FIG. 11C). These sgRNAs had a heterogeneous pattern of abundance across organs and tumors (FIG. 4E). Although the tumor group had a relatively low number of detected sgRNAs, it had the highest number of significantly enriched sgRNAs (FIGS. 4F & 11C). In contrast, although the dLN group had a relatively high number of detected sgRNAs, it had the lowest number of significantly enriched sgRNAs (FIGS. 4F & 11C) (Tumor significant sgRNA (101±30, n=5) vs. dLN (24±10, n=5) (Mann-Whitney test, two-sided, p=0.048) (FIG. 4F). This might be explained by the fact that the tumors expressed cOVA antigen recognized by the OT-I; Cas9 $CD8^+$ $T_{eff}$ cells, which flowed into tumors from adjacent dLNs.

Figure 5B:
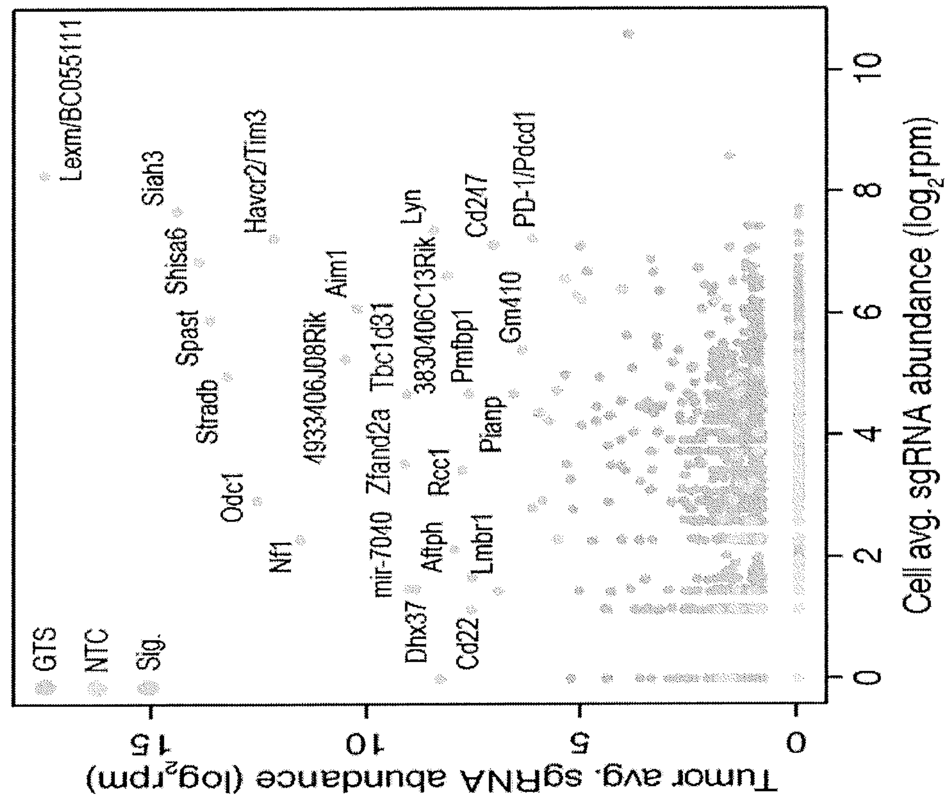
Figure 5A:
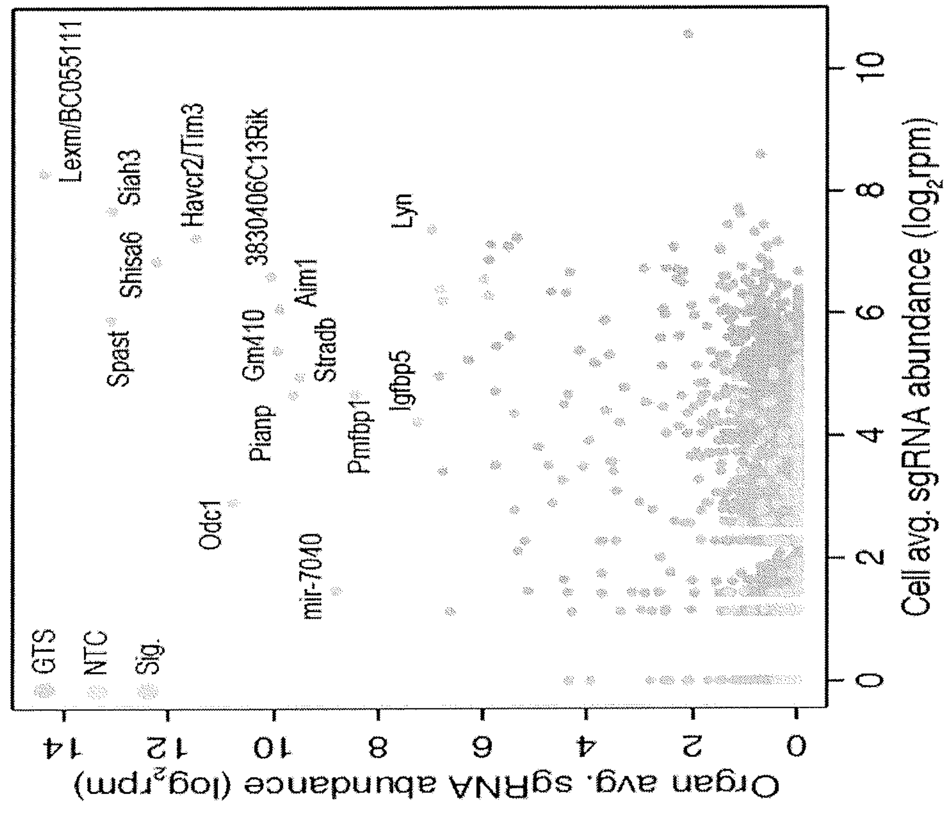

Example 7: Significantly Enriched sgRNAs and Genes in Lymphoid, Nonlymphoid Organs and cOVA-Expressing Tumors Ranking sgRNAs by their overall average abundance in organs (FIG. 5A) or tumors (FIG. 5B) again revealed dominant signatures of immune genes (such as Tim3/Havcr2, Lexm/BC055111, Lyn, Cd247 and PD-1/Pdcd1), tumor suppressor genes (such as Aim1 and Nf1), as well as genes with undocumented function in $CD8^+$ T cells or generally uncharacterized genes (such as Shisa6, Siah3, Odc1, Dhx37, and 3830406C13Rik) (FIGS. 5A-5B). Ranking sgRNAs by their prevalence across multiple samples, or by the number of independent enriched sgRNAs, revealed similar signatures (FIGS. 5C & 11D). All significant genes are collectively enriched in functional categories with immune functions (FIG. 5D). These data together suggest the loss-of-function of these genes make $CD8^+$ $T_{eff}$ cells consistently better survivors in organs and tumors in vivo.

Figure 5E:
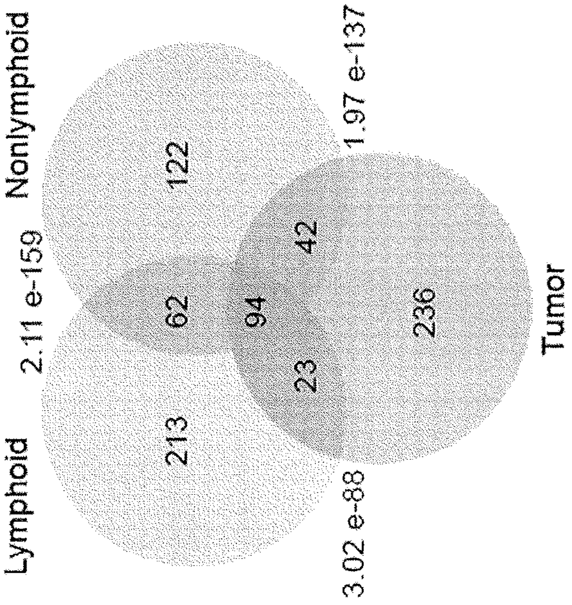
Figure 5F:
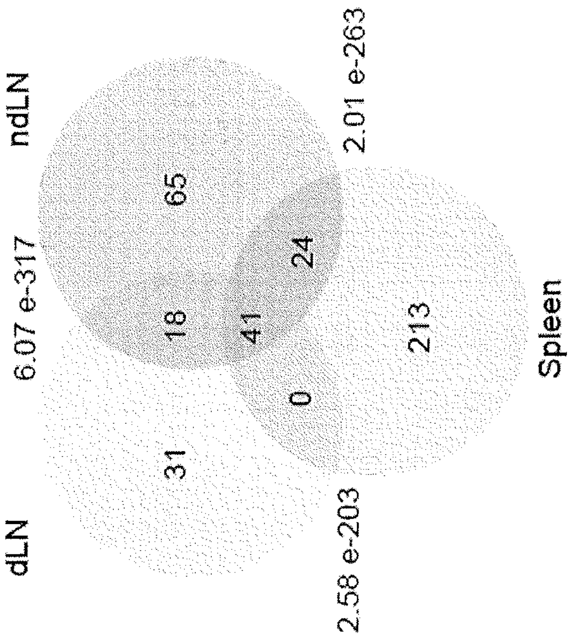
Figure 5G:
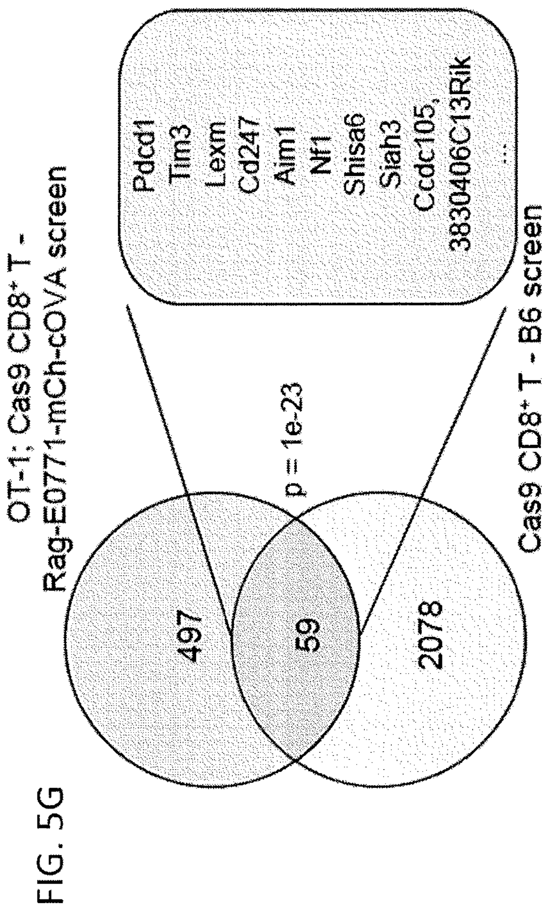

By comparing the set of enriched sgRNAs between different sample types, it was discovered that the significantly enriched sgRNAs in each of the three groups (lymphoid organ, non-lymphoid organ and tumor) significantly overlapped with one other (pairwise hypergeometric test, lymphoid vs. non-lymphoid $p=2.11\times10^{-159}$, lymphoid vs. tumor $p=3.02\times10^{-88}$, and non-lymphoid vs. tumor $p=1.97\times10^{-137}$) (FIG. 5E). There were enriched sgRNAs unique to each sample type (FIG. 5E). Among lymphoid organs, the three groups (dLN, ndLN and spleen) also significantly overlapped (pairwise hypergeometric test, dLN vs. ndLN $p=6.07\times10^{-317}$, dLN vs. spleen $p=2.58\times10^{-203}$, and ndLN vs. spleen $p=2.01\times10^{-263}$) (FIG. 5F). By comparing the hits from this screen (OT-I; Cas9 $CD8^+$ $T_{eff}$ cells in $Rag1^{-/-}$ host bearing tumors with cOVA antigen) to the first screen (Cas9 $CD8^+$ $T_{eff}$ cells in WT host), a highly significant overlap of genes was seen (hypergeometric test, $p=1\times10^{-23}$) (FIG. 5G). The shared genes included multiple immune genes (such as Tim3/Havcr2, Lexm/BC055111, Zap70, Cd247 and PD-1/Pdcd1), a few tumor suppressor genes (Aim1 and Nf1), as well as many genes with undocumented function in $CD8^+$ T cells or genes with little information (such as Shisa6, Siah3, Ccdc105, Ccdc81 and 3830406C13Rik) (FIG. 5G). These data suggest that there exist a common set of genes that modulate the trafficking and survival of $CD8^+$ $T_{eff}$ cells in organs and tumors, with or without antigen.

Figure 4I:
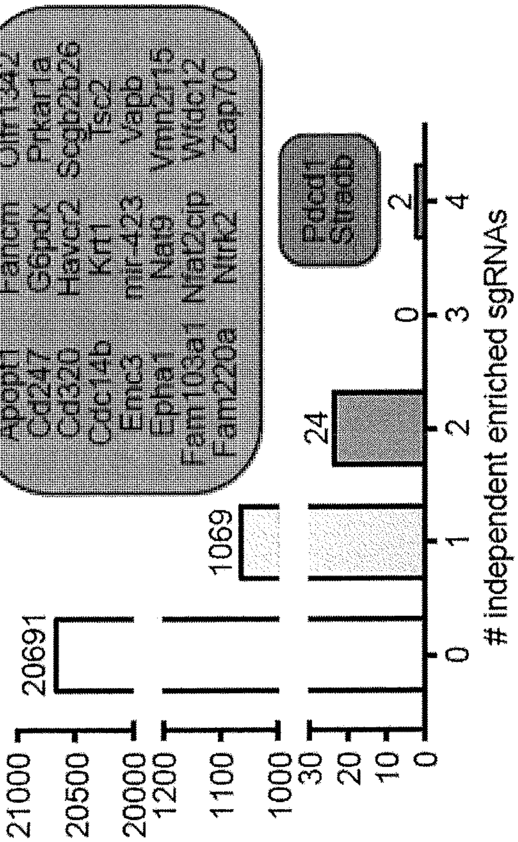
Figure 4J:
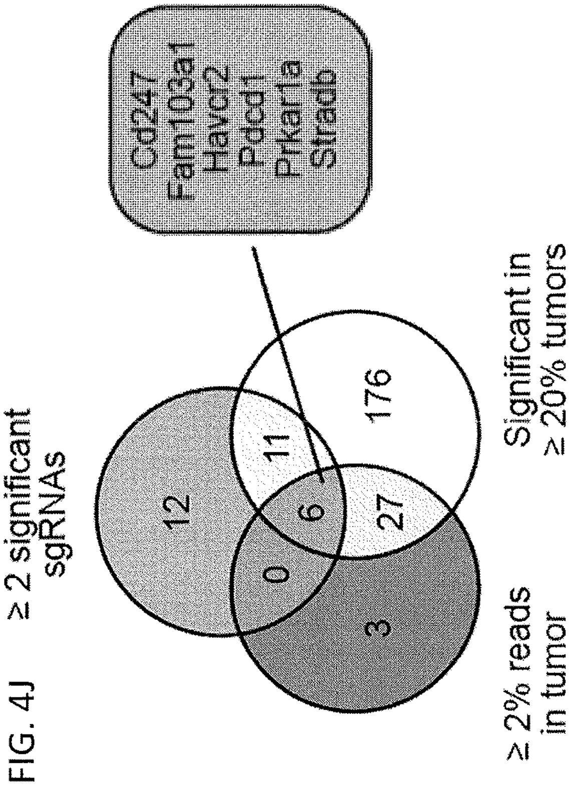
Figure 4H:
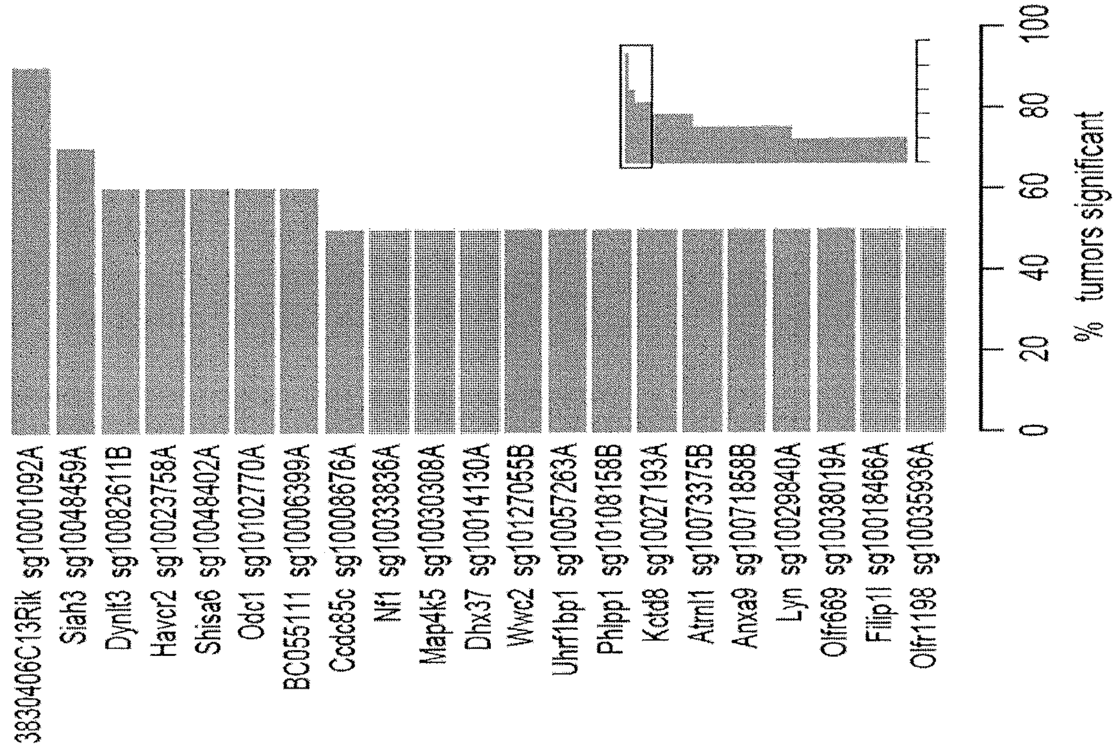
Figure 21F:
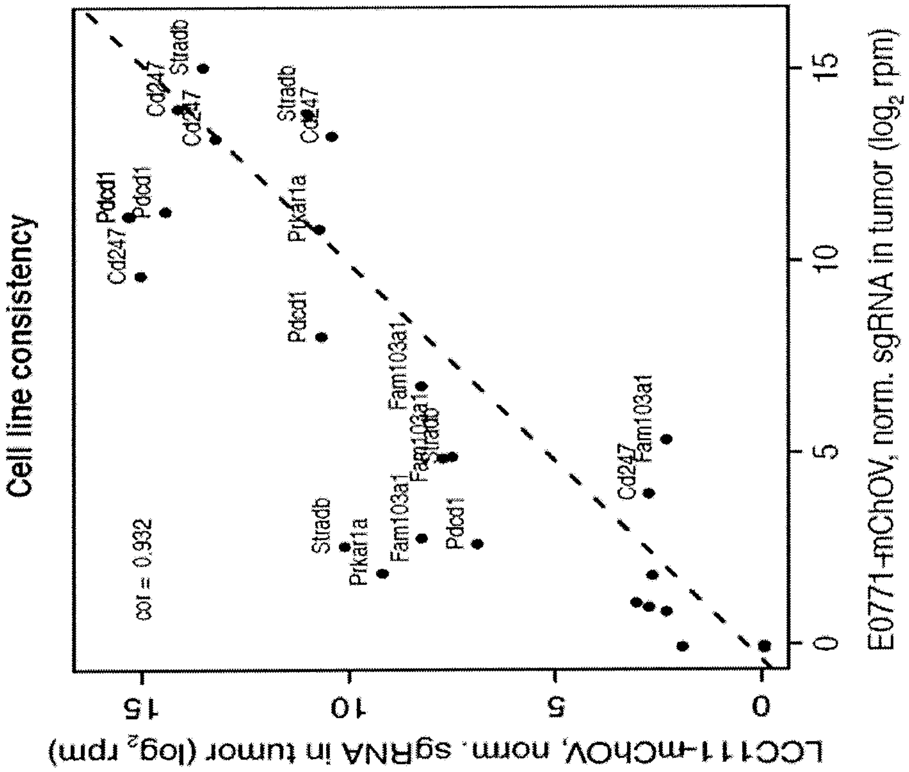
Figure 21E:
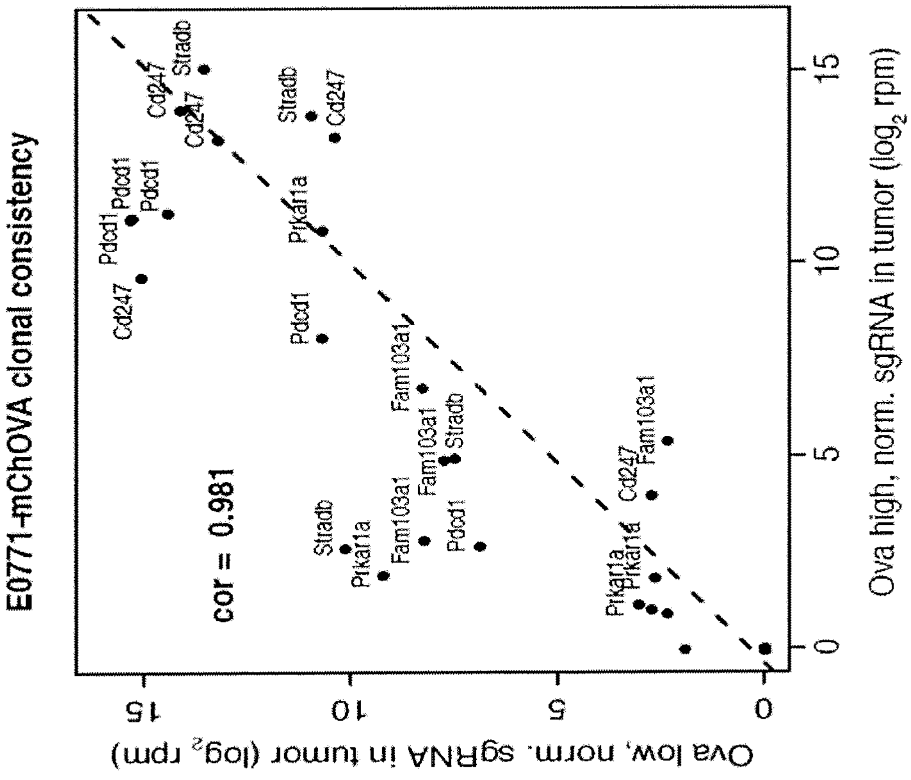

Using the criteria of FDR<0.5%, significantly enriched sgRNAs were identified in each tumor (FIG. 4H). Ranking sgRNAs by their prevalence across tumors again revealed dominant signatures of immune genes (such as Tim3/Havcr2, BC055111, and Lyn), growth genes (e.g. Nf1), as well as genes with undocumented function in $CD8^+$ T cells or generally uncharacterized genes (such as Shisa6, Siah3, Odc1, Dhx37, and 3830406C13Rik) (FIG. 4H). Ranking sgRNAs by the number of independent enriched sgRNAs revealed 26 genes with multiple enriched sgRNAs (FIG. 4I). Notably, two genes (Pdcd1 and Stradb) had 4 enriched sgRNAs, representing independent evidence for their phenotypes (FIG. 4I). After considering a third criteria of sgRNA abundance (≥2% of total reads in a single tumor) representing substantial TIL clones, a total of 6 genes are significantly enriched across all three criteria (Cd247, Fam103a1, Hacvr2, Pdcd1, Prkar1a, and Stradb) (FIG. 4J). To test the clonal effect of cOVA antigen expression level, we took the top hits from the screen and performed a minipool screen with two clones expressing different levels of cOVA (cl.3 and cl.5), and found that the sgRNA representation is highly consistent between the two (Pearson correlation=0.981) (FIG. 21E). To test if the results hold across cancer cell types, we performed a minipool screen with two cell lines, E0771-mCh-cOVA (breast cancer) and LCC-mCh-cOVA (lung cancer), and found that the sgRNA representation is highly correlated with each other (Pearson correlation=0.932) (FIG. 21F). These data together suggest that the CRISPR perturbation of these genes make $CD8^+$ $T_{eff}$ cells consistently better in terms of tumor infiltration and survival in the tumor microenvironment.

Example 8: Further Testing of a Selected Set of Significantly Enriched Genes

Figure 6A:
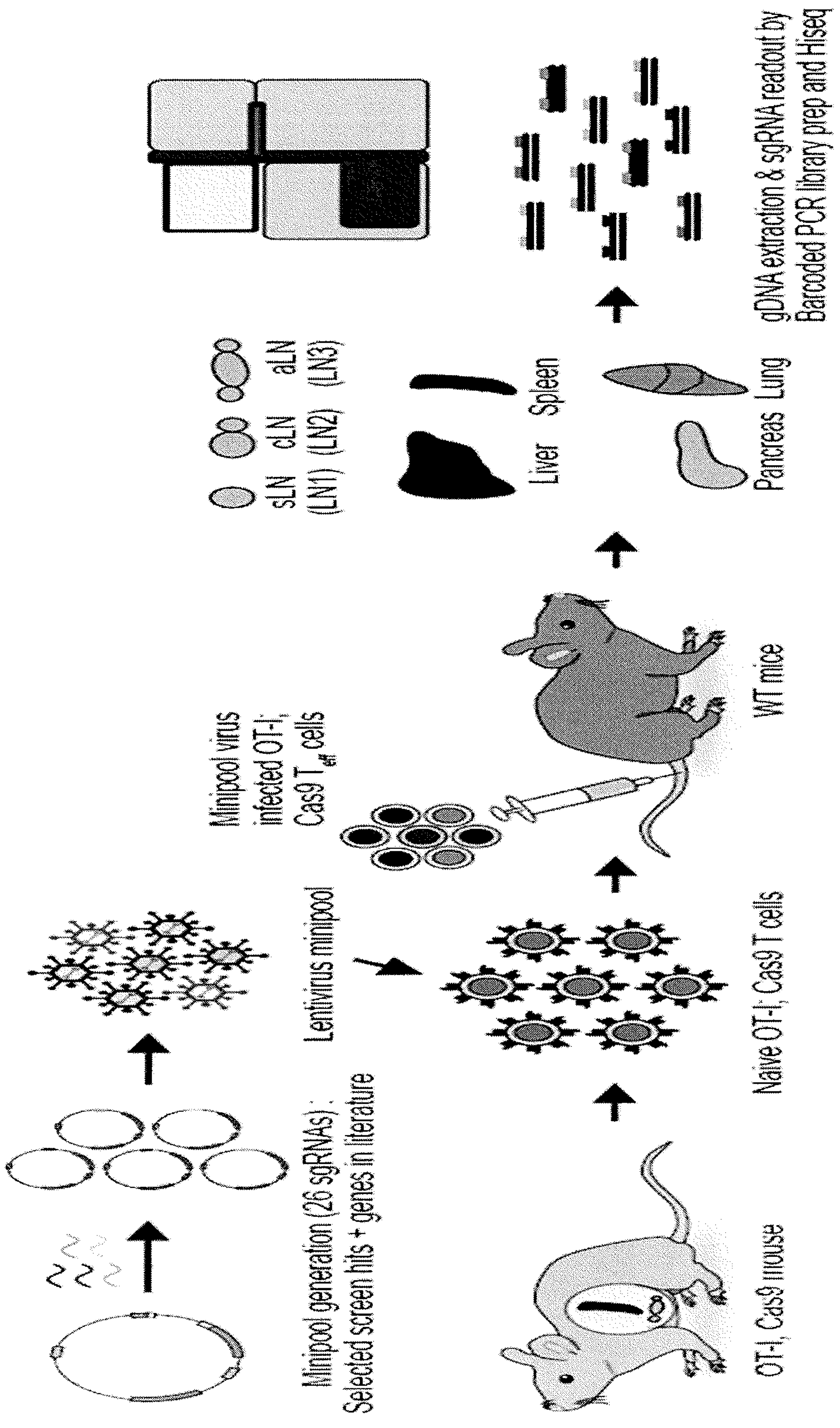
Figure 6B:
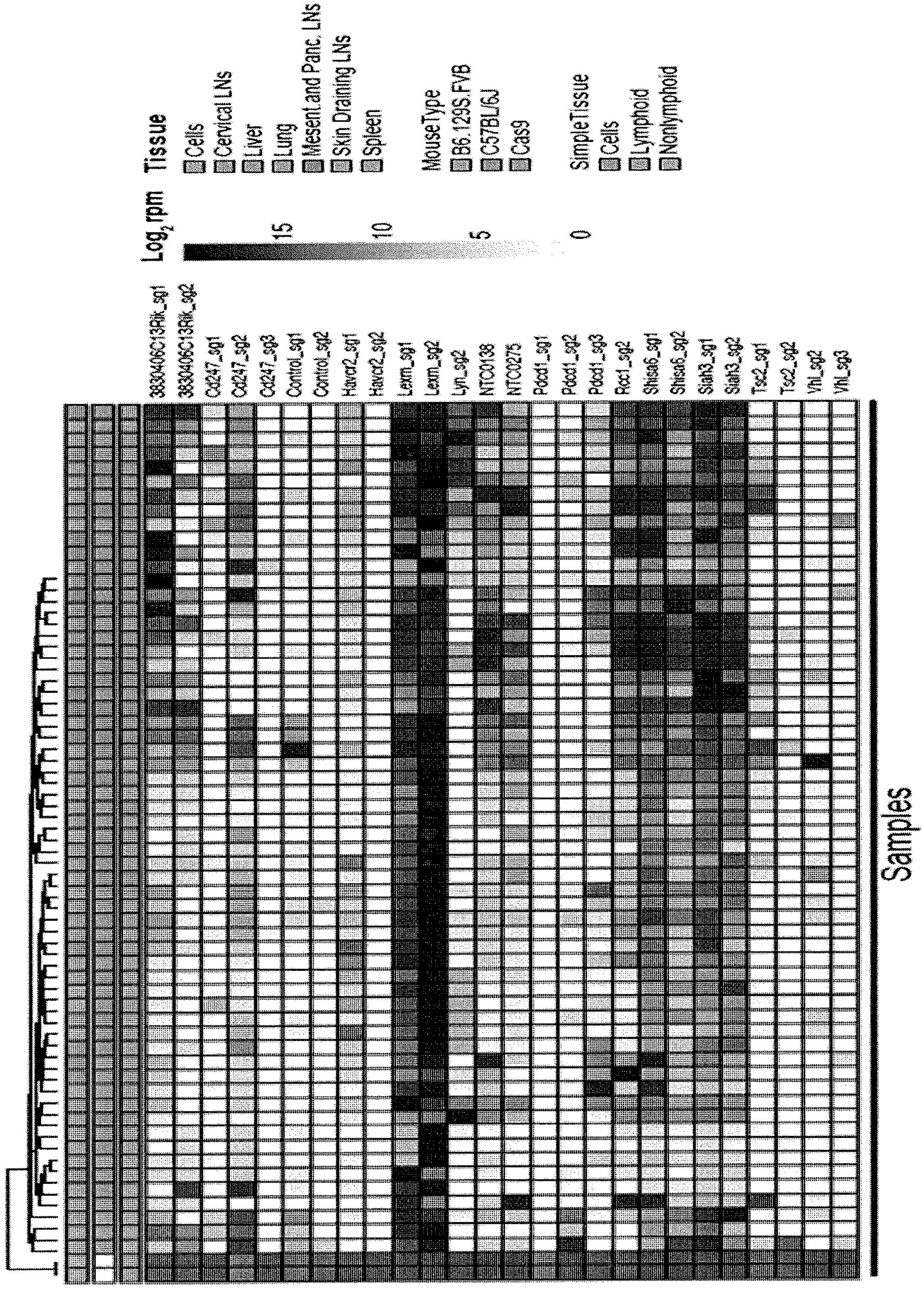

To further test the T cell trafficking and survival signature for the genes enriched in the two genome-scale screens described herein, a selected set of genes highly enriched in either or both screens were focused on, and a small pool of sgRNAs targeting these genes were generated (minipools) (FIG. 6A). Lentivirus was generated from these minipools and OT-I; Cas9 $CD8^+$ $T_{eff}$ cells were mutagenized, and then intravenously injected into various strains of WT mice (FIG. 6A). Seven days after adoptive transfer, representative lymphoid (sLN, cLN and aLN) and non-lymphoid organs (liver, lung and pancreas) were isolated, and the sgRNA representation sequenced in each sample (FIG. 6A). The representation of relative sgRNA abundance was measured in all samples (FIG. 6B). All sgRNAs were found at approximately even abundance in the transduced, pre-injected cell population (FIG. 6B), whereas the internal organs showed a more dynamic picture of sgRNA abundance, with certain sgRNAs being absent, low abundance, medium abundance, or high abundance (FIGS. 6B-6C). Compared to control sgRNAs, 17/22 (77%) of the gene-targeting sgRNAs were significantly enriched in organs, targeting genes such as Lexm, Shisa6, Siah3, Tim3/Havcr2, PD-1/Pdcd1, Cd247, Tsc2 and Rccl (FIGS. 6B-6C & 13). A total of 17 sgRNAs were enriched in lymphoid organs and 14 were enriched in non-lymphoid organs, all of which were included in those in lymphoid organs (hypergeometric test, p=0.0021) (FIG. 6D). These data suggested that the hits from both screens have strong sgRNA enrichment across multiple organs, with little effect in culture.

Figure 22A:
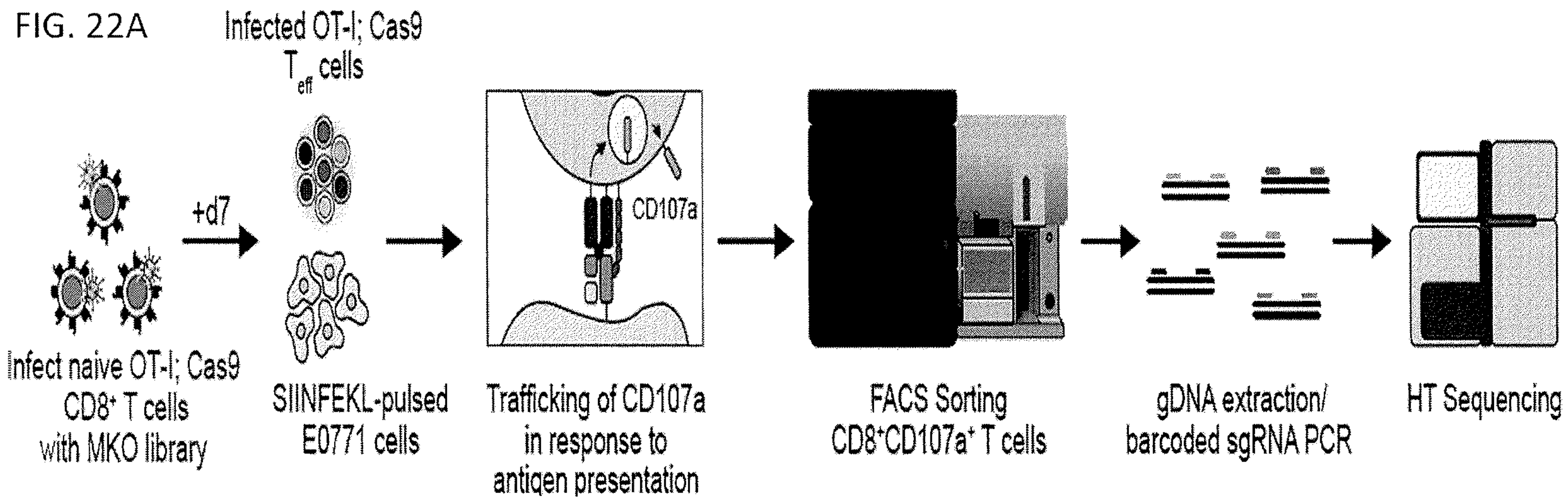
FIGS. 22A-22H are a series of plots and images illustrating high-throughput identification of genes modulating effector CD8+ T cell degranulation upon encountering tumor antigen.
Figure 22B:
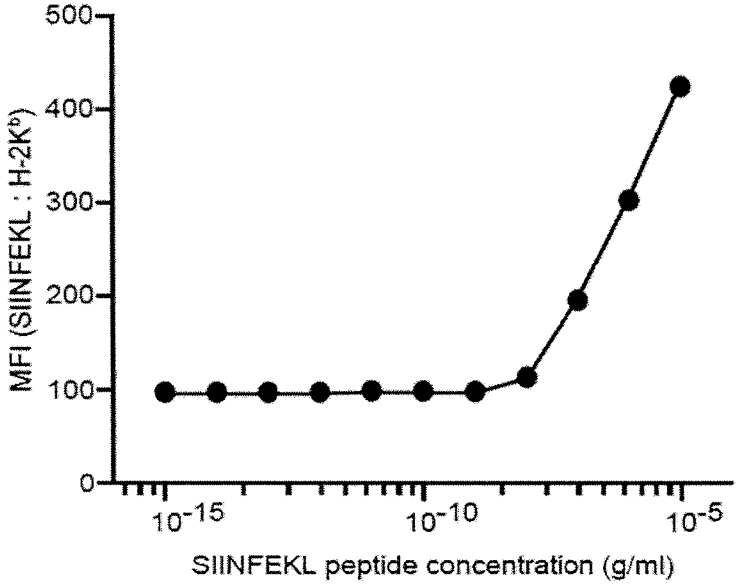
Figure 22C:
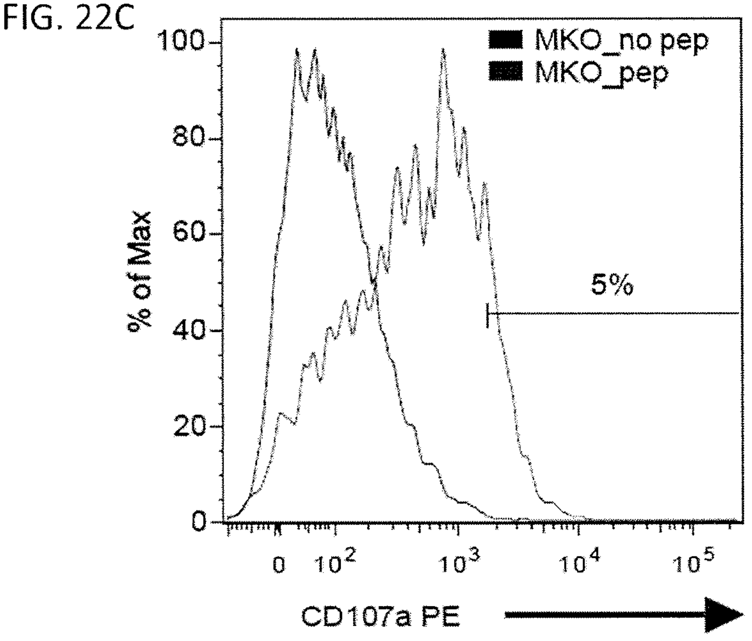
Figure 22D:
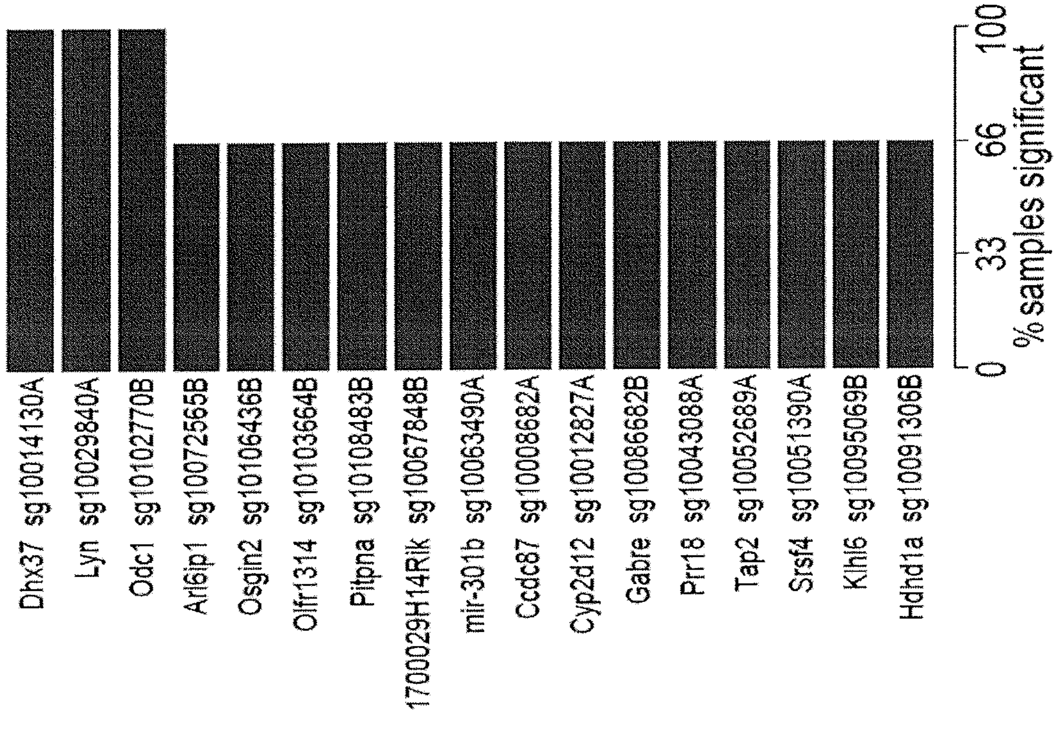
Figure 22E:
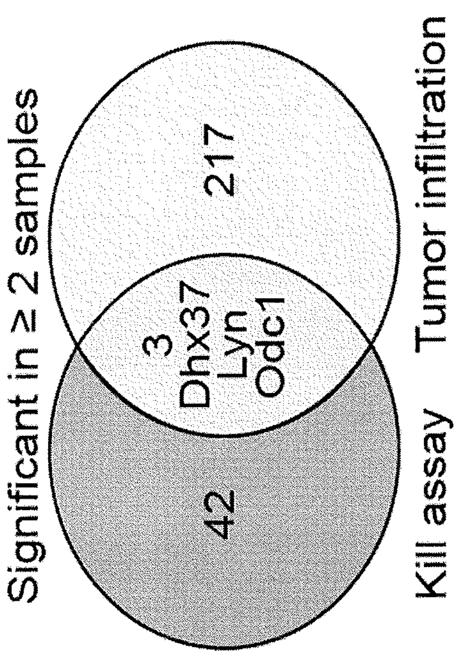

Example 9: High-Throughput Identification of Genes Modulating Effector $CD8^+$ T Cell Degranulation Upon Encountering Tumor Antigen Having observed an anti-tumor effect in vivo, the next aim was to identify genes that could modulate the ability of $CD8^+$ $T_{eff}$ cells to target and kill cancer cells bearing tumor-specific antigen. To do this, a degranulation screen was developed using a co-culture system in which OT-I; Cas9 $CD8^+$ $T_{eff}$ cells would degranulate in response to E0771 cancer cells presenting SIINFEKL peptide (FIG. 22A). E0771 cells were pulsed with varying concentrations of SIINFEKL peptide, and found to present SIINFEKL peptide on surface MHC-I in a dose-dependent manner (FIG. 22B). To perform a high-throughput CRISPR degranulation screen, naive OT-I; Cas9 $CD8^+$ T cells were isolated and transduced with MKO library. The cells were incubated in cRPMI supplemented with IL-2, IL-12, anti-CD28 and anti-CD3 for stimulation for 6 days, rested for 12 hours prior to the experiment on untreated plates, and then the MKO transduced $CD8^+$ $T_{eff}$ cells were co-cultured with SIINFEKL-pulsed E0771 cells at 1:1 (T cell:cancer cell) ratio (Methods). T cells were incubated in media containing anti-CD107a antibody to label the transient deposition of surface CD107a, a marker of T cell granules that is temporarily presented on the cell surface when T cells encounter cognate antigen on MHC. A total of $1\times10^7$ T cells were analyzed per replicate with three biological replicates, and the top 5% $CD107a^+$ cells were sorted (FIG. 22C), then subjected to genomic DNA extraction, CRISPR library readout, and screen data analysis (FIG. 22A). Using the FDR<0.5% significance cutoff, significantly enriched sgRNAs were identified in sorted $CD8^+CD107a^+$ T cells after exposure to SIINFEKL-pulsed E0771 tumor cells in co-culture (FIG. 22D). Remarkably, three genes were significantly enriched in all three samples (Dhx37, Lyn, and Odc1), and they were also found to be significant in the tumor infiltration screen (FIG. 22E). These data together pinpointed Dhx37, Lyn, and Odc1 as promising targets for potentially augmenting anti-tumor activity in vivo by $CD8^+$ T cells.

Figure 22F:
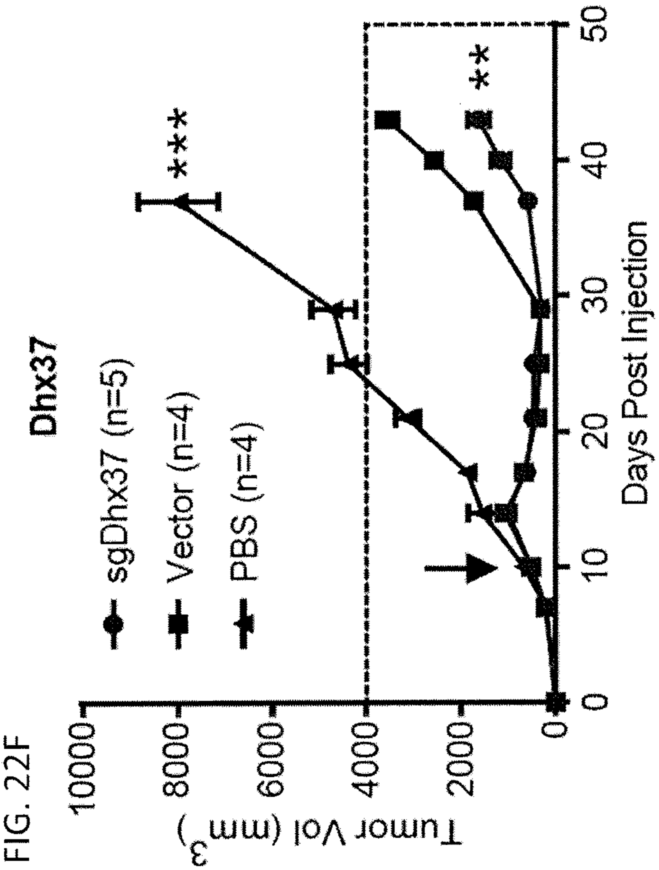

Example 10: Enhanced Anti-Tumor Function and Single-Cell Transcriptomic Signatures of OT-I; Cas9 $CD8^+$ $T_{eff}$ Cells with Dhx37 Perturbation The phenotype of Dhx37 in a model of immunotherapy was examined. Two sgRNAs targeting Dhx37 were cloned into the T cell CRISPR vector, virus preparation and T cell infection were performed as described herein. $5\times10^6$ sgDhx37 or vector lentivirus transduced OT-I; Cas9 $CD8^+$ T cells were adoptively transferred into mice bearing breast tumors, 10 days post mammary fat pad transplantation of $5\times10^6$ clone 3 $mCh^+cOVA^+E0771$ cells. Again, a 1:1 (T cell:cancer cell) ratio was adopted at the time of their respective injections (of note, the cancer cells in a day-10 tumor might largely outnumber $5\times10^6$ T cells). Despite initially growing for 3-days post adoptive transfer, the tumors regressed in the ensuing 2.5 weeks (FIG. 22F). Both vector and sgDhx37 infected OT-I; Cas9 $CD8^+$ $T_{eff}$ cells demonstrated strong anti-tumor effects beginning 7 days after adoptive transfer (Vector or sgDhx37 vs PBS, two-sided t-test, adjusted $p<0.001$ from d17 onwards (Benjamini, Krieger and Yekutieli method)) (FIG. 22F). As a result, sgDhx37 infected OT-I; Cas9 $CD8^+$ $T_{eff}$ cells (n=5 mice) significantly suppressed relapse when compared to mice treated with vector-infected OT-I; Cas9 $CD8^+$ $T_{eff}$ T cells (n=4 mice) (two-sided t-test, adjusted $p<0.01$ from d37 onwards) (FIG. 22F). These data suggest that targeting Dhx37 with CRISPR/Cas9 and sgRNAs enhanced the anti-tumor effects of OT-I; Cas9 $CD8^+$ $T_{eff}$ cells against E0771 tumors expressing cognate antigen cOVA.

Figure 22G:
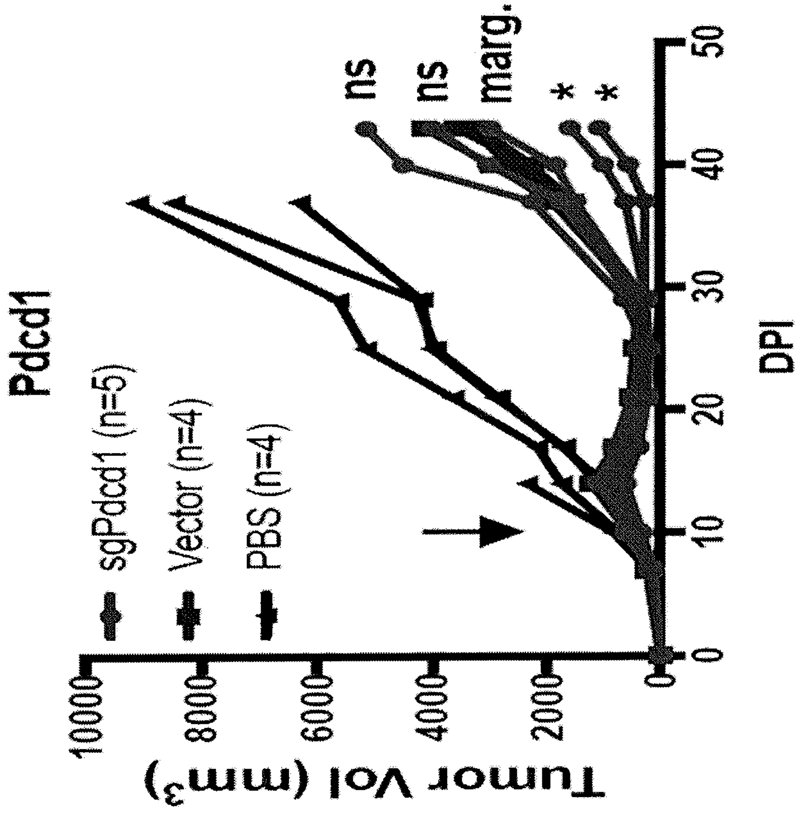
Figure 22H:
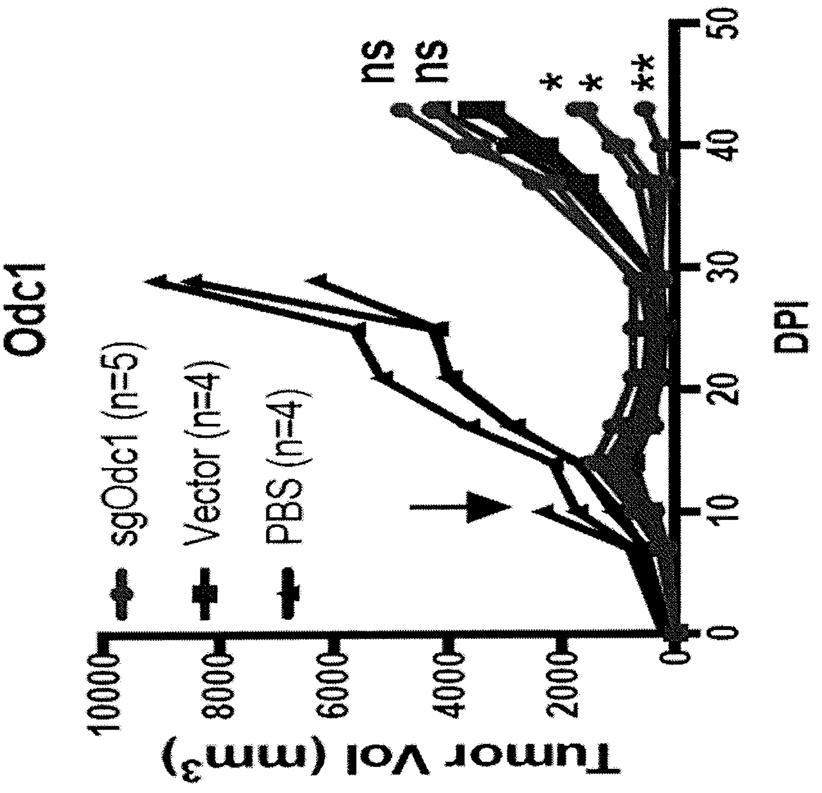

To further test other screen hits for their potential to serve as potential immunotherapy targets, additional studies were performed to investigate possible anti-tumor effects. Two additional genes were tested, Pdcd1 and Odc1. Pdcd1 encodes PD-1, a well-established immunotherapy target, although with varying response rates across different patients and different cancer types. Odc1 encodes an ornithine decarboxylase as an rate-limiting enzyme of the polyamine biosynthesis pathway which catalyzes ornithine to putrescine. With the same assay, it was observed that 2/5 (40%) of mice with sgPdcd1 OT-I; Cas9 $CD8^+$ $T_{eff}$ cells adoptive transfer had tumors significantly smaller than those in the vector control group, although 3/5 do not (FIG. 22G), with variable response rate reminiscent of PD-1 blockade in patients. Similarly, we observed that 3/5 (60%) of mice with sgOdc1 OT-I; Cas9 $CD8^+$ $T_{eff}$ cells adoptive transfer have tumors significantly smaller than those in the vector control group (FIG. 22H). SgRNA perturbation against these two genes showed partial efficacy, although to a lesser extent as compared to Dhx37 (5/5, 100%).

Figure 23A:
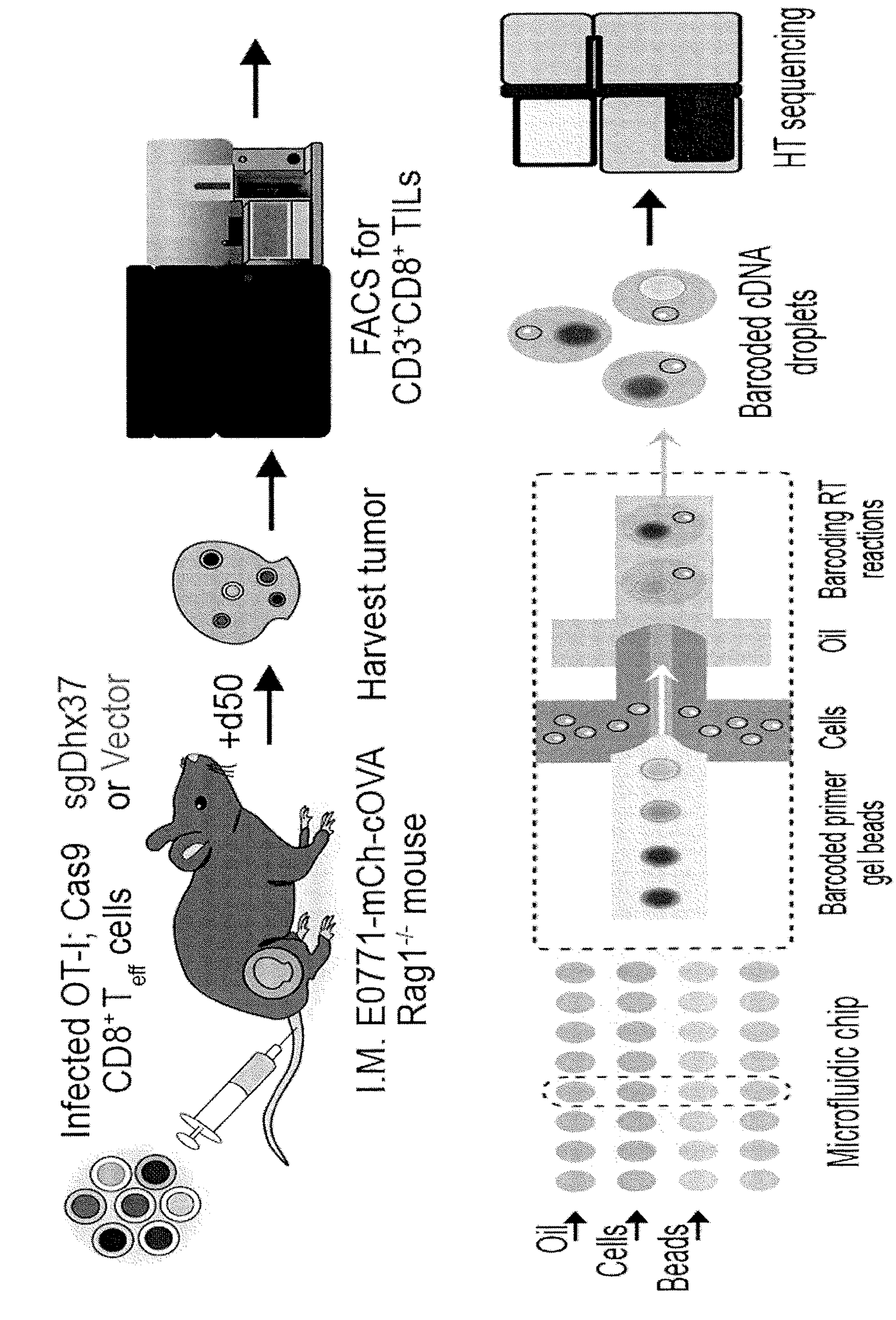
FIGS. 23A-23G are a series of plots and images illustrating single-cell transcriptomics of sgDhx37 OT-I; Cas9 $CD8^+$ TILs in E0771-mCh-cOVA tumors.

Dhx37 is a DEAH box RNA helicase reported to regulate escape behavior via glycine receptor expression in zebrafish, but has not been previously associated with T cell function in mammalian species. The putative ATP-Dependent RNA Helicase domain and conservation implies that it might affect gene expression and cellular function. To investigate the effect of gene expression alteration upon Dhx37 perturbation, transcriptome analysis of sgDhx37 OT-I; Cas9 $CD8^+$ T cells in the form of TILs was performed. Because TILs are in the heterogeneous tumor microenvironment, which might influence the state of TILs leading to highly variable gene expression, single cell RNA-seq (scRNAseq) was performed to investigate the transcriptomes of sgDhx37 TILs. Tumor-bearing mice were euthanized, single-cell suspensions generated from tumors by physical dissociation and enzymatic digestion, and then TILs collected by staining and sorting the live $CD3^+$ $CD8^+$ cells with FACS. Because TILs only consisted of a tiny fraction of cells in these tumors, the vast majority of single cell suspensions were sorted from whole tumors, and $3\times10^3$ to $2\times10^4$ live $CD3^+$ $CD8^+$ TILs per tumor were collected (FIG. 23A). These freshly collected TILs were subjected to an emulsion-based microfluidic device to barcode the $CD8^+$ TILs from sgDhx37 and vector groups, and scRNAseq library preparation was performed. The library was sequenced with Illumina Hiseq platform for unique molecular identifiers (UMIs), cellular barcodes, and the transcriptome in each cell was quantified.

Figure 23B:
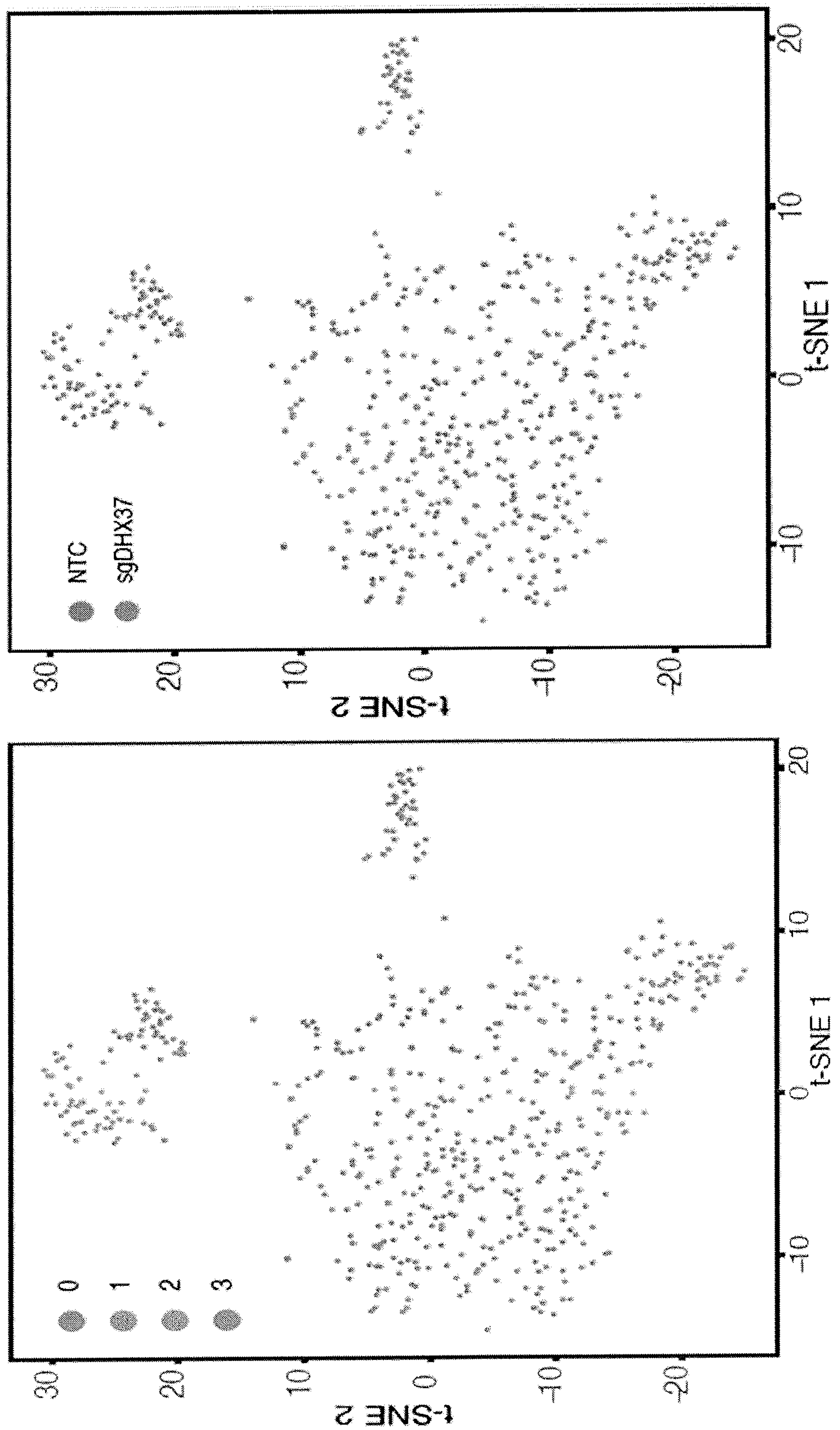
Figure 23C:
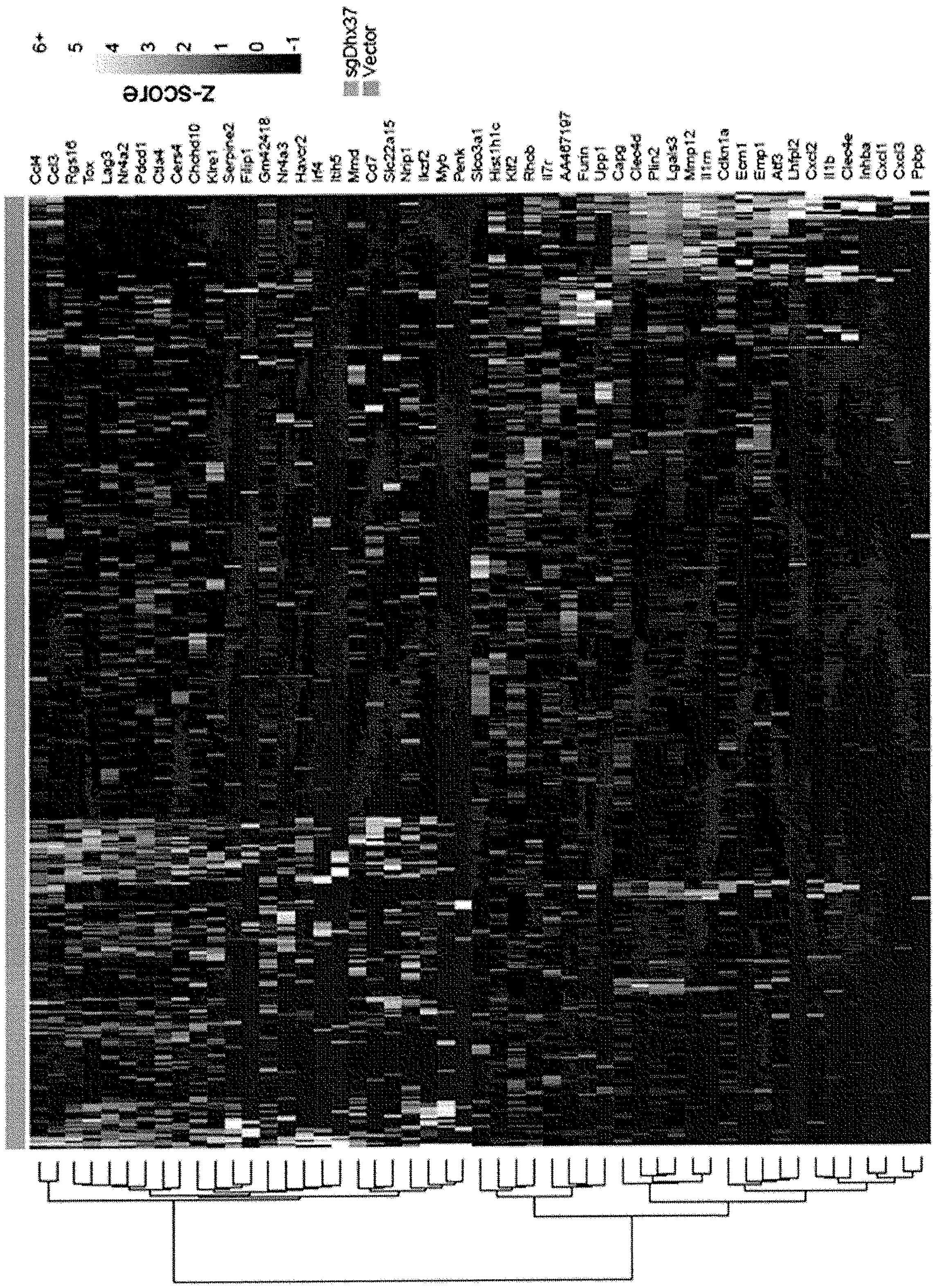
Figures 23D, 23E, 23F:
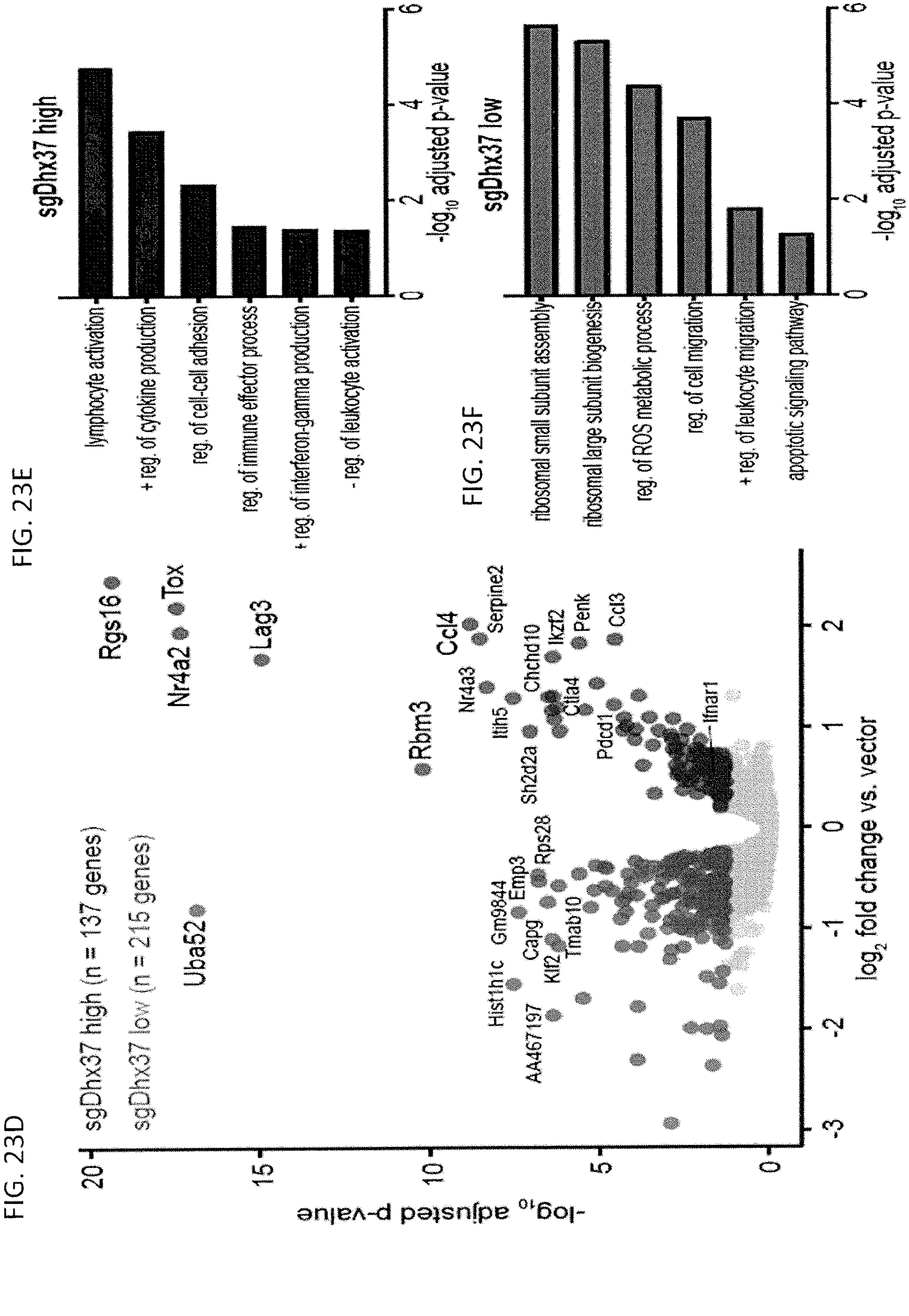
Figure 23G:
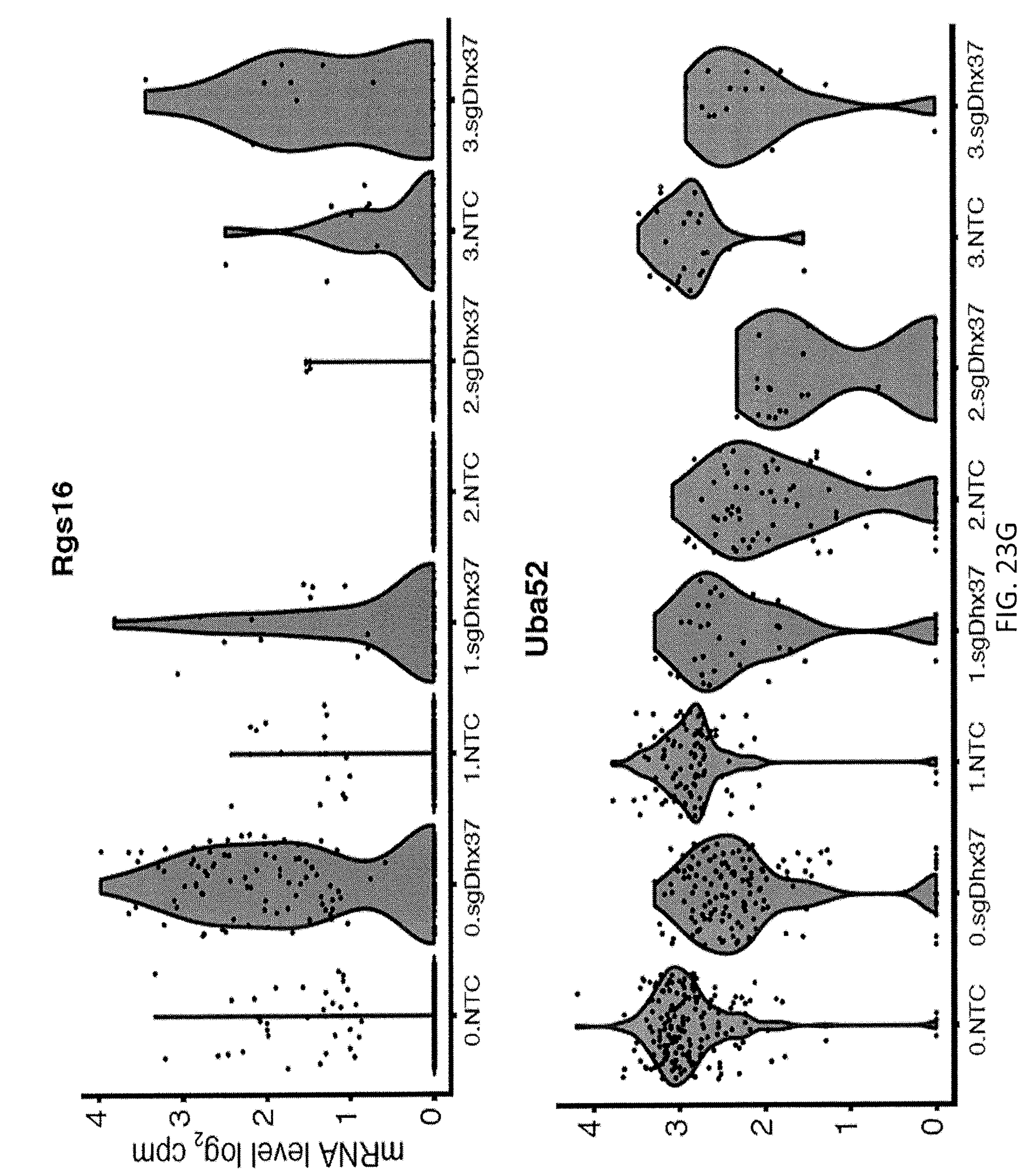

After processing, stringent filtering, and normalizing the raw scRNA-seq data, the final dataset was comprised of 552 cells (sgDhx37, n=191 cells; vector, n=361 cells), measuring a total of 8,244 expressed genes in TILs. t-SNE dimensional reduction was first performed to visualize the overall transcriptomic landscape of these cells (FIG. 23B). With this analysis 4 major clusters (k0 to k3) were uncovered as major subpopulations of these T cells based on their transcriptome (FIG. 23B). Differential expression analysis was subsequently performed between sgDhx37 and vector treated TILs, identifying sets of significantly upregulated and downregulated genes. 215 genes were significantly downregulated in sgDhx37 TILs, while 137 genes were significantly upregulated (Benjamini-Hochberg adjusted $p<0.05$) (FIGS. 23C-23D), with the mostly highly upregulated genes as Rgs16, Tox and Nr4a2 (FIG. 23D). Rgs16 was found as an IL-2-dependent activation gene in human T lymphocytes, and is enriched in activated/effector T cells. Nr4a2 is a nuclear receptor essential for thymic regulatory T cell ($T_{reg}$) development and homeostasis, and associated with T cell activation, although its specific function in $CD8^+$ T cell or TILs is not well characterized. Tox encodes a HMG box protein involved in both $CD8^+$ and $CD4^+$ T cell development, to some degree without the requirement of MHC-TCR interactions. Other significantly upregulated genes included known immune-related genes such as Eomes, Nr4a3, Lag3, Ccl4, Ifnar1, and Ikzf2, as well as genes with less knowledge in $CD8^+$ T cells or TILs (FIG. 23D). Collectively as a gene set, gene ontology analysis revealed multiple immune-related pathways that were significantly upregulated in sgDhx37 TILs (adjusted $p<0.05$), including lymphocyte activation, positive regulation of cytokine production, regulation of cell-cell adhesion, regulation of immune effector process, and positive regulation of interferon-gamma production (FIG. 23E). Somewhat intriguingly, sgDhx37 upregulated genes also include genes involved in negative regulation of leukocyte activation such as Ctla4 and Pdcd1, albeit to a lesser extent, which mirrors the positive correlation of T cell cytotoxic scores with these markers in TILs from human melanoma patients. Lag3, Ctla4 and Pdcd1 are T cell activation-induced markers, with their blockade improving antitumor activity, but their presence does not inhibit adoptive cell transfer therapy. Lag3 is expressed at a high level together with Rgs16, Nr4a2 and Tox, while Ctla4 and Pdcd1 are expressed at a lower level together with the other immune activating transcripts. On the other hand, downregulated genes in sgDhx37 TILs are enriched in ribosomal small subunit assembly and ribosomal large subunit biogenesis (FIG. 23F), consistent with the hypothesized role of human DHX37 protein in rRNA modification and processing in the nucleus and cytosol (UniProtKB—Q8IY37). The top upregulated gene (Rgs16) and downregulated gene (Uba52) are consistently upregulated or downregulated in each of the 4 clusters (FIG. 23G). Taken together, the scRNAseq data revealed significant changes in the transcriptomes of sgDhx37 TILs in the heterogeneous tumor microenvironment at the single-cell level.

Example 11: Investigation of DHX37 in Human

Figure 24A:
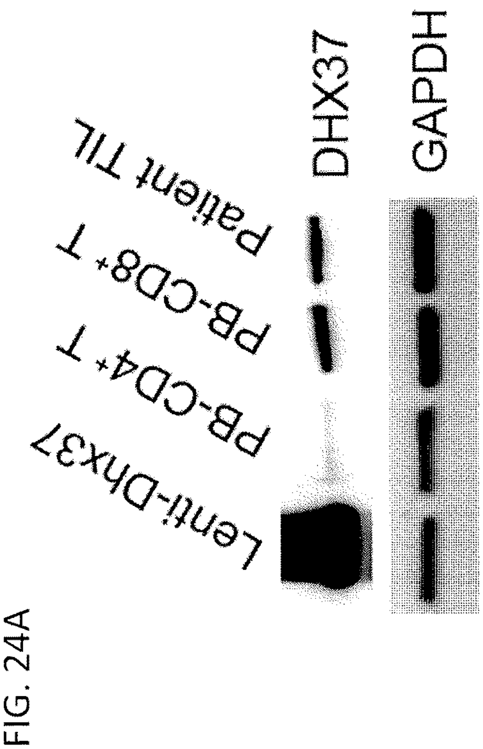
FIGS. 24A-24E are a series of plots and images illustrating analysis of DHX37 in human cells.
Figure 24B:
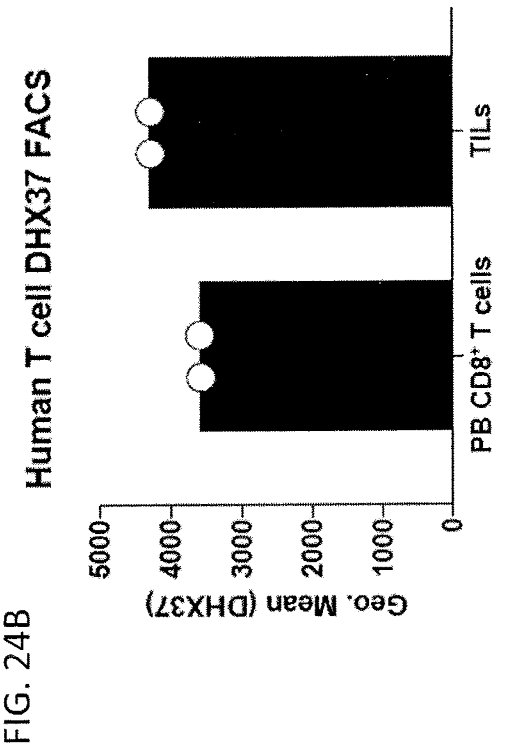
Figure 24C:
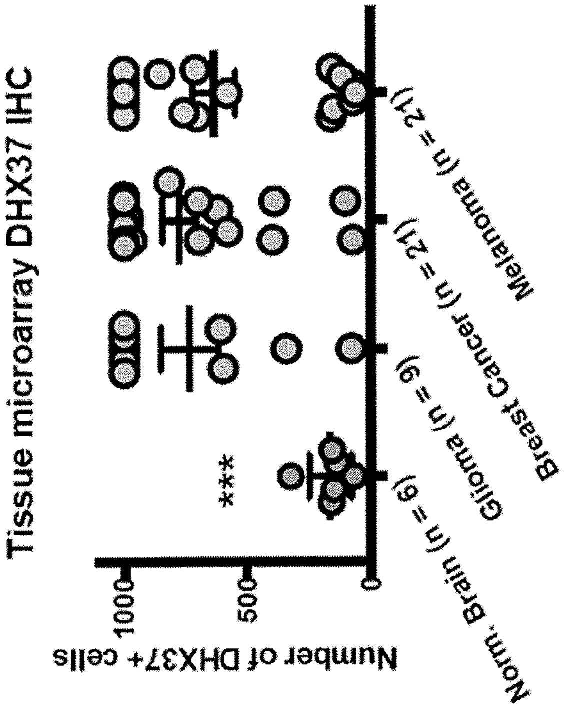
Figure 24D:
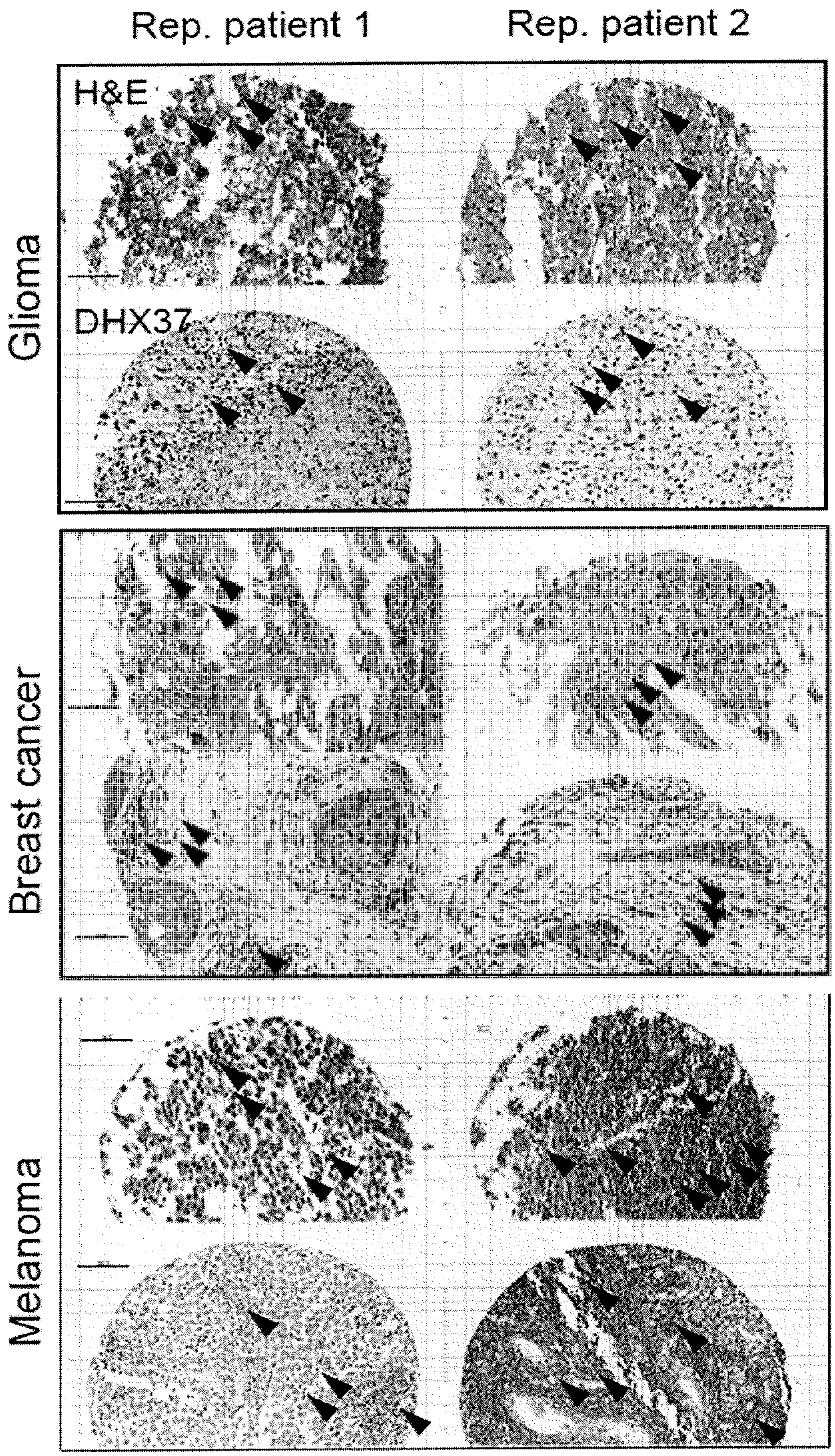
Figure 24E:
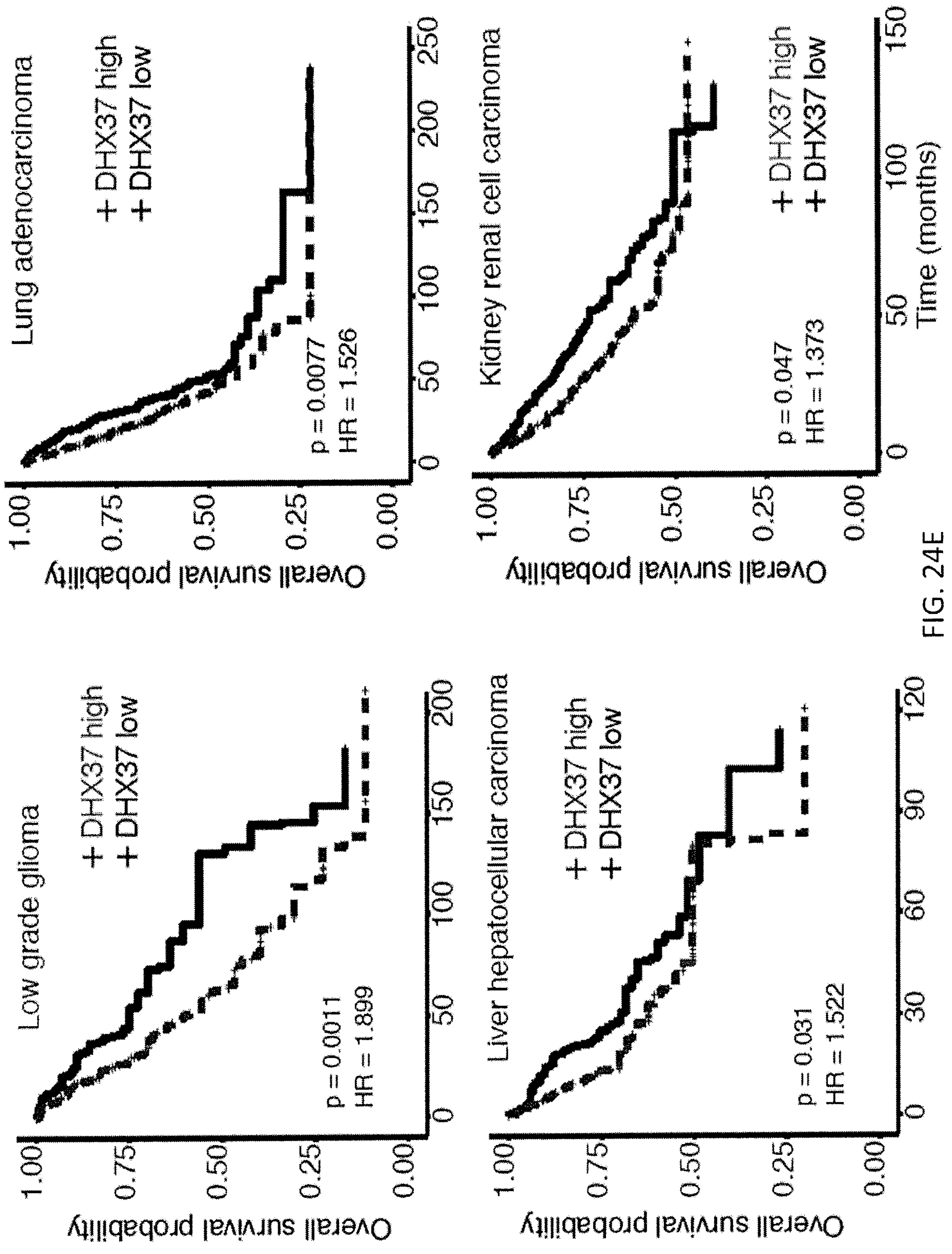

Human DHX37 is expressed in most organs, with highest expression in lymphoid tissues such as the bone marrow, lymph nodes, spleen and appendix. To examine the relevant roles of DHX37 in human T cells, its endogenous expression at the protein level was assayed. A lentiviral overexpression vector was generated as a positive control. The presence of DHX37 protein was detected in human peripheral blood (PB) $CD8^+$ and $CD4^+$ T cells, as well as TILs from a lung cancer patient (FIG. 24A). This finding was further corroborated using intracellular staining and FACS analysis (FIG. 24B). To analyze DHX37 expression at a spatial level, available tissue microarrays (TMAs) were retrieved for several cancer types including glioma, breast cancer and melanoma. H&E staining as well as immunohistochemistry (IHC) staining was performed for DHX37. A significantly higher level of $DHX37^+$ cells in glioma was observed as compared to normal brain tissues (unpaired t-test, two-sided, $p<0.001$) (FIG. 24C). Breast cancer and melanoma tumor samples also had high numbers of $DHX37^+$ cells at a comparable level to glioma, while matched normal tissues were not available for breast cancer and melanoma for these TMAs (FIG. 24C). Various populations of TILs were observed in all three cancer types (FIG. 24D). DHX37 is primarily localized in the nucleus, with strong staining at nuclear membranes (FIG. 24D). Importantly, with available patient survival data from TCGA, that high-DHX37 level was found to be linked to poor survival across multiple cancer types including glioma, liver hepatocellular carcinoma, lung adenocarcinoma and kidney renal cell carcinoma (FIG. 24E). These data together point to DHX37's expression in human T cells, patient TILs and prognostic relevance.

Figure 25A:
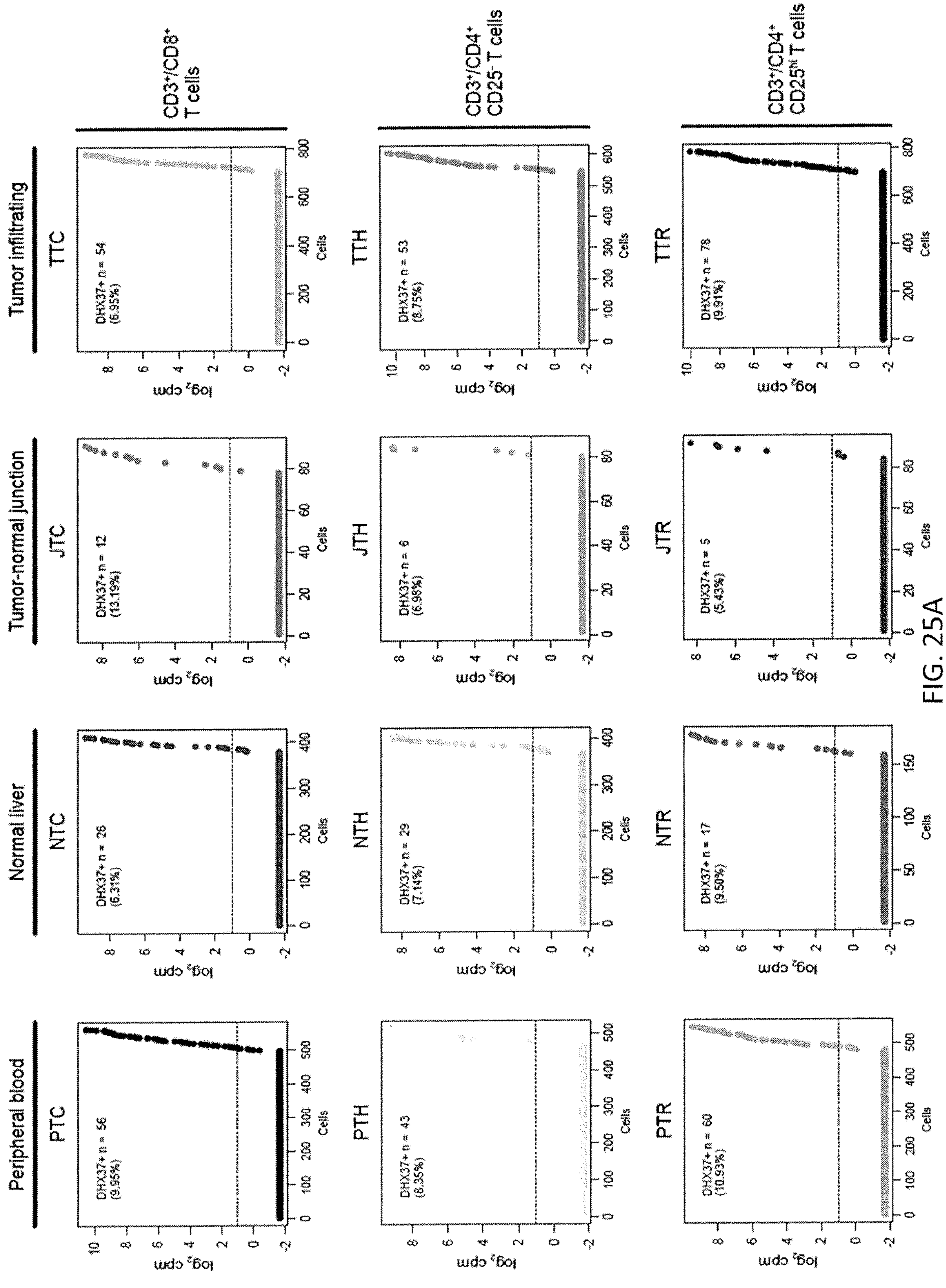
FIGS. 25A-25E are a series of plots illustrating gene expression signature of DHX37 in populations of single human T cells.
Figure 25B:
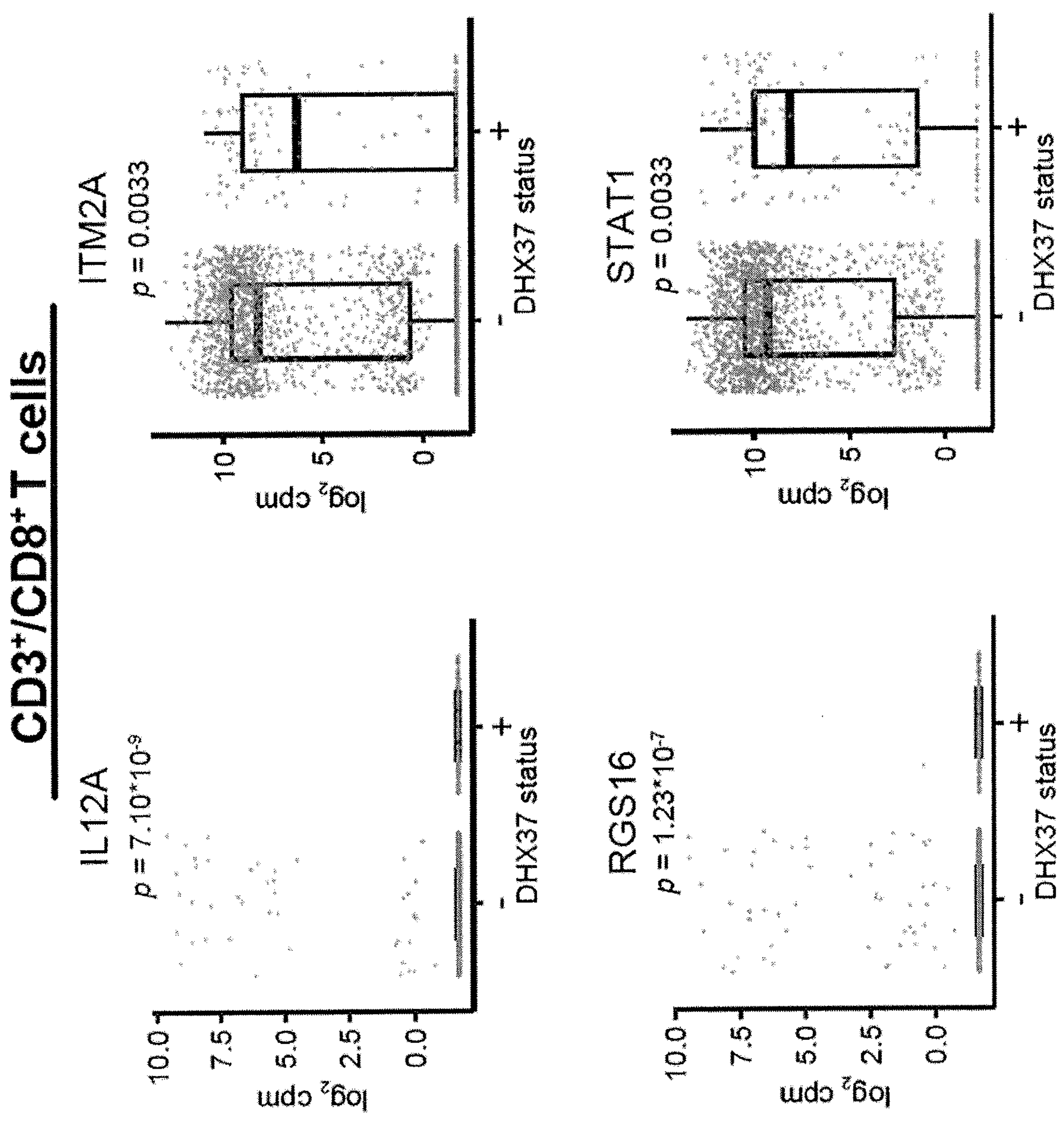
Figure 25C:
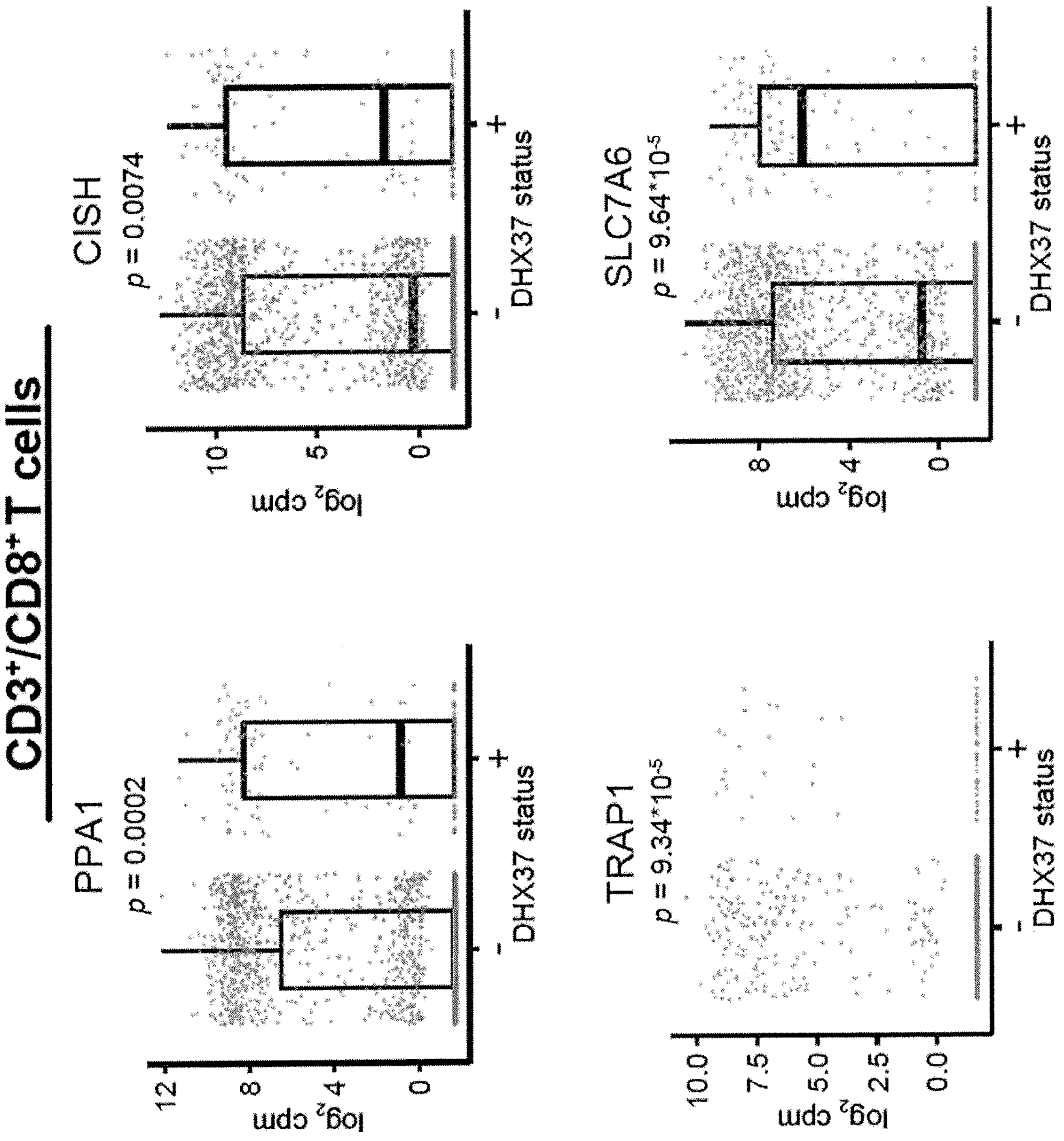
Figure 25D:
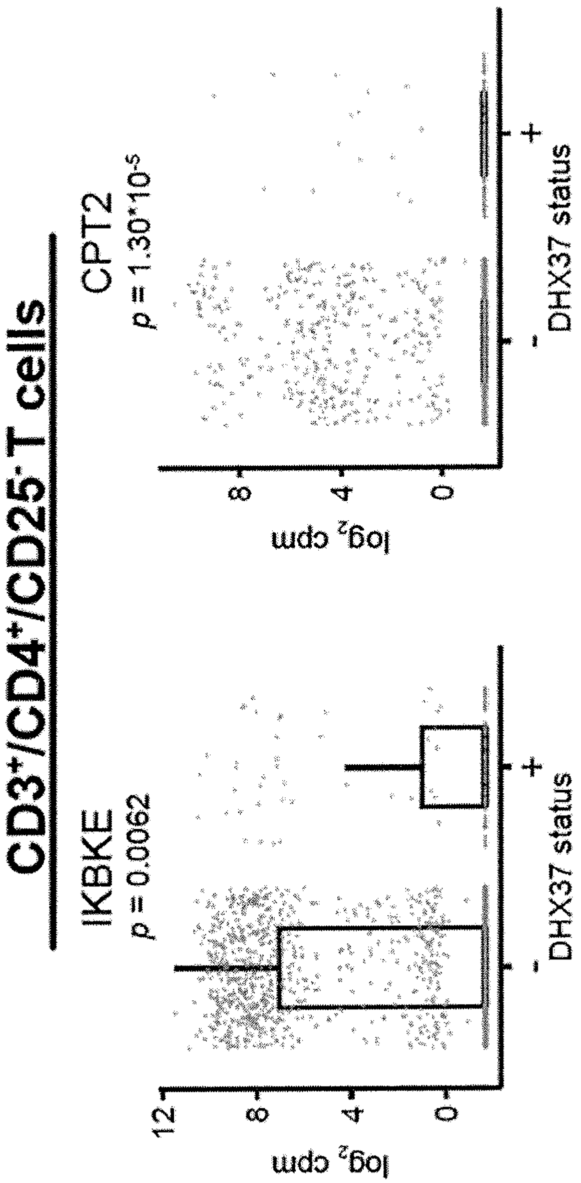
Figure 25E:
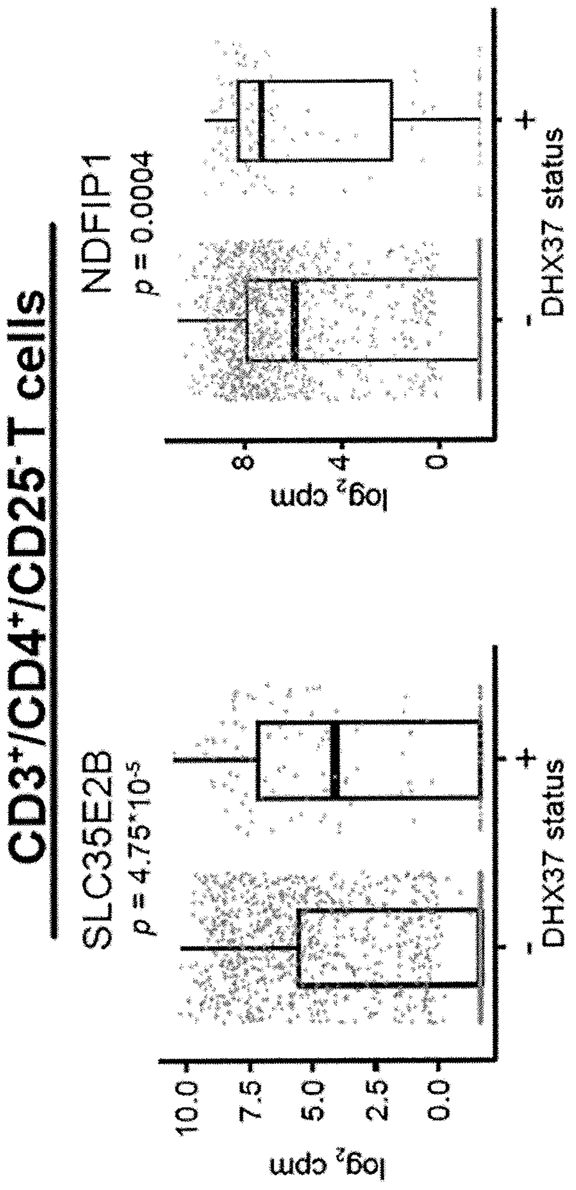

To further explore the signature of DHX37 in human T cells, a recent single-cell transcriptomics dataset of human TILs was analyzed. DHX37 expression was detected in a fraction of peripheral blood T cells, tissue-resident T cells and tumor-infiltrating T cells (FIG. 25A). DHX37 was expressed in $CD3^+/CD8^+$ (cytotoxic T cell), $CD3^+/CD4^+/CD25^-$ (T helper cell), and $CD3^+/CD4^+/CD25^+$ (Treg) populations (FIG. 25A). In the subpopulation of cells that express relatively higher level of DHX37 ($DHX37^+$ T cells), a variety of genes were differentially expressed compared to those expressing lower or undetectable levels ($DHX37^-$ T cells). Interestingly, $DHX37^+$ cytotoxic T cells downregulate multiple immune genes with documented roles in cytotoxicity, T cell activation, cytokine-mediated cell signaling, regulatory function and anti-cancer immunity, including IL12A, ITM2A, RGS16, and STAT1 (Fig. S9b), again consistent with our mouse TIL scRNA-seq. Genes that were more highly expressed in $DHX37^+$ cells included PPA1, CISH, TRAP1, and SLC7A6 (FIG. 25C). In $CD3^+/CD4^+/CD25^-$ helper T cells, the expression of genes such as IKBKE and CPT2 was significantly lower in $DHX37^+$ cells, while SLC35E2B and NDFIP1 are significantly lower (FIG. 25D-25E). Collectively, the analysis of human T cell scRNAseq data revealed signatures of gene expression changes in $DHX37^+$ vs. $DHX37^-$ T cells. Many of these differentially expressed genes have known roles in T cells, suggesting that natural cell population-wide variation in DHX37 expression may influence the function of human T cells.

Figure 26A:
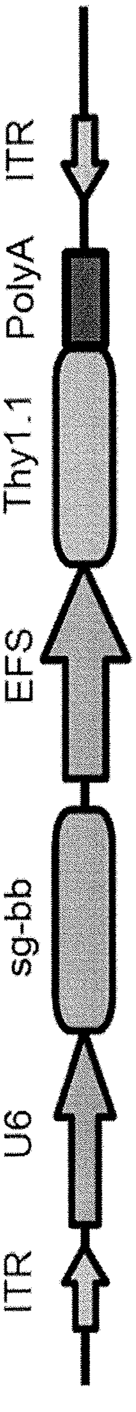
FIGS. 26A-26F are a series of plots and images illustrating development of a new AAV-CRISPR system and integrated interrogation of acute Dhx37 loss in $CD8^+$ $T_{eff}$ cells.
Figure 26B:
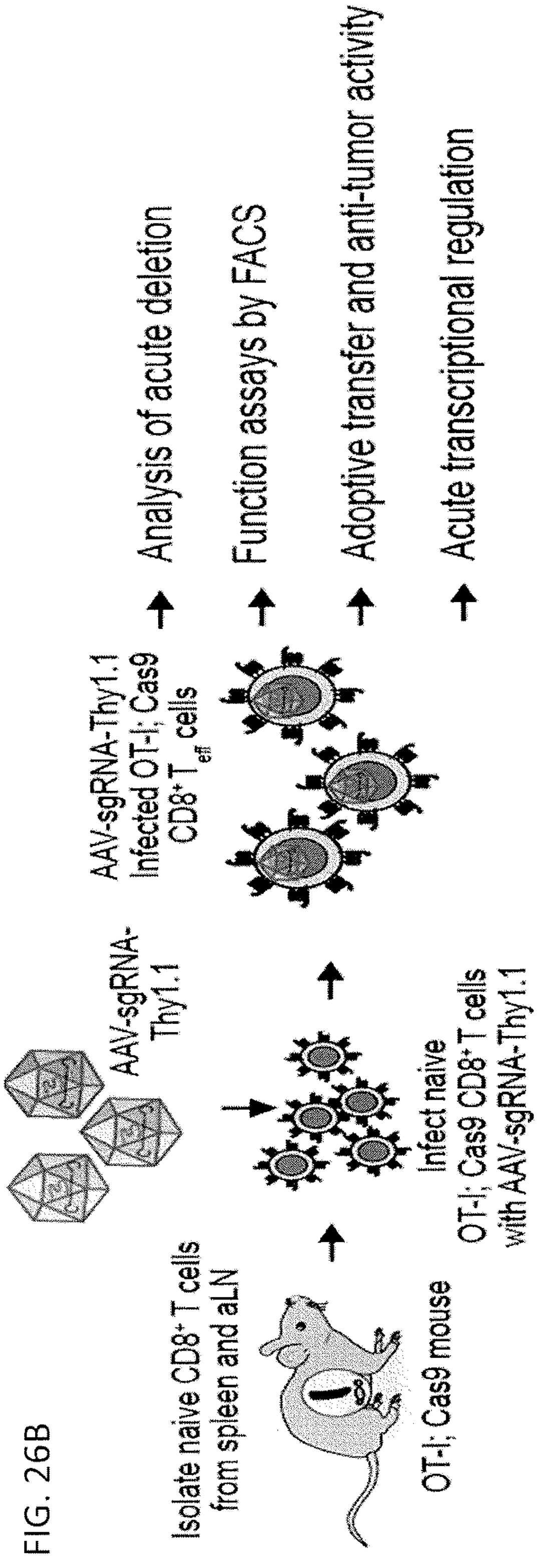
Figure 26C:
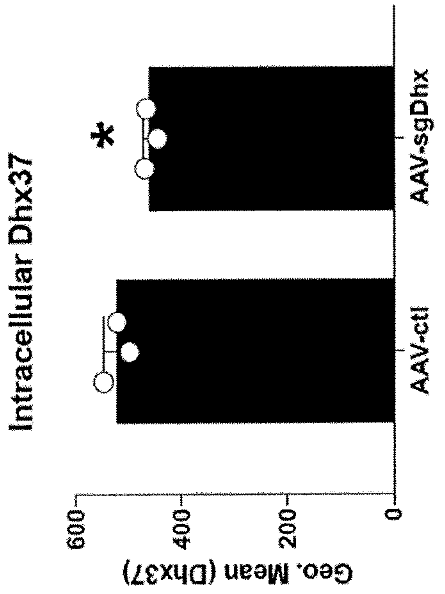
Figure 26D:
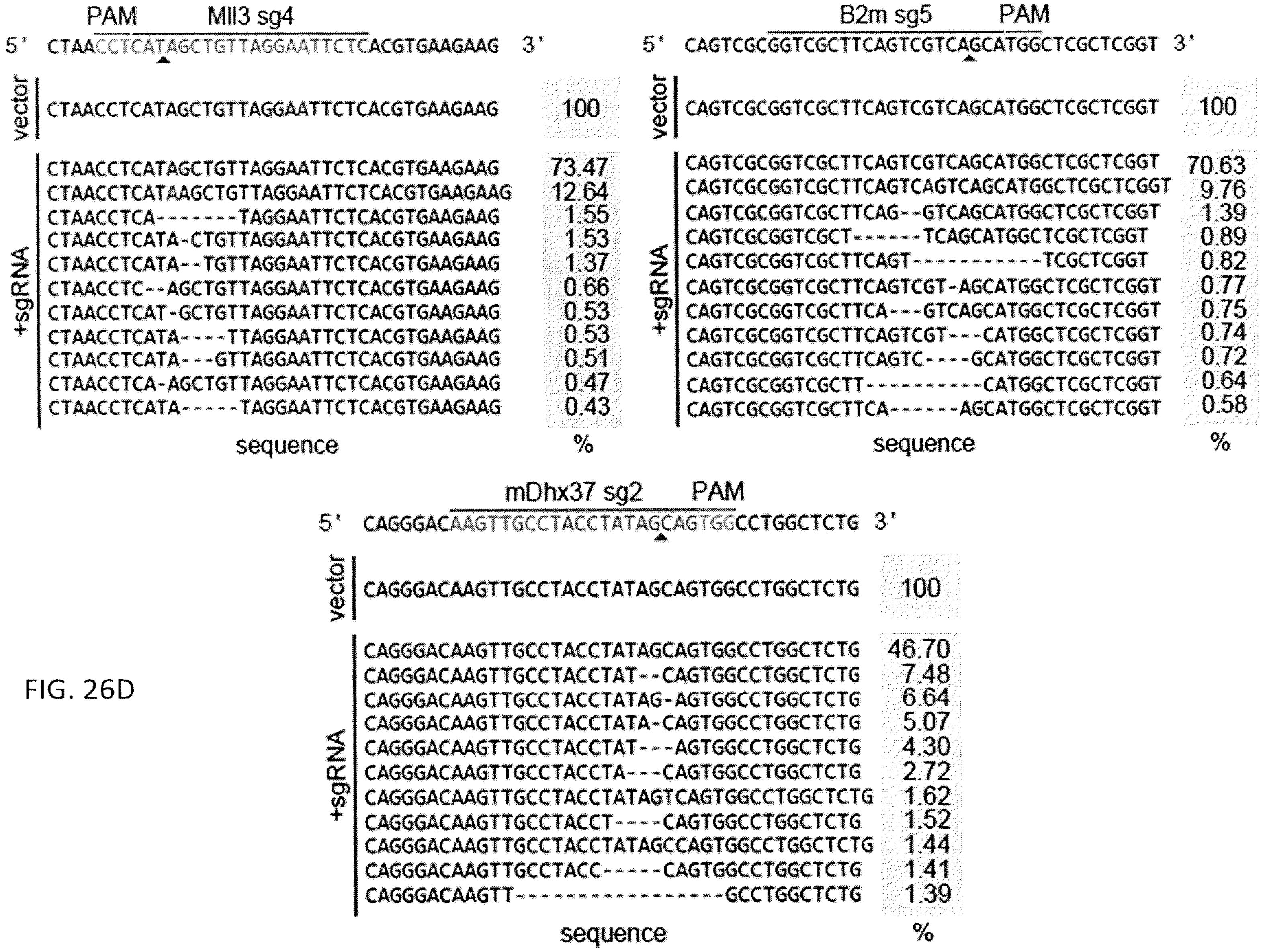
Figure 26F:
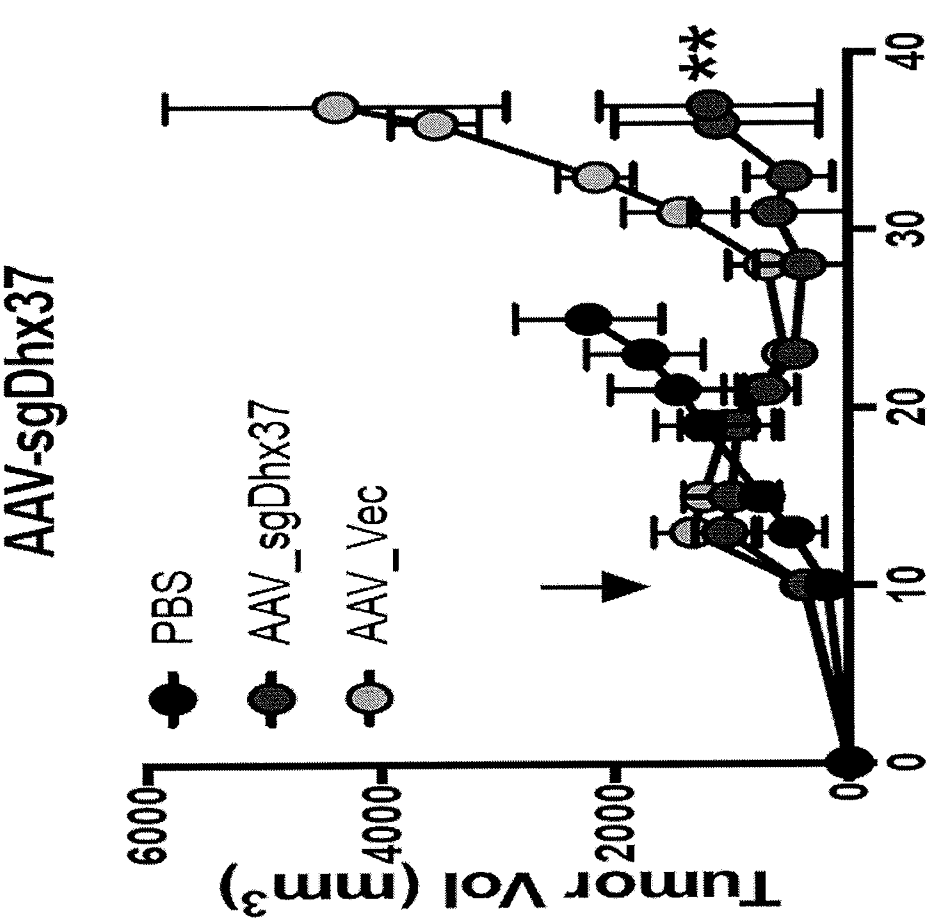
Figure 26E:
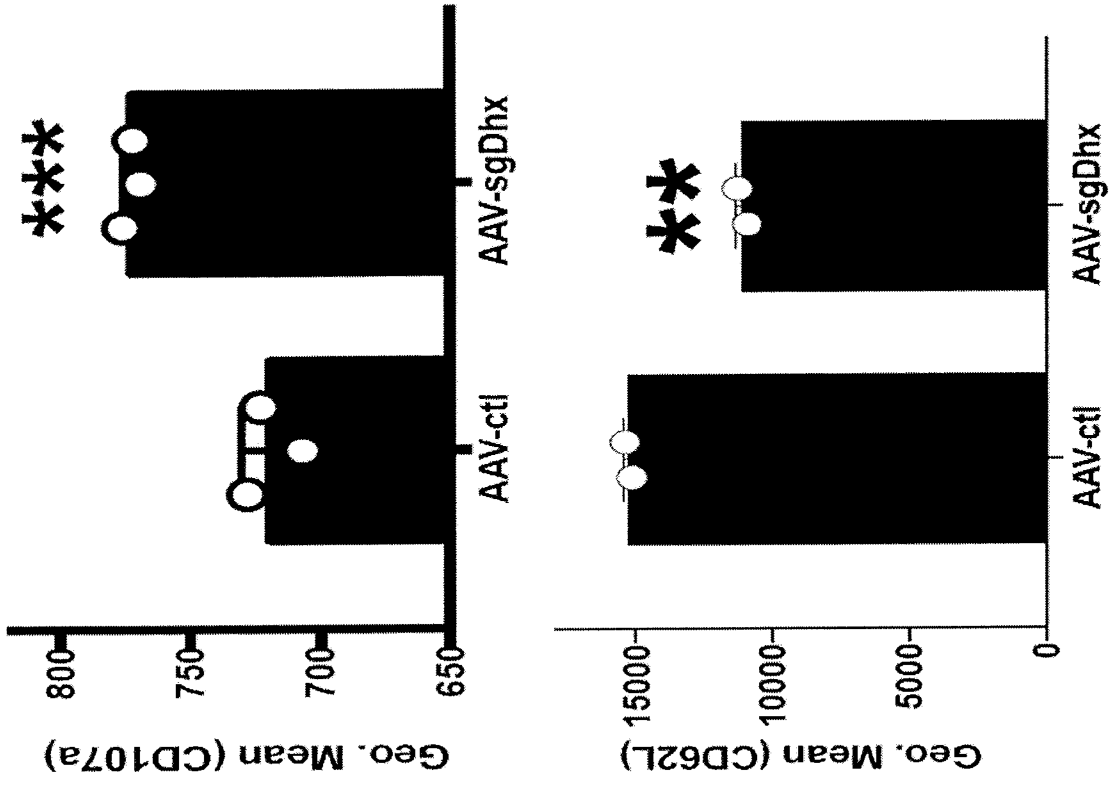

Example 12: Investigation of Acute Dhx37 Loss in $CD8^+$ $T_{eff}$ Cells with AAV-CRISPR Mediated T Cell Gene Editing The function of Dhx37 was further investigated directly in cultured $CD8^+$ T cells. Because mouse primary $CD8^+$ T cells are challenging for long-term culture as the majority of cells undergo apoptosis after day 7 in culture, adeno-associated virus (AAV) was adopted as a vehicle for gene editing in primary $CD8^+$ T cells. A new AAV CRISPR vector capable of targeting primary T cells was generated (FIG. 26A). OT-I; Cas9 $CD8^+$ $T_{eff}$ cells were isolated and infected with AAV-sgRNA-Thy1.1 vectors, then molecular and functional analyses were performed upon acute Dhx37 loss, in addition to gene regulation and anti-tumor activities (FIG. 26B). It was demonstrated that AAV-sgDhx37 as well as AAV-sgMll3 and AAV-sgB2m potently mutagenized the targeted loci 5 days after in vitro culture (FIG. 26D). This observation is corroborated with reduction of intracellular Dhx37 protein level (FIG. 26C). The partial knockdown is likely due to Dhx37 protein stability at this time point, as well as that not all indels lead to effective loss-of-protein. As compared to vector control, AAV-sgDhx37 treated OT-I; Cas9 $CD8^+$ $T_{eff}$ cells had significantly increased levels of surface CD107a when co-cultured with cognate SIINFEKL-pulsed E0771 cancer cells (t test, two sided, p=0.001, FIG. 26E), which further validated the kill assay screen. AAV-sgDhx37 treated OT-I; Cas9 $CD8^+$ $T_{eff}$ cells also showed decreased levels of CD62L (FIG. 26E). Adoptive transfer of AAV-sgDhx37 treated OT-I; Cas9 $CD8^+$ $T_{eff}$ cells significantly enhanced the anti-tumor activity in vivo as compared to AAV-vector (FIG. 26F). These experiments established AAV-CRISPR as an independent system for potent and acute T cell gene editing, further elucidated the cellular phenotypes of acute loss of Dhx37, and validated the anti-tumor effect of Dhx37 blockade in T cells.

Figure 27D:
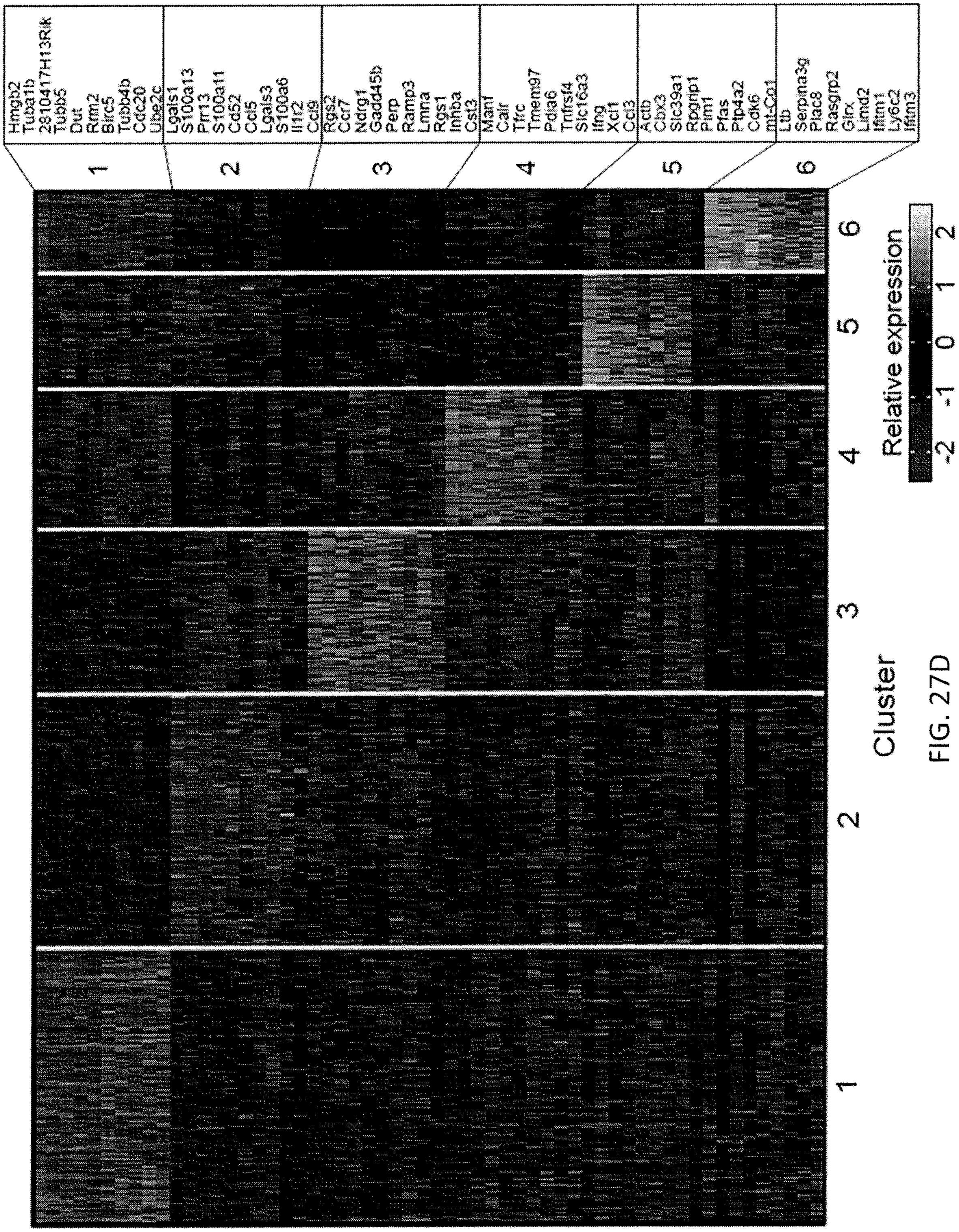
Figure 27E:
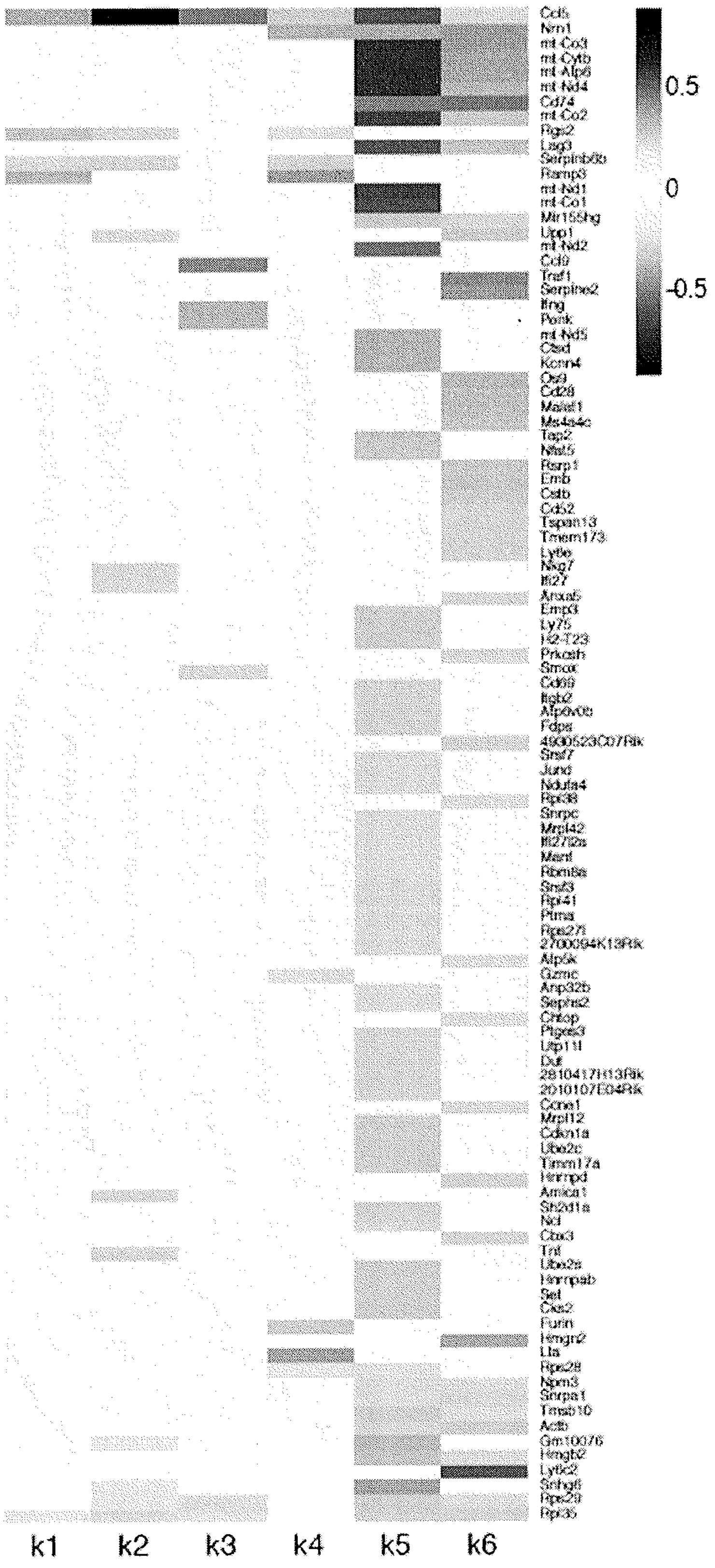
Figure 27F:
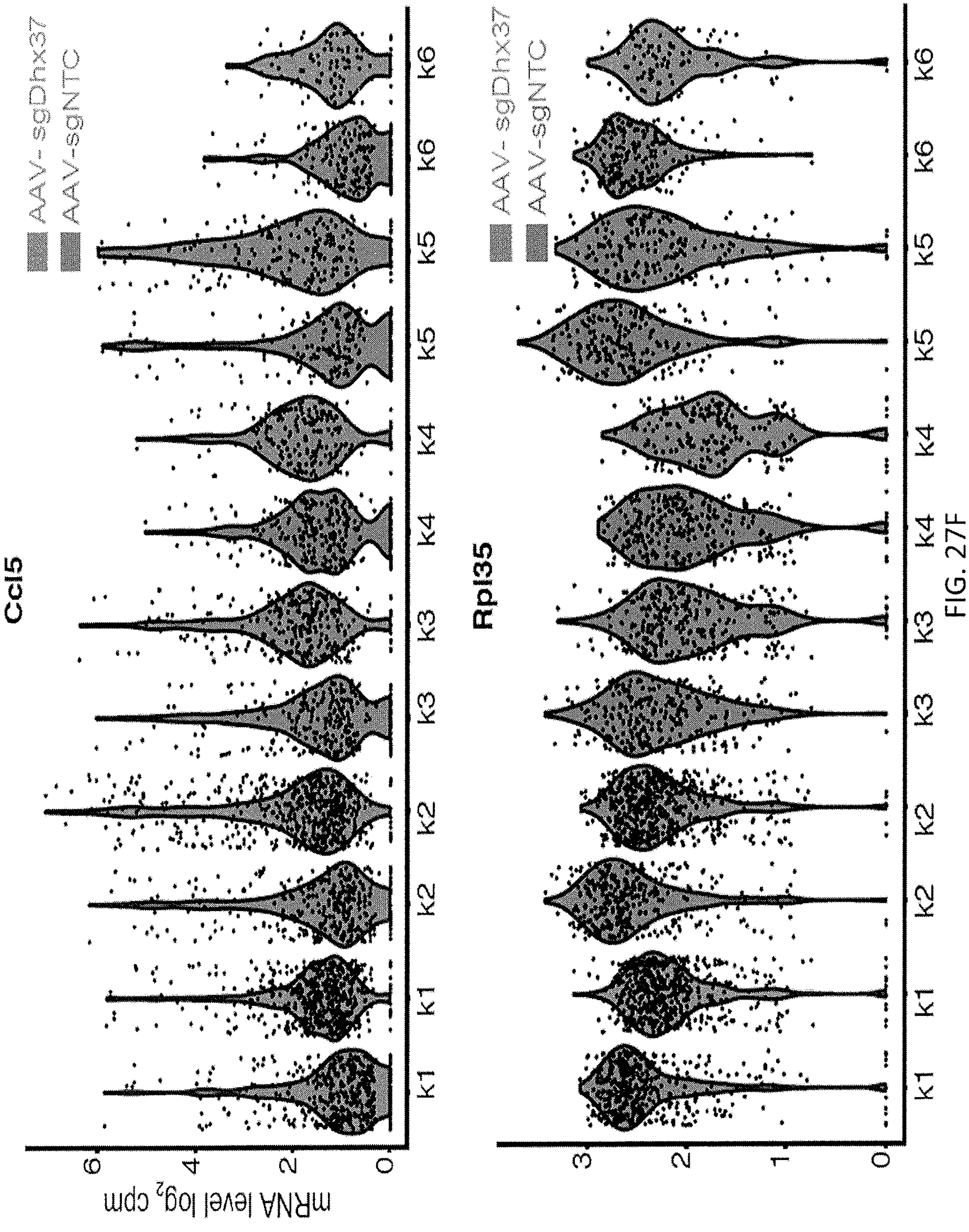
Figure 28A:
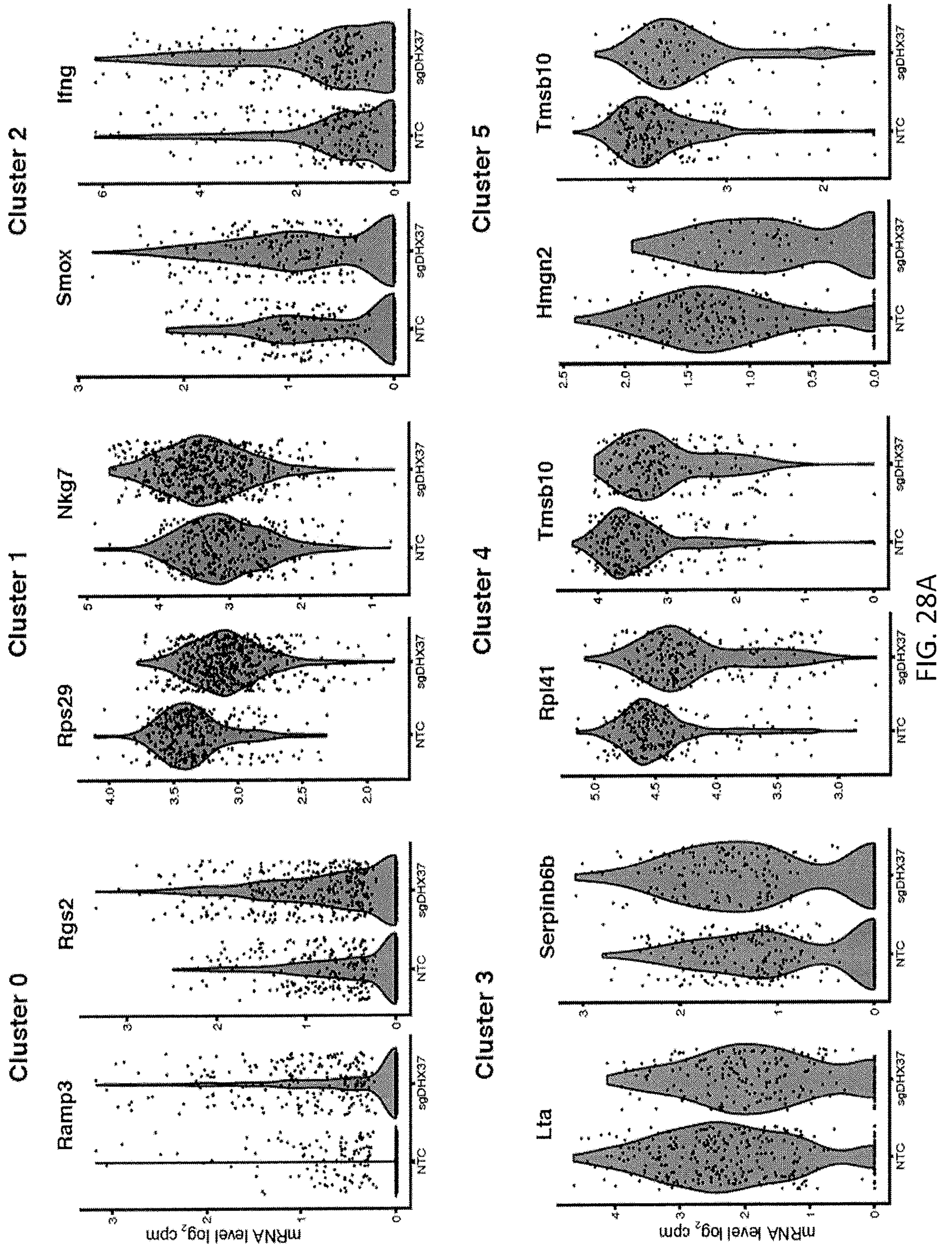
FIGS. 28A-28C shows additional analysis of gene regulation upon Dhx37 loss in mouse and human $CD8^+$ cells.
Figures 28B, 28C:
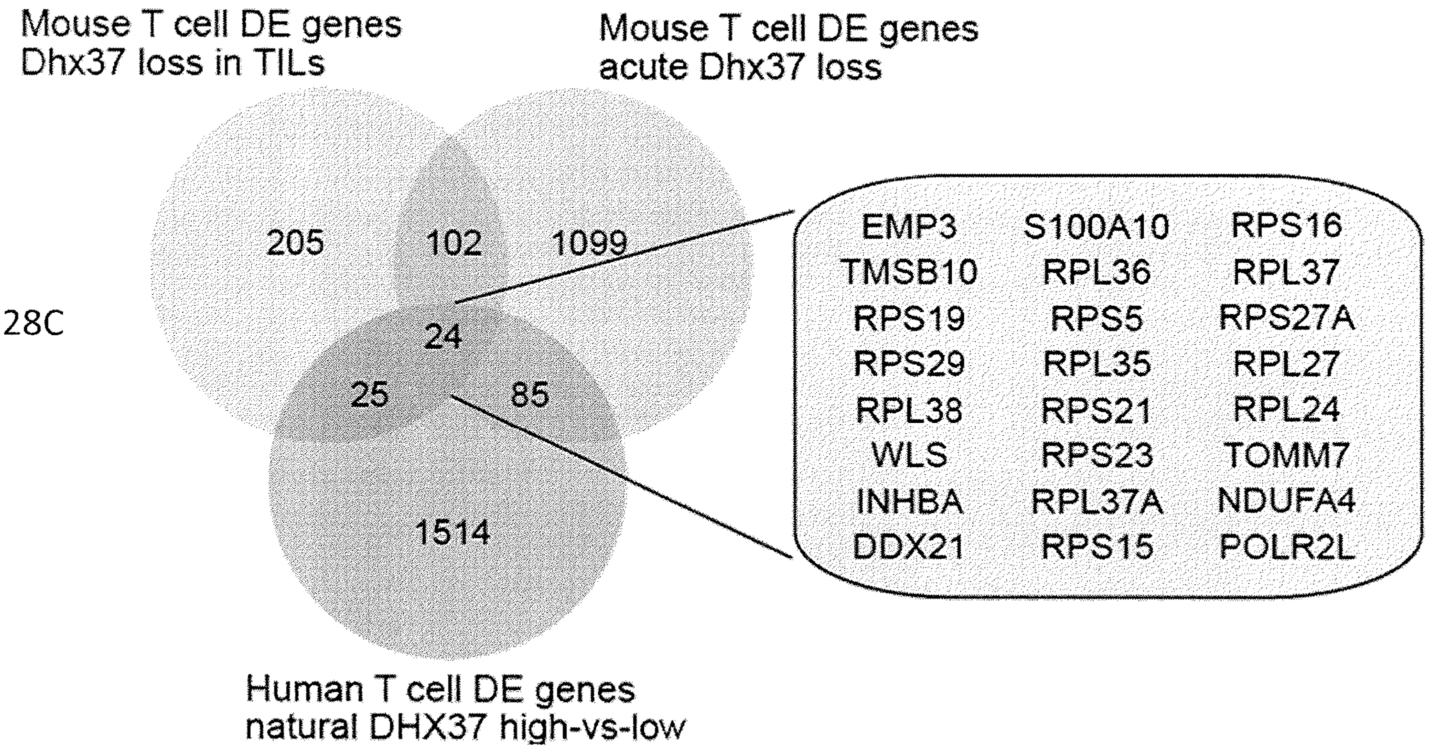

AAV-sgDhx37 generated a mixture of mutants at Dhx37 locus and mouse primary T cells do not grow as single cell clones. Thus, to better understand the transcriptional changes upon acute Dhx37 loss in a heterogeneous T cell population at a more refined resolution, single cell transcriptome profiling was again performed, with a much larger set of cells (establishing knockouts in in vitro culture eliminates the barrier of low availability of $CD8^+$ T cells as TILs). A total of 1,883 AAV-sgDhx37 treated OT-I; Cas9 $CD8^+$ $T_{eff}$ cells were profiled 6 days post infection, in parallel with 1,735 AAV-sgNTC treated ones (FIG. 27A). Dimension reduction analysis showed 6 major clusters for these cells (FIG. 27B). Each cluster was represented by a distinct gene signature (FIG. 27D), revealing a substantial level of transcriptomic heterogeneity even with T cells of clonal TCR (in both AAV-sgNTC and AAV-sgDhx37). Intriguingly, AAV-sgDhx37 $CD8^+$ T cells are enriched in cluster 2 but depleted in clusters 4 and 6 (hypergeometric test, $p<0.001$) (FIG. 27C). Differential expression analysis was performed in all 6 clusters with sufficient cell numbers to provide statistical power in each one, and a panel of genes deregulated upon acute Dhx37 loss was unveiled (FIG. 27E). There are a small number of genes consistently deregulated across all clusters, with a larger number of cluster-specific differentially regulated genes (FIG. 27E). For example, Ccl5 is significantly upregulated upon acute Dhx37 loss in all 6 clusters, and Rpl35 is significantly downregulated in 5/6 clusters (FIG. 27F). Multiple genes were found to be differentially regulated only in specific clusters (e.g. Rgs2, Lag3, Ifng, Ramp3, Rps29, Nkg7, Smox, Lta, Serpinb6b, Rpl41, Tmsb10, Hmgn2, Npm3 and Ly6c2) (FIG. 27E, FIG. 28A), reflecting sub-population specific dynamic gene regulation across a heterogeneous cell population. The upregulated genes upon acute Dhx37 loss are also highly enriched in the gene set categories involving immune function (FIG. 28B), while the downregulated gene sets are ribosomal components. Although under different experimental settings, the differentially regulated genes upon Dhx37 loss by three different kinds of mechanisms, lenti-CRISPR mediated perturbation in mouse TILs, AAV-CRISPR mediated acute loss in culture, and naturally low-expression population in human T cells, converged on a total of 24 genes (FIG. 28C).

Example 13: Demonstration of Gene Editing in Human T Cells

Figure 29:
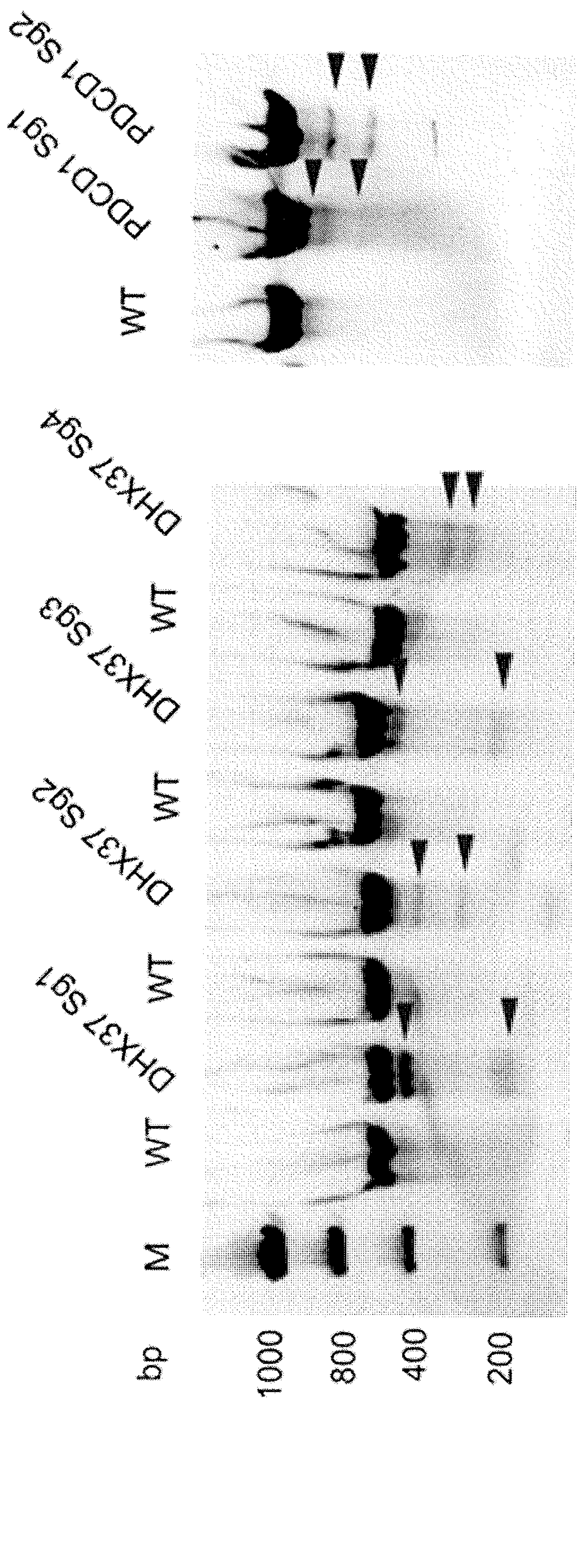
FIG. 29 is an image illustrating gene editing in human T cells with the vectors of the present invention. Surveyor assay of human DHX37 gene (3 independent sgRNAs) and PDCD1 gene (2 independent sgRNAs). The arrows point to cleavage product bands as a result of on-target gene editing in human T cells.

Gene editing was performed in human T cells using the compositions and methods of the present invention (FIG. 29). Results from a Surveyor assay of human DHX37 gene (3 independent sgRNAs) and PDCD1 gene (2 independent sgRNAs) are shown in FIG. 29. The arrows pointed to cleavage product bands as a result of on-target gene editing in human T cells.

Example 14

Herein, genome editing was coupled to high-throughput screening approaches and directly applied to systematically study the trafficking and survival of $CD8^+$ T cells in vivo, both in physiological and pathological (cancer) settings. Although the data presented herein focused on $CD8^+$ T cells, this approach can readily be applied to study $CD4^+$ T helper cells and regulatory T cells ($T_{reg}$). The present cancer immunotherapy model was developed based on orthotopic transplantation of breast cancer cells followed by adoptive transfer of CRISPR-targeted $CD8^+$ $T_{eff}$ cells, while a variety of cancer models such as genetically engineered mouse models and genome-editing based cancer models are all possible alternatives. Direct high-throughput genetic manipulation of T cells in vivo without adoptive transfer should render direct mutagenesis of the T cell population feasible.

$CD8^+$ T cells play fundamental roles in the adaptive immune response mounted against intracellular pathogens and tumors, with a central role in the cancer-immune response. Herein, high-throughput in vivo CRISPR screens were performed in $CD8^+$ $T_{eff}$ cells in wildtype animals and in a setting of immunotherapy, which generated genome-scale maps of genetic factors modulating the trafficking and survival of in $CD8^+$ cytotoxic T cells in the presence and absence of known antigens, and identified enriched genes belonging to various functional categories including multiple that were not documented in literature. This study demonstrates a new approach for high-throughput genetic interrogation of T cells in vivo, which can be broadly applied for diverse studies in immunology and immunotherapy.

Other Embodiments

The recitation of a listing of elements in any definition of a variable herein includes definitions of that variable as any single element or combination (or subcombination) of listed elements. The recitation of an embodiment herein includes that embodiment as any single embodiment or in combination with any other embodiments or portions thereof.

The disclosures of each and every patent, patent application, and publication cited herein are hereby incorporated herein by reference in their entirety. While this invention has been disclosed with reference to specific embodiments, it is apparent that other embodiments and variations of this invention may be devised by others skilled in the art without departing from the true spirit and scope of the invention. The appended claims are intended to be construed to include all such embodiments and equivalent variations.

---

SEQUENCE LISTING (140898 sequences)

SEQ ID NO: 1 - RNA, 20 nt, Artificial Sequence
  MKO10000001_A_0610007P14Rik
  gRNA
uccugaauguguuacgaagc

SEQ ID NO: 2 - RNA, 20 nt, Artificial Sequence
  MKO10000002_A_0610007P14Rik
  gRNA
ggucgggcuccgguaccuag

SEQ ID NO: 3 - RNA, 20 nt, Artificial Sequence
  MKO10000003_A_0610007P14Rik
  gRNA
gccagcuucguaacacauuc

SEQ ID NO: 4 - RNA, 20 nt, Artificial Sequence
  MKO10000004_A_0610009B22Rik
  gRNA
ucaucaugcugcaugacgug

SEQ ID NO: 5 - RNA, 20 nt, Artificial Sequence
  MKO10000005_A_0610009B22Rik
  gRNA
auucaaugagugguucgucu

SEQ ID NO: 6 - RNA, 20 nt, Artificial Sequence
  MKO10000006_A_0610009B22Rik
  gRNA
ucgucacggcugggcacaug

SEQ ID NO: 7 - RNA, 20 nt, Artificial Sequence
  MKO10000007_A_0610009D07Rik
  gRNA
uacacucugauuugacgaau

SEQ ID NO: 8 - RNA, 20 nt, Artificial Sequence
  MKO10000008_A_0610009D07Rik
  gRNA
uacaaaauccgauuuacuuc

SEQ ID NO: 9 - RNA, 20 nt, Artificial Sequence
  MKO10000009_A_0610009D07Rik
  gRNA
aacagccuauguggucuaug

SEQ ID NO: 10 - RNA, 20 nt, Artificial Sequence
  MKO10000010_A_0610009O20Rik
  gRNA
auggcgucccgcaguguguu

SEQ ID NO: 11 - RNA, 20 nt, Artificial Sequence
  MKO10000011_A_0610009O20Rik
  gRNA
cugugccaagagcguucagc

SEQ ID NO: 12 - RNA, 20 nt, Artificial Sequence
  MKO10000012_A_0610009O20Rik
  gRNA
uggguuugggcguuauccca

SEQ ID NO: 13 - RNA, 20 nt, Artificial Sequence
  MKO10000013_A_0610010B08Rik
  gRNA
uauagcugugagauucuuau

SEQ ID NO: 14 - RNA, 20 nt, Artificial Sequence
  MKO10000014_A_0610010B08Rik
  gRNA
cgugcaugugaacuucacuc

SEQ ID NO: 15 - RNA, 20 nt, Artificial Sequence
  MKO10000015_A_0610010B08Rik
  gRNA
gacuucuagaaguuugaaaa

SEQ ID NO: 16 - RNA, 20 nt, Artificial Sequence
  MKO10000016_A_0610010F05Rik
  gRNA
aacuguacugcucguaaugc

SEQ ID NO: 17 - RNA, 20 nt, Artificial Sequence
  MKO10000017_A_0610010F05Rik
  gRNA
gauugugagauucccgcuuu

SEQ ID NO: 18 - RNA, 20 nt, Artificial Sequence
  MKO10000018_A_0610010F05Rik
  gRNA
gaaacuguaucuugaucaac

SEQ ID NO: 19 - RNA, 20 nt, Artificial Sequence
  MKO10000019_A_0610010K14Rik
  gRNA
ggcgccgccuucacgaagcu

SEQ ID NO: 20 - RNA, 20 nt, Artificial Sequence
  MKO10000020_A_0610010K14Rik
  gRNA
caacuccccgagcuucguga

SEQ ID NO: 21 - RNA, 20 nt, Artificial Sequence
  MKO10000021_A_0610010K14Rik
  gRNA
cuugguggacgcugacguca

SEQ ID NO: 22 - RNA, 20 nt, Artificial Sequence
  MKO10000022_A_0610011F06Rik
  gRNA
gaucuucccauugacggcau

SEQ ID NO: 23 - RNA, 20 nt, Artificial Sequence
  MKO10000023_A_0610011F06Rik
  gRNA
guacagcggagccuucacau

SEQ ID NO: 24 - RNA, 20 nt, Artificial Sequence
  MKO10000024_A_0610011F06Rik
  gRNA
cggcaucccaccccgaucgc

SEQ ID NO: 25 - RNA, 20 nt, Artificial Sequence
  MKO10000025_A_0610012H03Rik
  gRNA
agcgagccgaagauccccac

SEQ ID NO: 26 - RNA, 20 nt, Artificial Sequence
  MKO10000026_A_0610012H03Rik
  gRNA
aguacacagcguuguucacg

SEQ ID NO: 27 - RNA, 20 nt, Artificial Sequence
  MKO10000027_A_0610012H03Rik
  gRNA
cuccaguguguguuaccgac

SEQ ID NO: 28 - RNA, 20 nt, Artificial Sequence
  MKO10000028_A_0610030E20Rik
  gRNA
uccgucggaaccagcucgau

SEQ ID NO: 29 - RNA, 20 nt, Artificial Sequence
  MKO10000029_A_0610030E20Rik
  gRNA
cggggcgguaccgaucgagc

SEQ ID NO: 30 - RNA, 20 nt, Artificial Sequence
  MKO10000030_A_0610030E20Rik
  gRNA
ccuccuggauucgcgaucug

SEQ ID NO: 31 - RNA, 20 nt, Artificial Sequence
  MKO10000031_A_0610031J06Rik
  gRNA
ugacagcaccaaugcguccg

SEQ ID NO: 32 - RNA, 20 nt, Artificial Sequence
  MKO10000032_A_0610031J06Rik
  gRNA
cugugcccccucggacgcau

SEQ ID NO: 33 - RNA, 20 nt, Artificial Sequence
  MKO10000033_A_0610031J06Rik
  gRNA
ggaguuccguucguucacug

SEQ ID NO: 34 - RNA, 20 nt, Artificial Sequence
  MKO10000034_A_0610037L13Rik
  gRNA
caggacagcguggcgcugaa

SEQ ID NO: 35 - RNA, 20 nt, Artificial Sequence
  MKO10000035_A_0610037L13Rik
  gRNA
ugagaaguucaagacgauag

SEQ ID NO: 36 - RNA, 20 nt, Artificial Sequence
  MKO10000036_A_0610037L13Rik
  gRNA
gugcacauagcuugcacuuc

SEQ ID NO: 37 - RNA, 20 nt, Artificial Sequence
  MKO10000037_A_0610040J01Rik
  gRNA
ccaguucaagugcccucgcc

SEQ ID NO: 38 - RNA, 20 nt, Artificial Sequence
  MKO10000038_A_0610040J01Rik
  gRNA
cccaucgugcagggcauucc

SEQ ID NO: 39 - RNA, 20 nt, Artificial Sequence
  MKO10000039_A_0610040J01Rik
  gRNA
agauaauccagauggggugc

SEQ ID NO: 40 - RNA, 20 nt, Artificial Sequence
  MKO10000040_A_mmuMarch1
  gRNA
gaucgacuugcagaucgccc

SEQ ID NO: 41 - RNA, 20 nt, Artificial Sequence
  MKO10000041_A_mmuMarch1
  gRNA
aucacacccugucgcugcac

SEQ ID NO: 42 - RNA, 20 nt, Artificial Sequence
  MKO10000042_A_mmuMarch1
  gRNA
caggcaagcagcccaacgac

SEQ ID NO: 43 - RNA, 20 nt, Artificial Sequence
  MKO10000043_A_mmuSep1
  gRNA
guuccucaccaaccucuacg

SEQ ID NO: 44 - RNA, 20 nt, Artificial Sequence
  MKO10000044_A_mmuSep1
  gRNA
cugccgauccucguagaggu

SEQ ID NO: 45 - RNA, 20 nt, Artificial Sequence
  MKO10000045_A_mmuSep1
  gRNA
uccucaaugaagcgaaccac

SEQ ID NO: 46 - RNA, 20 nt, Artificial Sequence
  MKO10000046_A_mmuMarch10
  gRNA
aagcgggucgucaugcaaac

SEQ ID NO: 47 - RNA, 20 nt, Artificial Sequence
  MKO10000047_A_mmuMarch10
  gRNA
acacuuagccgaagauguuu

SEQ ID NO: 48 - RNA, 20 nt, Artificial Sequence
  MKO10000048_A_mmuMarch10
  gRNA
uaggggugacuuaccauaug

SEQ ID NO: 49 - RNA, 20 nt, Artificial Sequence
  MKO10000049_A_mmuSep10
  gRNA
cucuacuucauugcuccgac

SEQ ID NO: 50 - RNA, 20 nt, Artificial Sequence
  MKO10000050_A_mmuSep10
  gRNA
cugucggagcaaugaaguag

SEQ ID NO: 51 - RNA, 20 nt, Artificial Sequence
  MKO10000051_A_mmuSep10
  gRNA
cauuauaccacuuauugcca

SEQ ID NO: 52 - RNA, 20 nt, Artificial Sequence
  MKO10000052_A_mmuMarch11
  gRNA
gacccuacgaugcgcuccag

SEQ ID NO: 53 - RNA, 20 nt, Artificial Sequence
  MKO10000053_A_mmuMarch11
  gRNA
gggcgagccgccgguagaac

SEQ ID NO: 54 - RNA, 20 nt, Artificial Sequence
  MKO10000054_A_mmuMarch11
  gRNA
ucacacucgcuauuaagaac

SEQ ID NO: 55 - RNA, 20 nt, Artificial Sequence
  MKO10000055_A_mmuSep11
  gRNA
gugucggcuuucgcgaugau

SEQ ID NO: 56 - RNA, 20 nt, Artificial Sequence
  MKO10000056_A_mmuSep11
  gRNA
ccagcuacucacaacgagcc

SEQ ID NO: 57 - RNA, 20 nt, Artificial Sequence
  MKO10000057_A_mmuSep11
  gRNA
ucagccguacguugcuuucc

SEQ ID NO: 58 - RNA, 20 nt, Artificial Sequence
  MKO10000058_A_1100001G20Rik
  gRNA
gacguaccuaaaagcugcag

SEQ ID NO: 59 - RNA, 20 nt, Artificial Sequence
  MKO10000059_A_1100001G20Rik
  gRNA
accugugcugagcucugccg

SEQ ID NO: 60 - RNA, 20 nt, Artificial Sequence
  MKO10000060_A_1100001G20Rik
  gRNA
auacugacacauuguuccuc

SEQ ID NO: 61 - RNA, 20 nt, Artificial Sequence
  MKO10000061_A_1110001A16Rik
  gRNA
auguaggauggcucggauca

SEQ ID NO: 62 - RNA, 20 nt, Artificial Sequence
  MKO10000062_A_1110001A16Rik
  gRNA
uuaaagaucuuccucgccag

SEQ ID NO: 63 - RNA, 20 nt, Artificial Sequence
  MKO10000063_A_1110001A16Rik
  gRNA
aacauaccuuccaaaaugaa

SEQ ID NO: 64 - RNA, 20 nt, Artificial Sequence
  MKO10000064_A_1110001J03Rik
  gRNA
ugugucgcgauauggccgcc

SEQ ID NO: 65 - RNA, 20 nt, Artificial Sequence
  MKO10000065_A_1110001J03Rik
  gRNA
gcggccauaucgcgacacag

SEQ ID NO: 66 - RNA, 20 nt, Artificial Sequence
  MKO10000066_A_1110001J03Rik
  gRNA
guugccggaugcuacucaaa

SEQ ID NO: 67 - RNA, 20 nt, Artificial Sequence
  MKO10000067_A_1110004E09Rik
  gRNA
gaugccuuggaccagcuucg

SEQ ID NO: 68 - RNA, 20 nt, Artificial Sequence
  MKO10000068_A_1110004E09Rik
  gRNA
ucaugaccgcaccucgaagc

SEQ ID NO: 69 - RNA, 20 nt, Artificial Sequence
  MKO10000069_A_1110004E09Rik
  gRNA
aaucaucgucaagauccagc

SEQ ID NO: 70 - RNA, 20 nt, Artificial Sequence
  MKO10000070_A_1110004F10Rik
  gRNA
gcaaacugucaggacgguac

SEQ ID NO: 71 - RNA, 20 nt, Artificial Sequence
  MKO10000071_A_1110004F10Rik
  gRNA
ucaacaucucacuuccgaac

SEQ ID NO: 72 - RNA, 20 nt, Artificial Sequence
  MKO10000072_A_1110004F10Rik
  gRNA
ugcagcuuggaucuagcaau

SEQ ID NO: 73 - RNA, 20 nt, Artificial Sequence
  MKO10000073_A_1110007C09Rik
  gRNA
ggucacagagccguacgcgc

SEQ ID NO: 74 - RNA, 20 nt, Artificial Sequence
  MKO10000074_A_1110007C09Rik
  gRNA
cuguaccagccggucacagu

SEQ ID NO: 75 - RNA, 20 nt, Artificial Sequence
  MKO10000075_A_1110007C09Rik
  gRNA
cccccaguuccggaacccca

SEQ ID NO: 76 - RNA, 20 nt, Artificial Sequence
  MKO10000076_A_1110008F13Rik
  gRNA
uaacuaccuacaaaucgacg

SEQ ID NO: 77 - RNA, 20 nt, Artificial Sequence
  MKO10000077_A_1110008F13Rik
  gRNA
acagaacuccugcauugauc

SEQ ID NO: 78 - RNA, 20 nt, Artificial Sequence
  MKO10000078_A_1110008F13Rik
  gRNA
caaggugcugcggagcgacg

SEQ ID NO: 79 - RNA, 20 nt, Artificial Sequence
  MKO10000079_A_1110008J03Rik
  gRNA
cagaauuguaaccgauccag

SEQ ID NO: 80 - RNA, 20 nt, Artificial Sequence
  MKO10000080_A_1110008J03Rik
  gRNA
aaacagugacucaucgcagu

SEQ ID NO: 81 - RNA, 20 nt, Artificial Sequence
  MKO10000081_A_1110008J03Rik
  gRNA
acagucgccccugauguguu

SEQ ID NO: 82 - RNA, 20 nt, Artificial Sequence
  MKO10000082_A_1110008L16Rik
  gRNA
gaggugucgucuucuuauac

SEQ ID NO: 83 - RNA, 20 nt, Artificial Sequence
  MKO10000083_A_1110008L16Rik
  gRNA
guauaagaagacgacaccuc

SEQ ID NO: 84 - RNA, 20 nt, Artificial Sequence
  MKO10000084_A_1110008L16Rik
  gRNA
ccaucaauaacgauaucaaa

SEQ ID NO: 85 - RNA, 20 nt, Artificial Sequence
  MKO10000085_A_1110008P14Rik
  gRNA
cccgcaaugucgggccccaa

SEQ ID NO: 86 - RNA, 20 nt, Artificial Sequence
  MKO10000086_A_1110008P14Rik
  gRNA
gucgaaccggcagacgcgcc

SEQ ID NO: 87 - RNA, 20 nt, Artificial Sequence
  MKO10000087_A_1110008P14Rik
  gRNA
accuaggggcuggcaucgcc

SEQ ID NO: 88 - RNA, 20 nt, Artificial Sequence
  MKO10000088_A_1110012L19Rik
  gRNA
ugcccaggacuuauugacau

SEQ ID NO: 89 - RNA, 20 nt, Artificial Sequence
  MKO10000089_A_1110012L19Rik
  gRNA
auuucugaacgcugcucaac

SEQ ID NO: 90 - RNA, 20 nt, Artificial Sequence
  MKO10000090_A_1110012L19Rik
  gRNA
uccagagaccuuaacugcug

SEQ ID NO: 91 - RNA, 20 nt, Artificial Sequence
  MKO10000091_A_1110017D15Rik
  gRNA
gccguuuaccguaggcguug

SEQ ID NO: 92 - RNA, 20 nt, Artificial Sequence
  MKO10000092_A_1110017D15Rik
  gRNA
cgaguccuugcagcaacuac

SEQ ID NO: 93 - RNA, 20 nt, Artificial Sequence
  MKO10000093_A_1110017D15Rik
  gRNA
uaagguaccuuggacagucg

SEQ ID NO: 94 - RNA, 20 nt, Artificial Sequence
  MKO10000094_A_1110025L11Rik
  gRNA
uguggcuauggaugugguuc

SEQ ID NO: 95 - RNA, 20 nt, Artificial Sequence
  MKO10000095_A_1110025L11Rik
  gRNA
agcaccauguguggcuacua

SEQ ID NO: 96 - RNA, 20 nt, Artificial Sequence
  MKO10000096_A_1110025L11Rik
  gRNA
cauagccacagcccagucca

SEQ ID NO: 97 - RNA, 20 nt, Artificial Sequence
  MKO10000097_A_1110032A03Rik
  gRNA
cuccuauucgaaccguaccc

SEQ ID NO: 98 - RNA, 20 nt, Artificial Sequence
  MKO10000098_A_1110032A03Rik
  gRNA
ccauccguacuguaaaaacu

SEQ ID NO: 99 - RNA, 20 nt, Artificial Sequence
  MKO10000099_A_1110032A03Rik
  gRNA
ugcaucauauguuguuucga

SEQ ID NO: 100 - RNA, 20 nt, Artificial Sequence
  MKO10000100_A_1110032F04Rik
  gRNA
cagcucgugcuccgaaacgc

SEQ ID NO: 101 - RNA, 20 nt, Artificial Sequence
  MKO10000101_A_1110032F04Rik
  gRNA
gagucgucgucgucgucggg

SEQ ID NO: 102 - RNA, 20 nt, Artificial Sequence
  MKO10000102_A_1110032F04Rik
  gRNA
gaaacggaccuggccgccgu

SEQ ID NO: 103 - RNA, 20 nt, Artificial Sequence
  MKO10000103_A_1110034G24Rik
  gRNA
acacaccgcggguagaucca

SEQ ID NO: 104 - RNA, 20 nt, Artificial Sequence
  MKO10000104_A_1110034G24Rik
  gRNA
cuguaccuuggaucuacccg

SEQ ID NO: 105 - RNA, 20 nt, Artificial Sequence
  MKO10000105_A_1110034G24Rik
  gRNA
aacugcggagagcauaccuu

SEQ ID NO: 106 - RNA, 20 nt, Artificial Sequence
  MKO10000106_A_1110037F02Rik
  gRNA
gugauaauuaccuucgaguu

SEQ ID NO: 107 - RNA, 20 nt, Artificial Sequence
  MKO10000107_A_1110037F02Rik
  gRNA
ugaaguccgaguuauacccc

SEQ ID NO: 108 - RNA, 20 nt, Artificial Sequence
  MKO10000108_A_1110037F02Rik
  gRNA
caucuuuagaccaaacucga

SEQ ID NO: 109 - RNA, 20 nt, Artificial Sequence
  MKO10000109_A_1110038F14Rik
  gRNA
ccugcaugcgacuccgccgc

SEQ ID NO: 110 - RNA, 20 nt, Artificial Sequence
  MKO10000110_A_1110038F14Rik
  gRNA
ggaggcccuacgggcucuaa

SEQ ID NO: 111 - RNA, 20 nt, Artificial Sequence
  MKO10000111_A_1110038F14Rik
  gRNA
ccggcggcggagucgcaugc

SEQ ID NO: 112 - RNA, 20 nt, Artificial Sequence
  MKO10000112_A_1110051M20Rik
  gRNA
uggagaugcuuccgaacugu

SEQ ID NO: 113 - RNA, 20 nt, Artificial Sequence
  MKO10000113_A_1110051M20Rik
  gRNA
gagacauguccucacguaca

SEQ ID NO: 114 - RNA, 20 nt, Artificial Sequence
  MKO10000114_A_1110051M20Rik
  gRNA
auugugcccagacuucccgc

SEQ ID NO: 115 - RNA, 20 nt, Artificial Sequence
  MKO10000115_A_1110057K04Rik
  gRNA
ucagacauucguucgauagu

SEQ ID NO: 116 - RNA, 20 nt, Artificial Sequence
  MKO10000116_A_1110057K04Rik
  gRNA
gacucgcuucaucacgugaa

SEQ ID NO: 117 - RNA, 20 nt, Artificial Sequence
  MKO10000117_A_1110057K04Rik
  gRNA
cgaaugucugaaucgcccaa

SEQ ID NO: 118 - RNA, 20 nt, Artificial Sequence
  MKO10000118_A_1110058L19Rik
  gRNA
ggcccggagccuacacgaua

SEQ ID NO: 119 - RNA, 20 nt, Artificial Sequence
  MKO10000119_A_1110058L19Rik
  gRNA
agugagucaaaacgaccgag

SEQ ID NO: 120 - RNA, 20 nt, Artificial Sequence
  MKO10000120_A_1110058L19Rik
  gRNA
gacgaaagucauccgugaaa

SEQ ID NO: 121 - RNA, 20 nt, Artificial Sequence
  MKO10000121_A_1110059E24Rik
  gRNA
uccguccgcagcgucuucua

SEQ ID NO: 122 - RNA, 20 nt, Artificial Sequence
  MKO10000122_A_1110059E24Rik
  gRNA
ucuggccauagaagacgcug

SEQ ID NO: 123 - RNA, 20 nt, Artificial Sequence
  MKO10000123_A_1110059E24Rik
  gRNA
ugauaagaguguucagacca

SEQ ID NO: 124 - RNA, 20 nt, Artificial Sequence
  MKO10000124_A_1110059G10Rik
  gRNA
cacuugguuccgcuugcuca

SEQ ID NO: 125 - RNA, 20 nt, Artificial Sequence
  MKO10000125_A_1110059G10Rik
  gRNA
ccagaacuaccaugagcaag

SEQ ID NO: 126 - RNA, 20 nt, Artificial Sequence
  MKO10000126_A_1110059G10Rik
  gRNA
agaugaacagccucaaguag

SEQ ID NO: 127 - RNA, 20 nt, Artificial Sequence
  MKO10000127_A_1110059M19Rik
  gRNA
uacacuaacaccugcuauug

SEQ ID NO: 128 - RNA, 20 nt, Artificial Sequence
  MKO10000128_A_1110059M19Rik
  gRNA
ccuccgaucaucagugccau

SEQ ID NO: 129 - RNA, 20 nt, Artificial Sequence
  MKO10000129_A_1110059M19Rik
  gRNA
uacauggcuuguacugaaaa

SEQ ID NO: 130 - RNA, 20 nt, Artificial Sequence
  MKO10000130_A_1110065P20Rik
  gRNA
cgccggcgcccagaaccggc

SEQ ID NO: 131 - RNA, 20 nt, Artificial Sequence
  MKO10000131_A_1110065P20Rik
  gRNA
ccaccucuggccgauacaga

SEQ ID NO: 132 - RNA, 20 nt, Artificial Sequence
  MKO10000132_A_1110065P20Rik
  gRNA
uagaacgguucagccaaguc

SEQ ID NO: 133 - RNA, 20 nt, Artificial Sequence
  MKO10000133_A_1190002N15Rik
  gRNA
accgaguucgcgcgucucaa

SEQ ID NO: 134 - RNA, 20 nt, Artificial Sequence
  MKO10000134_A_1190002N15Rik
  gRNA
ccgccuggugcgccgcuacg

SEQ ID NO: 135 - RNA, 20 nt, Artificial Sequence
  MKO10000135_A_1190002N15Rik
  gRNA
gaaccggccauagcguuucu

SEQ ID NO: 136 - RNA, 20 nt, Artificial Sequence
  MKO10000136_A_1190003K10Rik
  gRNA
acagacuuguuaccgagaac

SEQ ID NO: 137 - RNA, 20 nt, Artificial Sequence
  MKO10000137_A_1190003K10Rik
  gRNA
agacuucccugcgcauguac

SEQ ID NO: 138 - RNA, 20 nt, Artificial Sequence
  MKO10000138_A_1190003K10Rik
  gRNA
gccagaagcacucaguucuc

SEQ ID NO: 139 - RNA, 20 nt, Artificial Sequence
  MKO10000139_A_1190005I06Rik
  gRNA
ucaggacgggggccucgucg

SEQ ID NO: 140 - RNA, 20 nt, Artificial Sequence
  MKO10000140_A_1190005I06Rik
  gRNA
aggcgacgcgcuugcagccg

SEQ ID NO: 141 - RNA, 20 nt, Artificial Sequence
  MKO10000141_A_1190005I06Rik
  gRNA
acggcugcaagcgcgucgcc

SEQ ID NO: 142 - RNA, 20 nt, Artificial Sequence
  MKO10000142_A_1190007I07Rik
  gRNA
agaacucaaaacggagcuuu

SEQ ID NO: 143 - RNA, 20 nt, Artificial Sequence
  MKO10000143_A_1190007I07Rik
  gRNA
caugugcgccggggcccagg

SEQ ID NO: 144 - RNA, 20 nt, Artificial Sequence
  MKO10000144_A_1190007I07Rik
  gRNA
ccccggcgcacauggccagg

SEQ ID NO: 145 - RNA, 20 nt, Artificial Sequence
  MKO10000145_A_42625
  gRNA
cugucagcccgggcgaucac

SEQ ID NO: 146 - RNA, 20 nt, Artificial Sequence
  MKO10000146_A_42625
  gRNA
caguccggcacagccgccuc

SEQ ID NO: 147 - RNA, 20 nt, Artificial Sequence
  MKO10000147_A_42625
  gRNA
guguacuuugugccacccac

SEQ ID NO: 148 - RNA, 20 nt, Artificial Sequence
  MKO10000148_A_1200014J11Rik
  gRNA
gauuuacuucugcucgaaag

SEQ ID NO: 149 - RNA, 20 nt, Artificial Sequence
  MKO10000149_A_1200014J11Rik
  gRNA
ugggaucgaugucaccucca

SEQ ID NO: 150 - RNA, 20 nt, Artificial Sequence
  MKO10000150_A_1200014J11Rik
  gRNA
cuccgacgacuugucuucac

SEQ ID NO: 151 - RNA, 20 nt, Artificial Sequence
  MKO10000151_A_1300002K09Rik
  gRNA
gucuccgaugcucucgucuu

SEQ ID NO: 152 - RNA, 20 nt, Artificial Sequence
  MKO10000152_A_1300002K09Rik
  gRNA
uuuaguaaccgaugguccua

SEQ ID NO: 153 - RNA, 20 nt, Artificial Sequence
  MKO10000153_A_1300002K09Rik
  gRNA
gccuccgaugaaaagcacaa

SEQ ID NO: 154 - RNA, 20 nt, Artificial Sequence
  MKO10000154_A_1300017J02Rik
  gRNA
gaacaucuuuccauccgcac

SEQ ID NO: 155 - RNA, 20 nt, Artificial Sequence
  MKO10000155_A_1300017J02Rik
  gRNA
ugacacaacgcaccaucgua

SEQ ID NO: 156 - RNA, 20 nt, Artificial Sequence
  MKO10000156_A_1300017J02Rik
  gRNA
cacuuacuuuaaggcucccc

SEQ ID NO: 157 - RNA, 20 nt, Artificial Sequence
  MKO10000157_A_42627
  gRNA
cacucgcuucgucaucgacc

SEQ ID NO: 158 - RNA, 20 nt, Artificial Sequence
  MKO10000158_A_42627
  gRNA
agaaucgugauagucagcua

SEQ ID NO: 159 - RNA, 20 nt, Artificial Sequence
  MKO10000159_A_42627
  gRNA
guccucucauuucuacucga

SEQ ID NO: 160 - RNA, 20 nt, Artificial Sequence
  MKO10000160_A_42628
  gRNA
ucguccaaaagcuuuaguac

SEQ ID NO: 161 - RNA, 20 nt, Artificial Sequence
  MKO10000161_A_42628
  gRNA
ugcagcucuugcgaucuucu

SEQ ID NO: 162 - RNA, 20 nt, Artificial Sequence
  MKO10000162_A_42628
  gRNA
acaguuuaaucugcucccac

SEQ ID NO: 163 - RNA, 20 nt, Artificial Sequence
  MKO10000163_A_1500009L16Rik
  gRNA
uagaacagaagacucgauaa

SEQ ID NO: 164 - RNA, 20 nt, Artificial Sequence
  MKO10000164_A_1500009L16Rik
  gRNA
gugucuuuaacugcuccugu

SEQ ID NO: 165 - RNA, 20 nt, Artificial Sequence
  MKO10000165_A_1500012F01Rik
  gRNA
gguaucaugugcacuauugc

SEQ ID NO: 166 - RNA, 20 nt, Artificial Sequence
  MKO10000166_A_1500012F01Rik
  gRNA
cuacaggcccgagagagccg

SEQ ID NO: 167 - RNA, 20 nt, Artificial Sequence
  MKO10000167_A_1500012F01Rik
  gRNA
cacucaccaaugcucgccuc

SEQ ID NO: 168 - RNA, 20 nt, Artificial Sequence
  MKO10000168_A_1500015O10Rik
  gRNA
ccaugagcaccucgucugcg

SEQ ID NO: 169 - RNA, 20 nt, Artificial Sequence
  MKO10000169_A_1500015O10Rik
  gRNA
ccgcgcagacgaggugcuca

SEQ ID NO: 170 - RNA, 20 nt, Artificial Sequence
  MKO10000170_A_1500015O10Rik
  gRNA
cgaaacggccaugacuacua

SEQ ID NO: 171 - RNA, 20 nt, Artificial Sequence
  MKO10000171_A_1600002H07Rik
  gRNA
ugagcacagacuacgaucaa

SEQ ID NO: 172 - RNA, 20 nt, Artificial Sequence
  MKO10000172_A_1600002H07Rik
  gRNA
ccgggguggcagccguguau

SEQ ID NO: 173 - RNA, 20 nt, Artificial Sequence
  MKO10000173_A_1600002H07Rik
  gRNA
ccuuggacuccugcgccgau

SEQ ID NO: 174 - RNA, 20 nt, Artificial Sequence
  MKO10000174_A_1600002K03Rik
  gRNA
cgcuuguucuacguaaucac

SEQ ID NO: 175 - RNA, 20 nt, Artificial Sequence
  MKO10000175_A_1600002K03Rik
  gRNA
cgcuaacgcaccuaaaagcc

SEQ ID NO: 176 - RNA, 20 nt, Artificial Sequence
  MKO10000176_A_1600002K03Rik
  gRNA
gacucaagaagucacagcga

SEQ ID NO: 177 - RNA, 20 nt, Artificial Sequence
  MKO10000177_A_1600012H06Rik
  gRNA
cacacuuccagcgaccgguc

SEQ ID NO: 178 - RNA, 20 nt, Artificial Sequence
  MKO10000178_A_1600012H06Rik
  gRNA
gagugcuguccgacacguac

SEQ ID NO: 179 - RNA, 20 nt, Artificial Sequence
  MKO10000179_A_1600012H06Rik
  gRNA
gcgcgcccuguugaugaucc

SEQ ID NO: 180 - RNA, 20 nt, Artificial Sequence
  MKO10000180_A_1600014C10Rik
  gRNA
cgcgcgcaccuuuaccgagc

SEQ ID NO: 181 - RNA, 20 nt, Artificial Sequence
  MKO10000181_A_1600014C10Rik
  gRNA
gcuaacgaccuaugucacca

SEQ ID NO: 182 - RNA, 20 nt, Artificial Sequence
  MKO10000182_A_1600014C10Rik
  gRNA
gaguccucccgaugaccaug

SEQ ID NO: 183 - RNA, 20 nt, Artificial Sequence
  MKO10000183_A_1600014C23Rik
  gRNA
aggaacccugccugcgcccc

SEQ ID NO: 184 - RNA, 20 nt, Artificial Sequence
  MKO10000184_A_1600014C23Rik
  gRNA
auuuccuccugaguaugacc

SEQ ID NO: 185 - RNA, 20 nt, Artificial Sequence
  MKO10000185_A_1600014C23Rik
  gRNA
aguucgacccaucuacagag

SEQ ID NO: 186 - RNA, 20 nt, Artificial Sequence
  MKO10000186_A_1600014K23Rik
  gRNA
gggcagcguuagacuccgac

SEQ ID NO: 187 - RNA, 20 nt, Artificial Sequence
  MKO10000187_A_1600014K23Rik
  gRNA
aauugccaaucaagaccgcc

SEQ ID NO: 188 - RNA, 20 nt, Artificial Sequence
  MKO10000188_A_1600014K23Rik
  gRNA
acgcgcacuccaucgccaug

SEQ ID NO: 189 - RNA, 20 nt, Artificial Sequence
  MKO10000189_A_1600015I10Rik
  gRNA
gcuacucgccaguuagccgc

SEQ ID NO: 190 - RNA, 20 nt, Artificial Sequence
  MKO10000190_A_1600015I10Rik
  gRNA
caaugcgguaauguacuagg

SEQ ID NO: 191 - RNA, 20 nt, Artificial Sequence
  MKO10000191_A_1600015I10Rik
  gRNA
ccaucccgugggucguaugg

SEQ ID NO: 192 - RNA, 20 nt, Artificial Sequence
  MKO10000192_A_1600016N20Rik
  gRNA
gaacagcccaccgaagugcc

SEQ ID NO: 193 - RNA, 20 nt, Artificial Sequence
  MKO10000193_A_1600016N20Rik
  gRNA
gcuucuggaccugguuccgc

SEQ ID NO: 194 - RNA, 20 nt, Artificial Sequence
  MKO10000194_A_1600016N20Rik
  gRNA
caaacucaccucgacgcugc

SEQ ID NO: 195 - RNA, 20 nt, Artificial Sequence
  MKO10000195_A_1700001C02Rik
  gRNA
ucauuagugugcccgcgcua

SEQ ID NO: 196 - RNA, 20 nt, Artificial Sequence
  MKO10000196_A_1700001C02Rik
  gRNA
aggcucugaacucgaaguaa

SEQ ID NO: 197 - RNA, 20 nt, Artificial Sequence
  MKO10000197_A_1700001C02Rik
  gRNA
aagagcuaugcgcuccucag

SEQ ID NO: 198 - RNA, 20 nt, Artificial Sequence
  MKO10000198_A_1700001C19Rik
  gRNA
ugcaggccgaucuguccccg

SEQ ID NO: 199 - RNA, 20 nt, Artificial Sequence
  MKO10000199_A_1700001C19Rik
  gRNA
agacgcugcgggguucaguc

SEQ ID NO: 200 - RNA, 20 nt, Artificial Sequence
  MKO10000200_A_1700001C19Rik
  gRNA
uucugggacaaugccgucag

SEQ ID NO: 201 - RNA, 20 nt, Artificial Sequence
  MKO10000201_A_1700001F09Rik
  gRNA
gcagccucuucuuuacuucc

SEQ ID NO: 202 - RNA, 20 nt, Artificial Sequence
  MKO10000202_A_1700001F09Rik
  gRNA
accuacagggucauuuagga

SEQ ID NO: 203 - RNA, 20 nt, Artificial Sequence
  MKO10000203_A_1700001F09Rik
  gRNA
gucauucaaauccuuguacu

SEQ ID NO: 204 - RNA, 20 nt, Artificial Sequence
  MKO10000204_A_1700001J03Rik
  gRNA
uuccucaguguuuagcgcga

SEQ ID NO: 205 - RNA, 20 nt, Artificial Sequence
  MKO10000205_A_1700001J03Rik
  gRNA
ggccaucgcgcuaaacacug

SEQ ID NO: 206 - RNA, 20 nt, Artificial Sequence
  MKO10000206_A_1700001J03Rik
  gRNA
aucauuuguaccacguauuc

SEQ ID NO: 207 - RNA, 20 nt, Artificial Sequence
  MKO10000207_A_1700001K19Rik
  gRNA
acacgcgcgccaucgccuuc

SEQ ID NO: 208 - RNA, 20 nt, Artificial Sequence
  MKO10000208_A_1700001K19Rik
  gRNA
cugcgauaguuggaaugacc

SEQ ID NO: 209 - RNA, 20 nt, Artificial Sequence
  MKO10000209_A_1700001K19Rik
  gRNA
ugggagcgagucuuccacgc

SEQ ID NO: 210 - RNA, 20 nt, Artificial Sequence
  MKO10000210_A_1700001L19Rik
  gRNA
gcgcagcuacuucagucgcg

SEQ ID NO: 211 - RNA, 20 nt, Artificial Sequence
  MKO10000211_A_1700001L19Rik
  gRNA
gucaccuccgaaacccugcg

SEQ ID NO: 212 - RNA, 20 nt, Artificial Sequence
  MKO10000212_A_1700001L19Rik
  gRNA
acgugaagaccgacuucuac

SEQ ID NO: 213 - RNA, 20 nt, Artificial Sequence
  MKO10000213_A_1700001O22Rik
  gRNA
uacugggaacgcaaccgugc

SEQ ID NO: 214 - RNA, 20 nt, Artificial Sequence
  MKO10000214_A_1700001O22Rik
  gRNA
ucucgucugcgaaucguacc

SEQ ID NO: 215 - RNA, 20 nt, Artificial Sequence
  MKO10000215_A_1700001O22Rik
  gRNA
agagccucacacgcgggggc

SEQ ID NO: 216 - RNA, 20 nt, Artificial Sequence
  MKO10000216_A_1700001P01Rik
  gRNA
uccggaaguaccgacgacug

SEQ ID NO: 217 - RNA, 20 nt, Artificial Sequence
  MKO10000217_A_1700001P01Rik
  gRNA
accacagucgucgguacuuc

SEQ ID NO: 218 - RNA, 20 nt, Artificial Sequence
  MKO10000218_A_1700001P01Rik
  gRNA
gccauuuaagcccguaguga

SEQ ID NO: 219 - RNA, 20 nt, Artificial Sequence
  MKO10000219_A_1700003E16Rik
  gRNA
uauaucgcgggcgcccgcgc

SEQ ID NO: 220 - RNA, 20 nt, Artificial Sequence
  MKO10000220_A_1700003E16Rik
  gRNA
cgcccgcgauauauuuccaa

SEQ ID NO: 221 - RNA, 20 nt, Artificial Sequence
  MKO10000221_A_1700003E16Rik
  gRNA
ugaccuuaugacucgaguua

SEQ ID NO: 222 - RNA, 20 nt, Artificial Sequence
  MKO10000222_A_1700003F12Rik
  gRNA
gacggcguggacaggcgcga

SEQ ID NO: 223 - RNA, 20 nt, Artificial Sequence
  MKO10000223_A_1700003F12Rik
  gRNA
gcgccuaugcuacguggggc

SEQ ID NO: 224 - RNA, 20 nt, Artificial Sequence
  MKO10000224_A_1700003F12Rik
  gRNA
ugacgggcuuuguccauguc

SEQ ID NO: 225 - RNA, 20 nt, Artificial Sequence
  MKO10000225_A_1700003M02Rik
  gRNA
gagcucaccaugauuguuac

SEQ ID NO: 226 - RNA, 20 nt, Artificial Sequence
  MKO10000226_A_1700003M02Rik
  gRNA
gauaugaacuauacaagucg

SEQ ID NO: 227 - RNA, 20 nt, Artificial Sequence
  MKO10000227_A_1700003M02Rik
  gRNA
ucuguuaaauaagcgaauuc

SEQ ID NO: 228 - RNA, 20 nt, Artificial Sequence
  MKO10000228_A_1700006A11Rik
  gRNA
auuugcuaaucccgaguugc

SEQ ID NO: 229 - RNA, 20 nt, Artificial Sequence
  MKO10000229_A_1700006A11Rik
  gRNA
cauaacucaaguauuccaca

SEQ ID NO: 230 - RNA, 20 nt, Artificial Sequence
  MKO10000230_A_1700006A11Rik
  gRNA
cucuccauucucaacgaaaa

SEQ ID NO: 231 - RNA, 20 nt, Artificial Sequence
  MKO10000231_A_1700006E09Rik
  gRNA
gcaaacccaacuaugaccgc

SEQ ID NO: 232 - RNA, 20 nt, Artificial Sequence
  MKO10000232_A_1700006E09Rik
  gRNA
aaaauugcgaaugccuaucg

SEQ ID NO: 233 - RNA, 20 nt, Artificial Sequence
  MKO10000233_A_1700006E09Rik
  gRNA
aguccaucuccgaugaccug

SEQ ID NO: 234 - RNA, 20 nt, Artificial Sequence
  MKO10000234_A_1700007B14Rik
  gRNA
ugaauccgugaguaagcaaa

SEQ ID NO: 235 - RNA, 20 nt, Artificial Sequence
  MKO10000235_A_1700007B14Rik
  gRNA
ucaaaagcaucagcuauccc

SEQ ID NO: 236 - RNA, 20 nt, Artificial Sequence
  MKO10000236_A_1700007B14Rik
  gRNA
gagcuugccuuugcauaauc

SEQ ID NO: 237 - RNA, 20 nt, Artificial Sequence
  MKO10000237_A_1700007G11Rik
  gRNA
uugguggagcuaggcuaccg

SEQ ID NO: 238 - RNA, 20 nt, Artificial Sequence
  MKO10000238_A_1700007G11Rik
  gRNA
gcuccaccaacuggcgagcc

SEQ ID NO: 239 - RNA, 20 nt, Artificial Sequence
  MKO10000239_A_1700007G11Rik
  gRNA
agggaagaggauaaucgugc

SEQ ID NO: 240 - RNA, 20 nt, Artificial Sequence
  MKO10000240_A_1700007K09Rik
  gRNA
accauugcuguugcgaguug

SEQ ID NO: 241 - RNA, 20 nt, Artificial Sequence
  MKO10000241_A_1700007K09Rik
  gRNA
accgcaacucgcaacagcaa

SEQ ID NO: 242 - RNA, 20 nt, Artificial Sequence
  MKO10000242_A_1700007K09Rik
  gRNA
ugaugaucgugauuauuguc

SEQ ID NO: 243 - RNA, 20 nt, Artificial Sequence
  MKO10000243_A_1700007K13Rik
  gRNA
uuagcgagaagcucccaguc

SEQ ID NO: 244 - RNA, 20 nt, Artificial Sequence
  MKO10000244_A_1700007K13Rik
  gRNA
ccguagccaugaaaccaccc

SEQ ID NO: 245 - RNA, 20 nt, Artificial Sequence
  MKO10000245_A_1700007K13Rik
  gRNA
uacuggcaucucaugcaccg

SEQ ID NO: 246 - RNA, 20 nt, Artificial Sequence
  MKO10000246_A_1700008A04Rik
  gRNA
auucuggcucgaugcccuuc

SEQ ID NO: 247 - RNA, 20 nt, Artificial Sequence
  MKO10000247_A_1700008A04Rik
  gRNA
gaagucaccacugugaugac

SEQ ID NO: 248 - RNA, 20 nt, Artificial Sequence
  MKO10000248_A_1700008A04Rik
  gRNA
cugaaagugguugcaguccu

SEQ ID NO: 249 - RNA, 20 nt, Artificial Sequence
  MKO10000249_A_1700008F21Rik
  gRNA
acuuguguaacauagcuguc

SEQ ID NO: 250 - RNA, 20 nt, Artificial Sequence
  MKO10000250_A_1700008F21Rik
  gRNA
uuucuuaguucgcucuaauu

SEQ ID NO: 251 - RNA, 20 nt, Artificial Sequence
  MKO10000251_A_1700008F21Rik
  gRNA
uuagagcgaacuaagaaacc

SEQ ID NO: 252 - RNA, 20 nt, Artificial Sequence
  MKO10000252_A_1700008I05Rik
  gRNA
uguacauugucuccacgaau

SEQ ID NO: 253 - RNA, 20 nt, Artificial Sequence
  MKO10000253_A_1700008I05Rik
  gRNA
uaguccagaaagccaauucg

SEQ ID NO: 254 - RNA, 20 nt, Artificial Sequence
  MKO10000254_A_1700008I05Rik
  gRNA
gaacauucgaccauauuuac

SEQ ID NO: 255 - RNA, 20 nt, Artificial Sequence
  MKO10000255_A_1700008O03Rik
  gRNA
cccccagcaguaaaucgucg

SEQ ID NO: 256 - RNA, 20 nt, Artificial Sequence
  MKO10000256_A_1700008O03Rik
  gRNA
guucacgcgcccgcuuucca

SEQ ID NO: 257 - RNA, 20 nt, Artificial Sequence
  MKO10000257_A_1700008O03Rik
  gRNA
caucucggaauaugaggcgc

SEQ ID NO: 258 - RNA, 20 nt, Artificial Sequence
  MKO10000258_A_1700008P02Rik
  gRNA
cuggugacaagccugaacgu

SEQ ID NO: 259 - RNA, 20 nt, Artificial Sequence
  MKO10000259_A_1700008P02Rik
  gRNA
uucucagccugccuacguuc

SEQ ID NO: 260 - RNA, 20 nt, Artificial Sequence
  MKO10000260_A_1700008P02Rik
  gRNA
gaagaagccuuacaugccaa

SEQ ID NO: 261 - RNA, 20 nt, Artificial Sequence
  MKO10000261_A_1700009N14Rik
  gRNA
ggauguaauagccgucucgc

SEQ ID NO: 262 - RNA, 20 nt, Artificial Sequence
  MKO10000262_A_1700009N14Rik
  gRNA
caguaccaccaucgcccacg

SEQ ID NO: 263 - RNA, 20 nt, Artificial Sequence
  MKO10000263_A_1700009N14Rik
  gRNA
gcccaucaaguuuaacgucu

SEQ ID NO: 264 - RNA, 20 nt, Artificial Sequence
  MKO10000264_A_1700009P17Rik
  gRNA
gaucuacucaacgccuguaa

SEQ ID NO: 265 - RNA, 20 nt, Artificial Sequence
  MKO10000265_A_1700009P17Rik
  gRNA
ugcgagcuuugcgguucauc

SEQ ID NO: 266 - RNA, 20 nt, Artificial Sequence
  MKO10000266_A_1700009P17Rik
  gRNA
guugucuccuuggauaaccg

SEQ ID NO: 267 - RNA, 20 nt, Artificial Sequence
  MKO10000267_A_1700010B08Rik
  gRNA
ccacaauauagaaauaccgc

SEQ ID NO: 268 - RNA, 20 nt, Artificial Sequence
  MKO10000268_A_1700010B08Rik
  gRNA
cuguaagcccugguuugaug

SEQ ID NO: 269 - RNA, 20 nt, Artificial Sequence
  MKO10000269_A_1700010B08Rik
  gRNA
aggacucaccuguaugauuc

SEQ ID NO: 270 - RNA, 20 nt, Artificial Sequence
  MKO10000270_A_1700010D01Rik
  gRNA
agaacaauauagcaccuaaa

SEQ ID NO: 271 - RNA, 20 nt, Artificial Sequence
  MKO10000271_A_1700010D01Rik
  gRNA
caugaagaacaagaaaacgc

SEQ ID NO: 272 - RNA, 20 nt, Artificial Sequence
  MKO10000272_A_1700010D01Rik
  gRNA
aggcaaaucuucacuaucuu

SEQ ID NO: 273 - RNA, 20 nt, Artificial Sequence
  MKO10000273_A_1700010I14Rik
  gRNA
aggccuguacgcguggguuc

SEQ ID NO: 274 - RNA, 20 nt, Artificial Sequence
  MKO10000274_A_1700010I14Rik
  gRNA
uaacgguacacaucccugcc

SEQ ID NO: 275 - RNA, 20 nt, Artificial Sequence
  MKO10000275_A_1700010I14Rik
  gRNA
uauuaccugauacugcgcug

SEQ ID NO: 276 - RNA, 20 nt, Artificial Sequence
  MKO10000276_A_1700011A15Rik
  gRNA
ucggcagcuacgugaguacc

SEQ ID NO: 277 - RNA, 20 nt, Artificial Sequence
  MKO10000277_A_1700011A15Rik
  gRNA
gccaugccggaugcggccuc

SEQ ID NO: 278 - RNA, 20 nt, Artificial Sequence
  MKO10000278_A_1700011A15Rik
  gRNA
gucuccagugacgucaccgc

SEQ ID NO: 279 - RNA, 20 nt, Artificial Sequence
  MKO10000279_A_1700011E24Rik
  gRNA
guacgagguacuuccagcac

SEQ ID NO: 280 - RNA, 20 nt, Artificial Sequence
  MKO10000280_A_1700011E24Rik
  gRNA
ggaucguuucucagcacaag

SEQ ID NO: 281 - RNA, 20 nt, Artificial Sequence
  MKO10000281_A_1700011E24Rik
  gRNA
aucuuugucaacuagugugc

SEQ ID NO: 282 - RNA, 20 nt, Artificial Sequence
  MKO10000282_A_1700011H14Rik
  gRNA
augucauagccguugcuccu

SEQ ID NO: 283 - RNA, 20 nt, Artificial Sequence
  MKO10000283_A_1700011H14Rik
  gRNA
gacucuuccucaacuccauu

SEQ ID NO: 284 - RNA, 20 nt, Artificial Sequence
  MKO10000284_A_1700011H14Rik
  gRNA
cacaagcaauuaccucugaa

SEQ ID NO: 285 - RNA, 20 nt, Artificial Sequence
  MKO10000285_A_1700011I03Rik
  gRNA
gugaaccgaaagaacguugg

SEQ ID NO: 286 - RNA, 20 nt, Artificial Sequence
  MKO10000286_A_1700011I03Rik
  gRNA
acucuccaccaacguucuuu

SEQ ID NO: 287 - RNA, 20 nt, Artificial Sequence
  MKO10000287_A_1700011I03Rik
  gRNA
augccauccaggucgaugcu

SEQ ID NO: 288 - RNA, 20 nt, Artificial Sequence
  MKO10000288_A_1700011L22Rik
  gRNA
aguuucucacccguuucagc

SEQ ID NO: 289 - RNA, 20 nt, Artificial Sequence
  MKO10000289_A_1700011L22Rik
  gRNA
guaacuuacagggggacaua

SEQ ID NO: 290 - RNA, 20 nt, Artificial Sequence
  MKO10000290_A_1700011L22Rik
  gRNA
cuggaggggcuugcuauauc

SEQ ID NO: 291 - RNA, 20 nt, Artificial Sequence
  MKO10000291_A_1700012A03Rik
  gRNA
gacaaguguagcaccuuauc

SEQ ID NO: 292 - RNA, 20 nt, Artificial Sequence
  MKO10000292_A_1700012A03Rik
  gRNA
ucgucucaugucaguaucca

SEQ ID NO: 293 - RNA, 20 nt, Artificial Sequence
  MKO10000293_A_1700012A03Rik
  gRNA
gaguagaauguucaaggguc

SEQ ID NO: 294 - RNA, 20 nt, Artificial Sequence
  MKO10000294_A_1700012B07Rik
  gRNA
aggggcucgcgucguauauu

SEQ ID NO: 295 - RNA, 20 nt, Artificial Sequence
  MKO10000295_A_1700012B07Rik
  gRNA
aaggaacgccguagccgcuu

SEQ ID NO: 296 - RNA, 20 nt, Artificial Sequence
  MKO10000296_A_1700012B07Rik
  gRNA
gagccagagcuugacgucac

SEQ ID NO: 297 - RNA, 20 nt, Artificial Sequence
  MKO10000297_A_1700012B09Rik
  gRNA
ccccgguggcaugaggcggc

SEQ ID NO: 298 - RNA, 20 nt, Artificial Sequence
  MKO10000298_A_1700012B09Rik
  gRNA
cacaagccaaguacuacucg

SEQ ID NO: 299 - RNA, 20 nt, Artificial Sequence
  MKO10000299_A_1700012B09Rik
  gRNA
cccuucgcggcccgccucug

SEQ ID NO: 300 - RNA, 20 nt, Artificial Sequence
  MKO10000300_A_1700012L04Rik
  gRNA
caggaagcgcguaacuccag

SEQ ID NO: 301 - RNA, 20 nt, Artificial Sequence
  MKO10000301_A_1700012L04Rik
  gRNA
aguuacgcgcuuccugccag

SEQ ID NO: 302 - RNA, 20 nt, Artificial Sequence
  MKO10000302_A_1700012L04Rik
  gRNA
ucauucacugaugugccacc

SEQ ID NO: 303 - RNA, 20 nt, Artificial Sequence
  MKO10000303_A_1700012P22Rik
  gRNA
cugaucagauagcgaugcga

SEQ ID NO: 304 - RNA, 20 nt, Artificial Sequence
  MKO10000304_A_1700012P22Rik
  gRNA
uauucaacgaaagugcuccu

SEQ ID NO: 305 - RNA, 20 nt, Artificial Sequence
  MKO10000305_A_1700012P22Rik
  gRNA
cauagcgcacaccggcagcc

SEQ ID NO: 306 - RNA, 20 nt, Artificial Sequence
  MKO10000306_A_1700013D24Rik
  gRNA
ucugcgcaauguuuccuaua

SEQ ID NO: 307 - RNA, 20 nt, Artificial Sequence
  MKO10000307_A_1700013D24Rik
  gRNA
uguucccaaguggcauaccu

SEQ ID NO: 308 - RNA, 20 nt, Artificial Sequence
  MKO10000308_A_1700013D24Rik
  gRNA
cuugggaacagacugacccc

SEQ ID NO: 309 - RNA, 20 nt, Artificial Sequence
  MKO10000309_A_1700013F07Rik
  gRNA
ugcuguugcgcaaggugagc

SEQ ID NO: 310 - RNA, 20 nt, Artificial Sequence
  MKO10000310_A_1700013F07Rik
  gRNA
ucgacuucuggacguggcug

SEQ ID NO: 311 - RNA, 20 nt, Artificial Sequence
  MKO10000311_A_1700013F07Rik
  gRNA
aacugagauauuguuacacc

SEQ ID NO: 312 - RNA, 20 nt, Artificial Sequence
  MKO10000312_A_1700013G24Rik
  gRNA
agaagaacccguugccgaac

SEQ ID NO: 313 - RNA, 20 nt, Artificial Sequence
  MKO10000313_A_1700013G24Rik
  gRNA
acccuugccguuguucauau

SEQ ID NO: 314 - RNA, 20 nt, Artificial Sequence
  MKO10000314_A_1700013G24Rik
  gRNA
gugacucgucucuacacacu

SEQ ID NO: 315 - RNA, 20 nt, Artificial Sequence
  MKO10000315_A_1700013H16Rik
  gRNA
guagaacuguuuacagaucc

SEQ ID NO: 316 - RNA, 20 nt, Artificial Sequence
  MKO10000316_A_1700013H16Rik
  gRNA
gcuuaaugaagagucugcuc

SEQ ID NO: 317 - RNA, 20 nt, Artificial Sequence
  MKO10000317_A_1700013H16Rik
  gRNA
aacucccucaaaagacuguc

SEQ ID NO: 318 - RNA, 20 nt, Artificial Sequence
  MKO10000318_A_1700015E13Rik
  gRNA
gacggaacugcaccaucuac

SEQ ID NO: 319 - RNA, 20 nt, Artificial Sequence
  MKO10000319_A_1700015E13Rik
  gRNA
gugcauacgaaguagcugua

SEQ ID NO: 320 - RNA, 20 nt, Artificial Sequence
  MKO10000320_A_1700015E13Rik
  gRNA
ugagcguuuaccuggcaagc

SEQ ID NO: 321 - RNA, 20 nt, Artificial Sequence
  MKO10000321_A_1700015F17Rik
  gRNA
acaaguucccgucuacaacu

SEQ ID NO: 322 - RNA, 20 nt, Artificial Sequence
  MKO10000322_A_1700015F17Rik
  gRNA
cucuuaucucgaguacacac

SEQ ID NO: 323 - RNA, 20 nt, Artificial Sequence
  MKO10000323_A_1700015F17Rik
  gRNA
auggcccuuuaugcaagaca

SEQ ID NO: 324 - RNA, 20 nt, Artificial Sequence
  MKO10000324_A_1700015G11Rik
  gRNA
ccuaacccgauuccggauac

SEQ ID NO: 325 - RNA, 20 nt, Artificial Sequence
  MKO10000325_A_1700015G11Rik
  gRNA
cuauguaggaaggaccacga

SEQ ID NO: 326 - RNA, 20 nt, Artificial Sequence
  MKO10000326_A_1700015G11Rik
  gRNA
cagcaugugccuucgaguua

SEQ ID NO: 327 - RNA, 20 nt, Artificial Sequence
  MKO10000327_A_1700016C15Rik
  gRNA
ugcuucgaaugagcguuugc

SEQ ID NO: 328 - RNA, 20 nt, Artificial Sequence
  MKO10000328_A_1700016C15Rik
  gRNA
ccagguugggaucggaaauu

SEQ ID NO: 329 - RNA, 20 nt, Artificial Sequence
  MKO10000329_A_1700016C15Rik
  gRNA
gucgcccaucgauuccaccu

SEQ ID NO: 330 - RNA, 20 nt, Artificial Sequence
  MKO10000330_A_1700016D06Rik
  gRNA
uuauauuuaccgucaaagga

SEQ ID NO: 331 - RNA, 20 nt, Artificial Sequence
  MKO10000331_A_1700016D06Rik
  gRNA
gacaagauucgaagagcuau

SEQ ID NO: 332 - RNA, 20 nt, Artificial Sequence
  MKO10000332_A_1700016D06Rik
  gRNA
uucacaacaaaaaacaacga

SEQ ID NO: 333 - RNA, 20 nt, Artificial Sequence
  MKO10000333_A_1700016H13Rik
  gRNA
acacaaacuugacgaacauc

SEQ ID NO: 334 - RNA, 20 nt, Artificial Sequence
  MKO10000334_A_1700016H13Rik
  gRNA
uggcguauggcuugccaaga

SEQ ID NO: 335 - RNA, 20 nt, Artificial Sequence
  MKO10000335_A_1700016H13Rik
  gRNA
aauacgauuucucccaagaa

SEQ ID NO: 336 - RNA, 20 nt, Artificial Sequence
  MKO10000336_A_1700016K19Rik
  gRNA
ccucaaaguagcuaugcgcg

SEQ ID NO: 337 - RNA, 20 nt, Artificial Sequence
  MKO10000337_A_1700016K19Rik
  gRNA
cucaccauacuccgccgcac

SEQ ID NO: 338 - RNA, 20 nt, Artificial Sequence
  MKO10000338_A_1700016K19Rik
  gRNA
ugaggcgguaccgcuuccuu

SEQ ID NO: 339 - RNA, 20 nt, Artificial Sequence
  MKO10000339_A_1700017B05Rik
  gRNA
ggcacuccaggacgcucguu

SEQ ID NO: 340 - RNA, 20 nt, Artificial Sequence
  MKO10000340_A_1700017B05Rik
  gRNA
cuggaugggacguucuugcg

SEQ ID NO: 341 - RNA, 20 nt, Artificial Sequence
  MKO10000341_A_1700017B05Rik
  gRNA
aggcgaagaucgaucugcuc

SEQ ID NO: 342 - RNA, 20 nt, Artificial Sequence
  MKO10000342_A_1700017D01Rik
  gRNA
aaacaucauaaguaucuucg

SEQ ID NO: 343 - RNA, 20 nt, Artificial Sequence
  MKO10000343_A_1700017D01Rik
  gRNA
cagggugcacaaauaaugcu

SEQ ID NO: 344 - RNA, 20 nt, Artificial Sequence
  MKO10000344_A_1700017D01Rik
  gRNA
uuaugaaccagugcagcacu

SEQ ID NO: 345 - RNA, 20 nt, Artificial Sequence
  MKO10000345_A_1700017N19Rik
  gRNA
aaaaagcguagcuccgacag

SEQ ID NO: 346 - RNA, 20 nt, Artificial Sequence
  MKO10000346_A_1700017N19Rik
  gRNA
gggucuugauacguucucca

SEQ ID NO: 347 - RNA, 20 nt, Artificial Sequence
  MKO10000347_A_1700017N19Rik
  gRNA
auauacucacugcuacuugg

SEQ ID NO: 348 - RNA, 20 nt, Artificial Sequence
  MKO10000348_A_1700018B08Rik
  gRNA
ggagcaccggcaggacuuca

SEQ ID NO: 349 - RNA, 20 nt, Artificial Sequence
  MKO10000349_A_1700018B08Rik
  gRNA
gguaggucucgaagaugaug

SEQ ID NO: 350 - RNA, 20 nt, Artificial Sequence
  MKO10000350_A_1700018B08Rik
  gRNA
ccccaaacuugguguagcau

SEQ ID NO: 351 - RNA, 20 nt, Artificial Sequence
  MKO10000351_A_1700018C11Rik
  gRNA
gcccuccgaccgugucucau

SEQ ID NO: 352 - RNA, 20 nt, Artificial Sequence
  MKO10000352_A_1700018C11Rik
  gRNA
gcuaccgcacaguccgucgu

SEQ ID NO: 353 - RNA, 20 nt, Artificial Sequence
  MKO10000353_A_1700018C11Rik
  gRNA
accuguuauugagagcgcca

SEQ ID NO: 354 - RNA, 20 nt, Artificial Sequence
  MKO10000354_A_1700018F24Rik
  gRNA
cagugccauauucagcuuuc

SEQ ID NO: 355 - RNA, 20 nt, Artificial Sequence
  MKO10000355_A_1700018F24Rik
  gRNA
cuaucuuacacagugcaguu

SEQ ID NO: 356 - RNA, 20 nt, Artificial Sequence
  MKO10000356_A_1700018F24Rik
  gRNA
guaagauagaaauaacugcc

SEQ ID NO: 357 - RNA, 20 nt, Artificial Sequence
  MKO10000357_A_1700019A02Rik
  gRNA
agaagaauccgacauguuug

SEQ ID NO: 358 - RNA, 20 nt, Artificial Sequence
  MKO10000358_A_1700019A02Rik
  gRNA
ucauugaugcaauacuccug

SEQ ID NO: 359 - RNA, 20 nt, Artificial Sequence
  MKO10000359_A_1700019A02Rik
  gRNA
caucucauaaaguaucccuc

SEQ ID NO: 360 - RNA, 20 nt, Artificial Sequence
  MKO10000360_A_1700019B03Rik
  gRNA
cacauccaccaggugaacgu

SEQ ID NO: 361 - RNA, 20 nt, Artificial Sequence
  MKO10000361_A_1700019B03Rik
  gRNA
cuccaggaccaacguucacc

SEQ ID NO: 362 - RNA, 20 nt, Artificial Sequence
  MKO10000362_A_1700019B03Rik
  gRNA
uguguaggucugcuucacga

SEQ ID NO: 363 - RNA, 20 nt, Artificial Sequence
  MKO10000363_A_1700019D03Rik
  gRNA
gagcccucacucucgaugua

SEQ ID NO: 364 - RNA, 20 nt, Artificial Sequence
  MKO10000364_A_1700019D03Rik
  gRNA
ccuugaauucgcagaccguc

SEQ ID NO: 365 - RNA, 20 nt, Artificial Sequence
  MKO10000365_A_1700019D03Rik
  gRNA
caucccauacaucgagagug

SEQ ID NO: 366 - RNA, 20 nt, Artificial Sequence
  MKO10000366_A_1700019G17Rik
  gRNA
ucggaugugauaaaaagcca

SEQ ID NO: 367 - RNA, 20 nt, Artificial Sequence
  MKO10000367_A_1700019G17Rik
  gRNA
gcuuucuuggagaaauuacg

SEQ ID NO: 368 - RNA, 20 nt, Artificial Sequence
  MKO10000368_A_1700019G17Rik
  gRNA
cugauaaauguuuacugccu

SEQ ID NO: 369 - RNA, 20 nt, Artificial Sequence
  MKO10000369_A_1700019L03Rik
  gRNA
accccagguaucagcggaaa

SEQ ID NO: 370 - RNA, 20 nt, Artificial Sequence
  MKO10000370_A_1700019L03Rik
  gRNA
caaggaauacguguacaacc

SEQ ID NO: 371 - RNA, 20 nt, Artificial Sequence
  MKO10000371_A_1700019L03Rik
  gRNA
guucgaggcccaacuggccc

SEQ ID NO: 372 - RNA, 20 nt, Artificial Sequence
  MKO10000372_A_1700019N19Rik
  gRNA
ugcuacuuaccgcaguaucc

SEQ ID NO: 373 - RNA, 20 nt, Artificial Sequence
  MKO10000373_A_1700019N19Rik
  gRNA
ucccugugugaaagcguucc

SEQ ID NO: 374 - RNA, 20 nt, Artificial Sequence
  MKO10000374_A_1700019N19Rik
  gRNA
uugccaggaaagcuccagcg

SEQ ID NO: 375 - RNA, 20 nt, Artificial Sequence
  MKO10000375_A_1700019O17Rik
  gRNA
ucgcgaccacugguaucgga

SEQ ID NO: 376 - RNA, 20 nt, Artificial Sequence
  MKO10000376_A_1700019O17Rik
  gRNA
cugcccgaugacgucccacc

SEQ ID NO: 377 - RNA, 20 nt, Artificial Sequence
  MKO10000377_A_1700019O17Rik
  gRNA
ccguucagcuaugcgcuacc

SEQ ID NO: 378 - RNA, 20 nt, Artificial Sequence
  MKO10000378_A_1700020A23Rik
  gRNA
agcgagucaugugccccccc

SEQ ID NO: 379 - RNA, 20 nt, Artificial Sequence
  MKO10000379_A_1700020A23Rik
  gRNA
guggcacuuacccauagagc

SEQ ID NO: 380 - RNA, 20 nt, Artificial Sequence
  MKO10000380_A_1700020A23Rik
  gRNA
aagucugugucguggcaggu

SEQ ID NO: 381 - RNA, 20 nt, Artificial Sequence
  MKO10000381_A_1700020D05Rik
  gRNA
cccgucgccaagcuuucguc

SEQ ID NO: 382 - RNA, 20 nt, Artificial Sequence
  MKO10000382_A_1700020D05Rik
  gRNA
accugacgaaagcuuggcga

SEQ ID NO: 383 - RNA, 20 nt, Artificial Sequence
  MKO10000383_A_1700020D05Rik
  gRNA
gcuuguacccgaacacguag

SEQ ID NO: 384 - RNA, 20 nt, Artificial Sequence
  MKO10000384_A_1700020L24Rik
  gRNA
uuccaccgacgacgaagacg

SEQ ID NO: 385 - RNA, 20 nt, Artificial Sequence
  MKO10000385_A_1700020L24Rik
  gRNA
gccuggcggccccggcagac

SEQ ID NO: 386 - RNA, 20 nt, Artificial Sequence
  MKO10000386_A_1700020L24Rik
  gRNA
cgccgcgucuccaacacgca

SEQ ID NO: 387 - RNA, 20 nt, Artificial Sequence
  MKO10000387_A_1700020N15Rik
  gRNA
gaaauucaaauauaaaguca

SEQ ID NO: 388 - RNA, 20 nt, Artificial Sequence
  MKO10000388_A_1700020N15Rik
  gRNA
ucucauucuucuucacagcu

SEQ ID NO: 389 - RNA, 20 nt, Artificial Sequence
  MKO10000389_A_1700020N15Rik
  gRNA
gcuguccagcucauagcuug

SEQ ID NO: 390 - RNA, 20 nt, Artificial Sequence
  MKO10000390_A_1700021F05Rik
  gRNA
uccaucggcgcaacaccacc

SEQ ID NO: 391 - RNA, 20 nt, Artificial Sequence
  MKO10000391_A_1700021F05Rik
  gRNA
ucuucaggaugacgucguac

SEQ ID NO: 392 - RNA, 20 nt, Artificial Sequence
  MKO10000392_A_1700021F05Rik
  gRNA
agacgaagaggacuccgacg

SEQ ID NO: 393 - RNA, 20 nt, Artificial Sequence
  MKO10000393_A_1700021F07Rik
  gRNA
gcuucaucggauggcgaucc

SEQ ID NO: 394 - RNA, 20 nt, Artificial Sequence
  MKO10000394_A_1700021F07Rik
  gRNA
aucgccauccgaugaagccc

SEQ ID NO: 395 - RNA, 20 nt, Artificial Sequence
  MKO10000395_A_1700021F07Rik
  gRNA
gcugagcgguuucugcgcca

SEQ ID NO: 396 - RNA, 20 nt, Artificial Sequence
  MKO10000396_A_1700021K19Rik
  gRNA
uauaguccggaugcguccgg

SEQ ID NO: 397 - RNA, 20 nt, Artificial Sequence
  MKO10000397_A_1700021K19Rik
  gRNA
ggguaauuugaagacgacug

SEQ ID NO: 398 - RNA, 20 nt, Artificial Sequence
  MKO10000398_A_1700021K19Rik
  gRNA
uuggcagguguguugccgcc

SEQ ID NO: 399 - RNA, 20 nt, Artificial Sequence
  MKO10000399_A_1700022I11Rik
  gRNA
ccagugcaacuguacgccua

SEQ ID NO: 400 - RNA, 20 nt, Artificial Sequence
  MKO10000400_A_1700022I11Rik
  gRNA
uuaucugacguugagccugc

SEQ ID NO: 401 - RNA, 20 nt, Artificial Sequence
  MKO10000401_A_1700022I11Rik
  gRNA
ggccauacuagucuuguuca

SEQ ID NO: 402 - RNA, 20 nt, Artificial Sequence
  MKO10000402_A_1700022P22Rik
  gRNA
gaagcgcgaguccuacugcc

SEQ ID NO: 403 - RNA, 20 nt, Artificial Sequence
  MKO10000403_A_1700022P22Rik
  gRNA
aaucuguucccgaaaguacc

SEQ ID NO: 404 - RNA, 20 nt, Artificial Sequence
  MKO10000404_A_1700022P22Rik
  gRNA
agauauacuucauccaaaua

SEQ ID NO: 405 - RNA, 20 nt, Artificial Sequence
  MKO10000405_A_1700023E05Rik
  gRNA
ucguuaacaggaggcuguuu

SEQ ID NO: 406 - RNA, 20 nt, Artificial Sequence
  MKO10000406_A_1700023E05Rik
  gRNA
cccgacauuaugucccuaac

SEQ ID NO: 407 - RNA, 20 nt, Artificial Sequence
  MKO10000407_A_1700023E05Rik
  gRNA
ggccagcuucuggauccguu

SEQ ID NO: 408 - RNA, 20 nt, Artificial Sequence
  MKO10000408_A_1700023F06Rik
  gRNA
gaaaauugcccugcgcaacg

SEQ ID NO: 409 - RNA, 20 nt, Artificial Sequence
  MKO10000409_A_1700023F06Rik
  gRNA
ccuugaaugcaucucgugug

SEQ ID NO: 410 - RNA, 20 nt, Artificial Sequence
  MKO10000410_A_1700023F06Rik
  gRNA
ggccggaugacaggucucaa

SEQ ID NO: 411 - RNA, 20 nt, Artificial Sequence
  MKO10000411_A_1700024G13Rik
  gRNA
gcaccgcaccuaccgacugc

SEQ ID NO: 412 - RNA, 20 nt, Artificial Sequence
  MKO10000412_A_1700024G13Rik
  gRNA
gcuguagggcccauagcgca

SEQ ID NO: 413 - RNA, 20 nt, Artificial Sequence
  MKO10000413_A_1700024G13Rik
  gRNA
ggcauuuagcacagcgaucc

SEQ ID NO: 414 - RNA, 20 nt, Artificial Sequence
  MKO10000414_A_1700024P04Rik
  gRNA
acguugcucuagcaucaauu

SEQ ID NO: 415 - RNA, 20 nt, Artificial Sequence
  MKO10000415_A_1700024P04Rik
  gRNA
caucuucgaacgcauugcua

SEQ ID NO: 416 - RNA, 20 nt, Artificial Sequence
  MKO10000416_A_1700024P04Rik
  gRNA
gcaagcguagccagcuucuu

SEQ ID NO: 417 - RNA, 20 nt, Artificial Sequence
  MKO10000417_A_1700024P16Rik
  gRNA
ugcuuucgagacacgccagc

SEQ ID NO: 418 - RNA, 20 nt, Artificial Sequence
  MKO10000418_A_1700024P16Rik
  gRNA
auuucguaucugagacacuc

SEQ ID NO: 419 - RNA, 20 nt, Artificial Sequence
  MKO10000419_A_1700024P16Rik
  gRNA
ucuuaaucccgccauuggua

SEQ ID NO: 420 - RNA, 20 nt, Artificial Sequence
  MKO10000420_A_1700025F22Rik
  gRNA
agcaucuucgcaacacuagu

SEQ ID NO: 421 - RNA, 20 nt, Artificial Sequence
  MKO10000421_A_1700025F22Rik
  gRNA
ugcuuccaguuuagccuauc

SEQ ID NO: 422 - RNA, 20 nt, Artificial Sequence
  MKO10000422_A_1700025F22Rik
  gRNA
cuaguguugcgaagaugcuu

SEQ ID NO: 423 - RNA, 20 nt, Artificial Sequence
  MKO10000423_A_1700025G04Rik
  gRNA
aaagugccagcucgaacaca

SEQ ID NO: 424 - RNA, 20 nt, Artificial Sequence
  MKO10000424_A_1700025G04Rik
  gRNA
uuuaagccuuguguucgagc

SEQ ID NO: 425 - RNA, 20 nt, Artificial Sequence
  MKO10000425_A_1700025G04Rik
  gRNA
ugaguauaggaucaaacccg

SEQ ID NO: 426 - RNA, 20 nt, Artificial Sequence
  MKO10000426_A_1700026D08Rik
  gRNA
cggcgcaaacagcugcgaaa

SEQ ID NO: 427 - RNA, 20 nt, Artificial Sequence
  MKO10000427_A_1700026D08Rik
  gRNA
ugaucacuuuaucgccauag

SEQ ID NO: 428 - RNA, 20 nt, Artificial Sequence
  MKO10000428_A_1700026D08Rik
  gRNA
ugugcagaccaucgccccga

SEQ ID NO: 429 - RNA, 20 nt, Artificial Sequence
  MKO10000429_A_1700026L06Rik
  gRNA
aggcaucaccugcucgauac

SEQ ID NO: 430 - RNA, 20 nt, Artificial Sequence
  MKO10000430_A_1700026L06Rik
  gRNA
cugcagguauccgcacgaag

SEQ ID NO: 431 - RNA, 20 nt, Artificial Sequence
  MKO10000431_A_1700026L06Rik
  gRNA
ggcugaccacgccuccauag

SEQ ID NO: 432 - RNA, 20 nt, Artificial Sequence
  MKO10000432_A_1700028K03Rik
  gRNA
auggcaauggaugagcguag

SEQ ID NO: 433 - RNA, 20 nt, Artificial Sequence
  MKO10000433_A_1700028K03Rik
  gRNA
ccuuaugugcacuauagcca

SEQ ID NO: 434 - RNA, 20 nt, Artificial Sequence
  MKO10000434_A_1700028K03Rik
  gRNA
uaucagaauaccgaaccuug

SEQ ID NO: 435 - RNA, 20 nt, Artificial Sequence
  MKO10000435_A_1700028P14Rik
  gRNA
augucaacauacaagcgauu

SEQ ID NO: 436 - RNA, 20 nt, Artificial Sequence
  MKO10000436_A_1700028P14Rik
  gRNA
ggugguggauauucauacug

SEQ ID NO: 437 - RNA, 20 nt, Artificial Sequence
  MKO10000437_A_1700028P14Rik
  gRNA
agauuaugauauagagaguc

SEQ ID NO: 438 - RNA, 20 nt, Artificial Sequence
  MKO10000438_A_1700029F12Rik
  gRNA
guuggccguccaugugacau

SEQ ID NO: 439 - RNA, 20 nt, Artificial Sequence
  MKO10000439_A_1700029F12Rik
  gRNA
guagccacugcuauacugcg

SEQ ID NO: 440 - RNA, 20 nt, Artificial Sequence
  MKO10000440_A_1700029F12Rik
  gRNA
acuugguaaacauuagcauc

SEQ ID NO: 441 - RNA, 20 nt, Artificial Sequence
  MKO10000441_A_1700029H14Rik
  gRNA
agaaggaccccgccgcgcac

SEQ ID NO: 442 - RNA, 20 nt, Artificial Sequence
  MKO10000442_A_1700029H14Rik
  gRNA
cuccagucgggugagccuag

SEQ ID NO: 443 - RNA, 20 nt, Artificial Sequence
  MKO10000443_A_1700029H14Rik
  gRNA
acgauguaucucugcggcug

SEQ ID NO: 444 - RNA, 20 nt, Artificial Sequence
  MKO10000444_A_1700029I15Rik
  gRNA
cccagcagcgcaagcgggac

SEQ ID NO: 445 - RNA, 20 nt, Artificial Sequence
  MKO10000445_A_1700029I15Rik
  gRNA
acaaugguucucgccaugcu

SEQ ID NO: 446 - RNA, 20 nt, Artificial Sequence
  MKO10000446_A_1700029I15Rik
  gRNA
ggagugcgccugccaagaug

SEQ ID NO: 447 - RNA, 20 nt, Artificial Sequence
  MKO10000447_A_1700029J07Rik
  gRNA
gugacccuuugauuagucga

SEQ ID NO: 448 - RNA, 20 nt, Artificial Sequence
  MKO10000448_A_1700029J07Rik
  gRNA
cgcagcgagacagaguuaua

SEQ ID NO: 449 - RNA, 20 nt, Artificial Sequence
  MKO10000449_A_1700029J07Rik
  gRNA
uuucuuugguuccccccggu

SEQ ID NO: 450 - RNA, 20 nt, Artificial Sequence
  MKO10000450_A_1700029P11Rik
  gRNA
ucgucguaaccauggaagug

SEQ ID NO: 451 - RNA, 20 nt, Artificial Sequence
  MKO10000451_A_1700029P11Rik
  gRNA
ccgguccgcugcggcccgaa

SEQ ID NO: 452 - RNA, 20 nt, Artificial Sequence
  MKO10000452_A_1700029P11Rik
  gRNA
uuacgacgacgacccgaagg

SEQ ID NO: 453 - RNA, 20 nt, Artificial Sequence
  MKO10000453_A_1700030F18Rik
  gRNA
ccgcugaaguuugguaaauc

SEQ ID NO: 454 - RNA, 20 nt, Artificial Sequence
  MKO10000454_A_1700030F18Rik
  gRNA
auuuaccaaacuucagcggc

SEQ ID NO: 455 - RNA, 20 nt, Artificial Sequence
  MKO10000455_A_1700030F18Rik
  gRNA
agacaggucagcguuccaca

SEQ ID NO: 456 - RNA, 20 nt, Artificial Sequence
  MKO10000456_A_1700030J22Rik
  gRNA
ugcauucccaccgacgugca

SEQ ID NO: 457 - RNA, 20 nt, Artificial Sequence
  MKO10000457_A_1700030J22Rik
  gRNA
ggcaagguaguggaugucgc

SEQ ID NO: 458 - RNA, 20 nt, Artificial Sequence
  MKO10000458_A_1700030J22Rik
  gRNA
ggcaccaacuuuacauuguc

SEQ ID NO: 459 - RNA, 20 nt, Artificial Sequence
  MKO10000459_A_1700030K09Rik
  gRNA
cccauacagucgacucgcgu

SEQ ID NO: 460 - RNA, 20 nt, Artificial Sequence
  MKO10000460_A_1700030K09Rik
  gRNA
aacgauaucugucugaccac

SEQ ID NO: 461 - RNA, 20 nt, Artificial Sequence
  MKO10000461_A_1700030K09Rik
  gRNA
gccaacgcgagucgacugua

SEQ ID NO: 462 - RNA, 20 nt, Artificial Sequence
  MKO10000462_A_1700031F05Rik
  gRNA
gggcccagucgucuccaccc

SEQ ID NO: 463 - RNA, 20 nt, Artificial Sequence
  MKO10000463_A_1700031F05Rik
  gRNA
cacugccgccccugucaagc

SEQ ID NO: 464 - RNA, 20 nt, Artificial Sequence
  MKO10000464_A_1700031F05Rik
  gRNA
ccugguugaacguguuauuc

SEQ ID NO: 465 - RNA, 20 nt, Artificial Sequence
  MKO10000465_A_1700034E13Rik
  gRNA
gguccgcccacaaacguuac

SEQ ID NO: 466 - RNA, 20 nt, Artificial Sequence
  MKO10000466_A_1700034E13Rik
  gRNA
acgccuuaaacgaagcugcu

SEQ ID NO: 467 - RNA, 20 nt, Artificial Sequence
  MKO10000467_A_1700034E13Rik
  gRNA
cucaugaaugcuaauagauu

SEQ ID NO: 468 - RNA, 20 nt, Artificial Sequence
  MKO10000468_A_1700034F02Rik
  gRNA
acacucacuuugcuucgagu

SEQ ID NO: 469 - RNA, 20 nt, Artificial Sequence
  MKO10000469_A_1700034F02Rik
  gRNA
aacauucauaccgaaacugc

SEQ ID NO: 470 - RNA, 20 nt, Artificial Sequence
  MKO10000470_A_1700034F02Rik
  gRNA
uaaacuaccguagauagcuu

SEQ ID NO: 471 - RNA, 20 nt, Artificial Sequence
  MKO10000471_A_1700034J05Rik
  gRNA
ggacacaaaucuucucccga

SEQ ID NO: 472 - RNA, 20 nt, Artificial Sequence
  MKO10000472_A_1700034J05Rik
  gRNA
guuacugaaagacgaaguug

SEQ ID NO: 473 - RNA, 20 nt, Artificial Sequence
  MKO10000473_A_1700034J05Rik
  gRNA
agaguccacaucgauauccc

SEQ ID NO: 474 - RNA, 20 nt, Artificial Sequence
  MKO10000474_A_1700034O15Rik
  gRNA
gguccuggagaguuauugcc

SEQ ID NO: 475 - RNA, 20 nt, Artificial Sequence
  MKO10000475_A_1700034O15Rik
  gRNA
gcaagaagacacgaucuccc

SEQ ID NO: 476 - RNA, 20 nt, Artificial Sequence
  MKO10000476_A_1700034O15Rik
  gRNA
gaggagacccaugacuucuc

SEQ ID NO: 477 - RNA, 20 nt, Artificial Sequence
  MKO10000477_A_1700037C18Rik
  gRNA
acuuccgacugcgacaccuc

SEQ ID NO: 478 - RNA, 20 nt, Artificial Sequence
  MKO10000478_A_1700037C18Rik
  gRNA
uugugcaagagaacccgcuc

SEQ ID NO: 479 - RNA, 20 nt, Artificial Sequence
  MKO10000479_A_1700037C18Rik
  gRNA
gugucgcagucggaaguucu

SEQ ID NO: 480 - RNA, 20 nt, Artificial Sequence
  MKO10000480_A_1700037H04Rik
  gRNA
gauuggcucggcuucgacug

SEQ ID NO: 481 - RNA, 20 nt, Artificial Sequence
  MKO10000481_A_1700037H04Rik
  gRNA
cugcugcaaagcggauacuu

SEQ ID NO: 482 - RNA, 20 nt, Artificial Sequence
  MKO10000482_A_1700037H04Rik
  gRNA
cgaaguauccgcuuugcagc

SEQ ID NO: 483 - RNA, 20 nt, Artificial Sequence
  MKO10000483_A_1700039E15Rik
  gRNA
gcaacgucacguagcuccac

SEQ ID NO: 484 - RNA, 20 nt, Artificial Sequence
  MKO10000484_A_1700039E15Rik
  gRNA
ggaccaggaggucaucgaac

SEQ ID NO: 485 - RNA, 20 nt, Artificial Sequence
  MKO10000485_A_1700039E15Rik
  gRNA
auaccacguagcugccaggg

SEQ ID NO: 486 - RNA, 20 nt, Artificial Sequence
  MKO10000486_A_1700040L02Rik
  gRNA
acucguagagccuguagugc

SEQ ID NO: 487 - RNA, 20 nt, Artificial Sequence
  MKO10000487_A_1700040L02Rik
  gRNA
ccugcgugacgccauccucu

SEQ ID NO: 488 - RNA, 20 nt, Artificial Sequence
  MKO10000488_A_1700040L02Rik
  gRNA
uggcgucacgcaggcaaguc

SEQ ID NO: 489 - RNA, 20 nt, Artificial Sequence
  MKO10000489_A_1700042B14Rik
  gRNA
uccucgaauauacaaaggaa

SEQ ID NO: 490 - RNA, 20 nt, Artificial Sequence
  MKO10000490_A_1700042B14Rik
  gRNA
cuauguuuaaauuugaagaa

SEQ ID NO: 491 - RNA, 20 nt, Artificial Sequence
  MKO10000491_A_1700042B14Rik
  gRNA
augccguugaaaaagugcca

SEQ ID NO: 492 - RNA, 20 nt, Artificial Sequence
  MKO10000492_A_1700042G07Rik
  gRNA
guauguucaaguguagccgc

SEQ ID NO: 493 - RNA, 20 nt, Artificial Sequence
  MKO10000493_A_1700042G07Rik
  gRNA
acauaccggcagaaaccccg

SEQ ID NO: 494 - RNA, 20 nt, Artificial Sequence
  MKO10000494_A_1700042G07Rik
  gRNA
cucagauuucucugucaacc

SEQ ID NO: 495 - RNA, 20 nt, Artificial Sequence
  MKO10000495_A_1700047I17Rik2
  gRNA
caagcauaccgggucgacag

SEQ ID NO: 496 - RNA, 20 nt, Artificial Sequence
  MKO10000496_A_1700047I17Rik2
  gRNA
cuauagauaaguaaugaaag

SEQ ID NO: 497 - RNA, 20 nt, Artificial Sequence
  MKO10000497_A_1700047I17Rik2
  gRNA
aguaccugagaggguugaug

SEQ ID NO: 498 - RNA, 20 nt, Artificial Sequence
  MKO10000498_A_1700049G17Rik
  gRNA
aaguagaauucuugaucucg

SEQ ID NO: 499 - RNA, 20 nt, Artificial Sequence
  MKO10000499_A_1700049G17Rik
  gRNA
gcucaagccuauugcaccau

SEQ ID NO: 500 - RNA, 20 nt, Artificial Sequence
  MKO10000500_A_1700049G17Rik
  gRNA
agagcccuggauggcuguga

SEQ ID NO: 501 - RNA, 20 nt, Artificial Sequence
  MKO10000501_A_1700052N19Rik
  gRNA
ggagaacuucuucgagucgc

SEQ ID NO: 502 - RNA, 20 nt, Artificial Sequence
  MKO10000502_A_1700052N19Rik
  gRNA
ugcaguucagcguauaaguc

SEQ ID NO: 503 - RNA, 20 nt, Artificial Sequence
  MKO10000503_A_1700052N19Rik
  gRNA
cuuugcauaucuuacgauua

SEQ ID NO: 504 - RNA, 20 nt, Artificial Sequence
  MKO10000504_A_1700054O13Rik
  gRNA
aacgaccgcgaacccucucg

SEQ ID NO: 505 - RNA, 20 nt, Artificial Sequence
  MKO10000505_A_1700054O13Rik
  gRNA
cgcauucuugaagccucgag

SEQ ID NO: 506 - RNA, 20 nt, Artificial Sequence
  MKO10000506_A_1700054O13Rik
  gRNA
uuaccucaccgacuacaucc

SEQ ID NO: 507 - RNA, 20 nt, Artificial Sequence
  MKO10000507_A_1700055N04Rik
  gRNA
caaacagcuucaugacgccc

SEQ ID NO: 508 - RNA, 20 nt, Artificial Sequence
  MKO10000508_A_1700055N04Rik
  gRNA
agacaaagacggcuaaguuc

SEQ ID NO: 509 - RNA, 20 nt, Artificial Sequence
  MKO10000509_A_1700055N04Rik
  gRNA
agcugagcacagcuuucauc

SEQ ID NO: 510 - RNA, 20 nt, Artificial Sequence
  MKO10000510_A_1700056E22Rik
  gRNA
cccgacuccgaucccgaagg

SEQ ID NO: 511 - RNA, 20 nt, Artificial Sequence
  MKO10000511_A_1700056E22Rik
  gRNA
gccgccuucgggaucggagu

SEQ ID NO: 512 - RNA, 20 nt, Artificial Sequence
  MKO10000512_A_1700056E22Rik
  gRNA
ugcccuacugcucucccgcg

SEQ ID NO: 513 - RNA, 20 nt, Artificial Sequence
  MKO10000513_A_1700057G04Rik
  gRNA
ccaaucugcgugugcaacau

SEQ ID NO: 514 - RNA, 20 nt, Artificial Sequence
  MKO10000514_A_1700057G04Rik
  gRNA
ccgccuucaucuuuacaucg

SEQ ID NO: 515 - RNA, 20 nt, Artificial Sequence
  MKO10000515_A_1700057G04Rik
  gRNA
caacaacaaucacaucguag

SEQ ID NO: 516 - RNA, 20 nt, Artificial Sequence
  MKO10000516_A_1700061G19Rik
  gRNA
ggccucguaguacucgaugu

SEQ ID NO: 517 - RNA, 20 nt, Artificial Sequence
  MKO10000517_A_1700061G19Rik
  gRNA
ucccgacuugaucaugagcg

SEQ ID NO: 518 - RNA, 20 nt, Artificial Sequence
  MKO10000518_A_1700061G19Rik
  gRNA
gugggucuggaacgcuuuca

SEQ ID NO: 519 - RNA, 20 nt, Artificial Sequence
  MKO10000519_A_1700065D16Rik
  gRNA
cgucgccagcuucgagucgc

SEQ ID NO: 520 - RNA, 20 nt, Artificial Sequence
  MKO10000520_A_1700065D16Rik
  gRNA
aagccgcucucgguugcggu

SEQ ID NO: 521 - RNA, 20 nt, Artificial Sequence
  MKO10000521_A_1700065D16Rik
  gRNA
cagagaccaaagcgacaggc

SEQ ID NO: 522 - RNA, 20 nt, Artificial Sequence
  MKO10000522_A_1700065I17Rik
  gRNA
gggacgauauucacuugccc

SEQ ID NO: 523 - RNA, 20 nt, Artificial Sequence
  MKO10000523_A_1700065I17Rik
  gRNA
cgacccguuacgucaugccu

SEQ ID NO: 524 - RNA, 20 nt, Artificial Sequence
  MKO10000524_A_1700065I17Rik
  gRNA
gucgucgucgaguuugggua

SEQ ID NO: 525 - RNA, 20 nt, Artificial Sequence
  MKO10000525_A_1700066B19Rik
  gRNA
cagcccgucgccaccucgag

SEQ ID NO: 526 - RNA, 20 nt, Artificial Sequence
  MKO10000526_A_1700066B19Rik
  gRNA
guagacucaguagccgccag

SEQ ID NO: 527 - RNA, 20 nt, Artificial Sequence
  MKO10000527_A_1700066B19Rik
  gRNA
cucccagauaugcccccucg

SEQ ID NO: 528 - RNA, 20 nt, Artificial Sequence
  MKO10000528_A_1700066M21Rik
  gRNA
cgcguuaccugcacgucccc

SEQ ID NO: 529 - RNA, 20 nt, Artificial Sequence
  MKO10000529_A_1700066M21Rik
  gRNA
cagacgccgcgaccccagca

SEQ ID NO: 530 - RNA, 20 nt, Artificial Sequence
  MKO10000530_A_1700066M21Rik
  gRNA
ucuaauccuucuacuaguaa

SEQ ID NO: 531 - RNA, 20 nt, Artificial Sequence
  MKO10000531_A_1700067K01Rik
  gRNA
ccugcaggaguugguccgga

SEQ ID NO: 532 - RNA, 20 nt, Artificial Sequence
  MKO10000532_A_1700067K01Rik
  gRNA
uaggggcauccaucggccaa

SEQ ID NO: 533 - RNA, 20 nt, Artificial Sequence
  MKO10000533_A_1700067K01Rik
  gRNA
cagaggaugaucuugacucg

SEQ ID NO: 534 - RNA, 20 nt, Artificial Sequence
  MKO10000534_A_1700067P10Rik
  gRNA
acacgcucauaggcaccagc

SEQ ID NO: 535 - RNA, 20 nt, Artificial Sequence
  MKO10000535_A_1700067P10Rik
  gRNA
gaucccgccaagauaacagc

SEQ ID NO: 536 - RNA, 20 nt, Artificial Sequence
  MKO10000536_A_1700067P10Rik
  gRNA
gaucauguccuugggaaaga

SEQ ID NO: 537 - RNA, 20 nt, Artificial Sequence
  MKO10000537_A_1700071K01Rik
  gRNA
ucuucacaugaauuccccua

SEQ ID NO: 538 - RNA, 20 nt, Artificial Sequence
  MKO10000538_A_1700071K01Rik
  gRNA
gagcucugcuuuauauaacg

SEQ ID NO: 539 - RNA, 20 nt, Artificial Sequence
  MKO10000539_A_1700071K01Rik
  gRNA
augggcugauuggccggaga

SEQ ID NO: 540 - RNA, 20 nt, Artificial Sequence
  MKO10000540_A_1700074P13Rik
  gRNA
gggugcauggaauauugucc

SEQ ID NO: 541 - RNA, 20 nt, Artificial Sequence
  MKO10000541_A_1700074P13Rik
  gRNA
cccaagaacuaaaauccgac

SEQ ID NO: 542 - RNA, 20 nt, Artificial Sequence
  MKO10000542_A_1700074P13Rik
  gRNA
gacucucauugacccucagu

SEQ ID NO: 543 - RNA, 20 nt, Artificial Sequence
  MKO10000543_A_1700080E11Rik
  gRNA
augcuguaugcgcccgaucc

SEQ ID NO: 544 - RNA, 20 nt, Artificial Sequence
  MKO10000544_A_1700080E11Rik
  gRNA
cagucgcccaucaaagcgca

SEQ ID NO: 545 - RNA, 20 nt, Artificial Sequence
  MKO10000545_A_1700080E11Rik
  gRNA
cgaucguccacaaaaccacc

SEQ ID NO: 546 - RNA, 20 nt, Artificial Sequence
  MKO10000546_A_1700080O16Rik
  gRNA
uuucgaggcguaccaaagau

SEQ ID NO: 547 - RNA, 20 nt, Artificial Sequence
  MKO10000547_A_1700080O16Rik
  gRNA
gggauccuguuuaacgaugc

SEQ ID NO: 548 - RNA, 20 nt, Artificial Sequence
  MKO10000548_A_1700080O16Rik
  gRNA
acgccacaacuccugcucgc

SEQ ID NO: 549 - RNA, 20 nt, Artificial Sequence
  MKO10000549_A_1700084C01Rik
  gRNA
aucacgugaaaucgcuagcc

SEQ ID NO: 550 - RNA, 20 nt, Artificial Sequence
  MKO10000550_A_1700084C01Rik
  gRNA
cuagcgauuucacgugauag

SEQ ID NO: 551 - RNA, 20 nt, Artificial Sequence
  MKO10000551_A_1700084C01Rik
  gRNA
cagucccggagccuaaaauu

SEQ ID NO: 552 - RNA, 20 nt, Artificial Sequence
  MKO10000552_A_1700088E04Rik
  gRNA
uucacgacuguacgccccau

SEQ ID NO: 553 - RNA, 20 nt, Artificial Sequence
  MKO10000553_A_1700088E04Rik
  gRNA
cugggucuucuugccgcacg

SEQ ID NO: 554 - RNA, 20 nt, Artificial Sequence
  MKO10000554_A_1700088E04Rik
  gRNA
gcaguaccgcagcaucaucc

SEQ ID NO: 555 - RNA, 20 nt, Artificial Sequence
  MKO10000555_A_1700092M07Rik
  gRNA
ggcuauccauguucagccgu

SEQ ID NO: 556 - RNA, 20 nt, Artificial Sequence
  MKO10000556_A_1700092M07Rik
  gRNA
guccugcuugccugaccgcg

SEQ ID NO: 557 - RNA, 20 nt, Artificial Sequence
  MKO10000557_A_1700092M07Rik
  gRNA
cggggccaugggcugcuguc

SEQ ID NO: 558 - RNA, 20 nt, Artificial Sequence
  MKO10000558_A_1700093K21Rik
  gRNA
uguucucgagcauagcuucg

SEQ ID NO: 559 - RNA, 20 nt, Artificial Sequence
  MKO10000559_A_1700093K21Rik
  gRNA
cgcagccuucgccuguacag

SEQ ID NO: 560 - RNA, 20 nt, Artificial Sequence
  MKO10000560_A_1700093K21Rik
  gRNA
aagcuaugcucgagaacaua

SEQ ID NO: 561 - RNA, 20 nt, Artificial Sequence
  MKO10000561_A_1700094D03Rik
  gRNA
cacuuaagaagacugucgac

SEQ ID NO: 562 - RNA, 20 nt, Artificial Sequence
  MKO10000562_A_1700094D03Rik
  gRNA
cagcaaauagguuucuccgu

SEQ ID NO: 563 - RNA, 20 nt, Artificial Sequence
  MKO10000563_A_1700094D03Rik
  gRNA
gucuaacaaacagcuacuag

SEQ ID NO: 564 - RNA, 20 nt, Artificial Sequence
  MKO10000564_A_1700101E01Rik
  gRNA
aacuauauugccaugaaccg

SEQ ID NO: 565 - RNA, 20 nt, Artificial Sequence
  MKO10000565_A_1700101E01Rik
  gRNA
uauaguuccgggucagcucg

SEQ ID NO: 566 - RNA, 20 nt, Artificial Sequence
  MKO10000566_A_1700101E01Rik
  gRNA
guacaagccuccggugaagc

SEQ ID NO: 567 - RNA, 20 nt, Artificial Sequence
  MKO10000567_A_1700102P08Rik
  gRNA
auauggugugucccgaaggc

SEQ ID NO: 568 - RNA, 20 nt, Artificial Sequence
  MKO10000568_A_1700102P08Rik
  gRNA
uauccgaacuauugaagaau

SEQ ID NO: 569 - RNA, 20 nt, Artificial Sequence
  MKO10000569_A_1700102P08Rik
  gRNA
cuucgggacacaccauauuc

SEQ ID NO: 570 - RNA, 20 nt, Artificial Sequence
  MKO10000570_A_1700106J16Rik
  gRNA
ccgaggcaucguccgcaaca

SEQ ID NO: 571 - RNA, 20 nt, Artificial Sequence
  MKO10000571_A_1700106J16Rik
  gRNA
acugaaggccauccguuacu

SEQ ID NO: 572 - RNA, 20 nt, Artificial Sequence
  MKO10000572_A_1700106J16Rik
  gRNA
ccaacauguucuccaaccgc

SEQ ID NO: 573 - RNA, 20 nt, Artificial Sequence
  MKO10000573_A_1700109H08Rik
  gRNA
cuggacugcaacacauuucg

SEQ ID NO: 574 - RNA, 20 nt, Artificial Sequence
  MKO10000574_A_1700109H08Rik
  gRNA
uguaaguccaccuuugcauc

SEQ ID NO: 575 - RNA, 20 nt, Artificial Sequence
  MKO10000575_A_1700109H08Rik
  gRNA
ucauuccgaauauguucugc

SEQ ID NO: 576 - RNA, 20 nt, Artificial Sequence
  MKO10000576_A_1700110M21Rik
  gRNA
acccggccaugccccagucg

SEQ ID NO: 577 - RNA, 20 nt, Artificial Sequence
  MKO10000577_A_1700110M21Rik
  gRNA
ucaguccccuucccgccuuc

SEQ ID NO: 578 - RNA, 20 nt, Artificial Sequence
  MKO10000578_A_1700110M21Rik
  gRNA
uuugaguccgaagagaagug

SEQ ID NO: 579 - RNA, 20 nt, Artificial Sequence
  MKO10000579_A_1700112E06Rik
  gRNA
aauuugcagguguccuacgu

SEQ ID NO: 580 - RNA, 20 nt, Artificial Sequence
  MKO10000580_A_1700112E06Rik
  gRNA
gcugcccaaguugaaguuuc

SEQ ID NO: 581 - RNA, 20 nt, Artificial Sequence
  MKO10000581_A_1700112E06Rik
  gRNA
cguggcaugucccaaugagc

SEQ ID NO: 582 - RNA, 20 nt, Artificial Sequence
  MKO10000582_A_1700113H08Rik
  gRNA
gcgguaaaaggucucagcgc

SEQ ID NO: 583 - RNA, 20 nt, Artificial Sequence
  MKO10000583_A_1700113H08Rik
  gRNA
uaucucuuuccccgcccgug

SEQ ID NO: 584 - RNA, 20 nt, Artificial Sequence
  MKO10000584_A_1700113H08Rik
  gRNA
gucugauuggguagucgucu

SEQ ID NO: 585 - RNA, 20 nt, Artificial Sequence
  MKO10000585_A_1700122O11Rik
  gRNA
ggaggguugauaauaaccgg

SEQ ID NO: 586 - RNA, 20 nt, Artificial Sequence
  MKO10000586_A_1700122O11Rik
  gRNA
uucaaucuggacgcugauag

SEQ ID NO: 587 - RNA, 20 nt, Artificial Sequence
  MKO10000587_A_1700122O11Rik
  gRNA
aucuuccaaugaugagaucu

SEQ ID NO: 588 - RNA, 20 nt, Artificial Sequence
  MKO10000588_A_1700123I01Rik
  gRNA
ggaagucaucguccaggagc

SEQ ID NO: 589 - RNA, 20 nt, Artificial Sequence
  MKO10000589_A_1700123I01Rik
  gRNA
ucccaccugaaguuuaaaca

SEQ ID NO: 590 - RNA, 20 nt, Artificial Sequence
  MKO10000590_A_1700123I01Rik
  gRNA
uuuccccauguuuaaacuuc

SEQ ID NO: 591 - RNA, 20 nt, Artificial Sequence
  MKO10000591_A_1700123K08Rik
  gRNA
cucgacucuuguaguugaac

SEQ ID NO: 592 - RNA, 20 nt, Artificial Sequence
  MKO10000592_A_1700123K08Rik
  gRNA
uuccucaaguuuaagugcga

SEQ ID NO: 593 - RNA, 20 nt, Artificial Sequence
  MKO10000593_A_1700123K08Rik
  gRNA
gucaguucacggaguacgug

SEQ ID NO: 594 - RNA, 20 nt, Artificial Sequence
  MKO10000594_A_1700123O20Rik
  gRNA
ccggcacugccuuagcgacc

SEQ ID NO: 595 - RNA, 20 nt, Artificial Sequence
  MKO10000595_A_1700123O20Rik
  gRNA
ccuguagaaaacguucccgc

SEQ ID NO: 596 - RNA, 20 nt, Artificial Sequence
  MKO10000596_A_1700123O20Rik
  gRNA
uaaaacuucgccacgaaauc

SEQ ID NO: 597 - RNA, 20 nt, Artificial Sequence
  MKO10000597_A_1700125H20Rik
  gRNA
ugcagcauuauugccgagcc

SEQ ID NO: 598 - RNA, 20 nt, Artificial Sequence
  MKO10000598_A_1700125H20Rik
  gRNA
acggaccagagcaucucccg

SEQ ID NO: 599 - RNA, 20 nt, Artificial Sequence
  MKO10000599_A_1700125H20Rik
  gRNA
ugggcagguucaacuuucga

SEQ ID NO: 600 - RNA, 20 nt, Artificial Sequence
  MKO10000600_A_1700129C05Rik
  gRNA
cuccaucccgaaauguuauu

SEQ ID NO: 601 - RNA, 20 nt, Artificial Sequence
  MKO10000601_A_1700129C05Rik
  gRNA
ccccacuuaccaaggaugug

SEQ ID NO: 602 - RNA, 20 nt, Artificial Sequence
  MKO10000602_A_1700129C05Rik
  gRNA
cuagacccagagcuuaaaau

SEQ ID NO: 603 - RNA, 20 nt, Artificial Sequence
  MKO10000603_A_1810009A15Rik
  gRNA
guacguacgcccgcuucuug

SEQ ID NO: 604 - RNA, 20 nt, Artificial Sequence
  MKO10000604_A_1810009A15Rik
  gRNA
uauuaagcagggaucggcga

SEQ ID NO: 605 - RNA, 20 nt, Artificial Sequence
  MKO10000605_A_1810009A15Rik
  gRNA
gaguguagccauggcaccuc

SEQ ID NO: 606 - RNA, 20 nt, Artificial Sequence
  MKO10000606_A_1810009J06Rik
  gRNA
guacccacugaucacugaua

SEQ ID NO: 607 - RNA, 20 nt, Artificial Sequence
  MKO10000607_A_1810009J06Rik
  gRNA
aucucuccauugcagacgac

SEQ ID NO: 608 - RNA, 20 nt, Artificial Sequence
  MKO10000608_A_1810009J06Rik
  gRNA
gcucccuuaucagugaucag

SEQ ID NO: 609 - RNA, 20 nt, Artificial Sequence
  MKO10000609_A_1810010H24Rik
  gRNA
gccuauugcgccagcgaauu

SEQ ID NO: 610 - RNA, 20 nt, Artificial Sequence
  MKO10000610_A_1810010H24Rik
  gRNA
agcgcgcucaccgaauucgc

SEQ ID NO: 611 - RNA, 20 nt, Artificial Sequence
  MKO10000611_A_1810010H24Rik
  gRNA
cacugugcgaaagucccucg

SEQ ID NO: 612 - RNA, 20 nt, Artificial Sequence
  MKO10000612_A_1810011H11Rik
  gRNA
cauuaucagacaagugucuc

SEQ ID NO: 613 - RNA, 20 nt, Artificial Sequence
  MKO10000613_A_1810011H11Rik
  gRNA
ccuugaagaucugcaugauc

SEQ ID NO: 614 - RNA, 20 nt, Artificial Sequence
  MKO10000614_A_1810011H11Rik
  gRNA
cuaccuaucucagucucagc

SEQ ID NO: 615 - RNA, 20 nt, Artificial Sequence
  MKO10000615_A_1810011O10Rik
  gRNA
cgggcuuacucgaagagacg

SEQ ID NO: 616 - RNA, 20 nt, Artificial Sequence
  MKO10000616_A_1810011O10Rik
  gRNA
cgaguaagcccguccaucca

SEQ ID NO: 617 - RNA, 20 nt, Artificial Sequence
  MKO10000617_A_1810011O10Rik
  gRNA
agccgcucgcaagaaagcug

SEQ ID NO: 618 - RNA, 20 nt, Artificial Sequence
  MKO10000618_A_1810013L24Rik
  gRNA
agcgugcguucgaguacccc

SEQ ID NO: 619 - RNA, 20 nt, Artificial Sequence
  MKO10000619_A_1810013L24Rik
  gRNA
uggcuaucagcgacgcaaua

SEQ ID NO: 620 - RNA, 20 nt, Artificial Sequence
  MKO10000620_A_1810013L24Rik
  gRNA
ggagcucuagaguuucgugg

SEQ ID NO: 621 - RNA, 20 nt, Artificial Sequence
  MKO10000621_A_1810019J16Rik
  gRNA
agcgcucaucguucguuucc

SEQ ID NO: 622 - RNA, 20 nt, Artificial Sequence
  MKO10000622_A_1810019J16Rik
  gRNA
cgugcaccagauugacgagc

SEQ ID NO: 623 - RNA, 20 nt, Artificial Sequence
  MKO10000623_A_1810019J16Rik
  gRNA
caaccgcagaugccaucgcc

SEQ ID NO: 624 - RNA, 20 nt, Artificial Sequence
  MKO10000624_A_1810022K09Rik
  gRNA
cugagcagccgcgugaacuu

SEQ ID NO: 625 - RNA, 20 nt, Artificial Sequence
  MKO10000625_A_1810022K09Rik
  gRNA
aguuacuacuaaucuuaaga

SEQ ID NO: 626 - RNA, 20 nt, Artificial Sequence
  MKO10000626_A_1810022K09Rik
  gRNA
gcuucucaccaaaguucacg

SEQ ID NO: 627 - RNA, 20 nt, Artificial Sequence
  MKO10000627_A_1810024B03Rik
  gRNA
ccaagcgacauauggagucu

SEQ ID NO: 628 - RNA, 20 nt, Artificial Sequence
  MKO10000628_A_1810024B03Rik
  gRNA
ugucauucacggcgcagcca

SEQ ID NO: 629 - RNA, 20 nt, Artificial Sequence
  MKO10000629_A_1810024B03Rik
  gRNA
aagaaguauuggcauacccg

SEQ ID NO: 630 - RNA, 20 nt, Artificial Sequence
  MKO10000630_A_1810026J23Rik
  gRNA
ccccggccggauccucgacg

SEQ ID NO: 631 - RNA, 20 nt, Artificial Sequence
  MKO10000631_A_1810026J23Rik
  gRNA
aggccuugcuggacgcaucg

SEQ ID NO: 632 - RNA, 20 nt, Artificial Sequence
  MKO10000632_A_1810026J23Rik
  gRNA
cuuaagagauucugguccgg

SEQ ID NO: 633 - RNA, 20 nt, Artificial Sequence
  MKO10000633_A_1810030O07Rik
  gRNA
cuauaggccuucaugccccg

SEQ ID NO: 634 - RNA, 20 nt, Artificial Sequence
  MKO10000634_A_1810030O07Rik
  gRNA
gcaauucuauuucaauuucg

SEQ ID NO: 635 - RNA, 20 nt, Artificial Sequence
  MKO10000635_A_1810030O07Rik
  gRNA
ucugcgcauaccugacacug

SEQ ID NO: 636 - RNA, 20 nt, Artificial Sequence
  MKO10000636_A_1810033B17Rik
  gRNA
ugacuacgagaauauaaccu

SEQ ID NO: 637 - RNA, 20 nt, Artificial Sequence
  MKO10000637_A_1810033B17Rik
  gRNA
aagguuauauucucguaguc

SEQ ID NO: 638 - RNA, 20 nt, Artificial Sequence
  MKO10000638_A_1810033B17Rik
  gRNA
cgaccggcugaagacugugc

SEQ ID NO: 639 - RNA, 20 nt, Artificial Sequence
  MKO10000639_A_1810037I17Rik
  gRNA
aggauacucaccagggcaag

SEQ ID NO: 640 - RNA, 20 nt, Artificial Sequence
  MKO10000640_A_1810037I17Rik
  gRNA
cgucgguaccagacgccgcc

SEQ ID NO: 641 - RNA, 20 nt, Artificial Sequence
  MKO10000641_A_1810037I17Rik
  gRNA
ucuucguguaccucuugccc

SEQ ID NO: 642 - RNA, 20 nt, Artificial Sequence
  MKO10000642_A_1810041L15Rik
  gRNA
agaauacugcgagcacguuc

SEQ ID NO: 643 - RNA, 20 nt, Artificial Sequence
  MKO10000643_A_1810041L15Rik
  gRNA
cuuaccaggcggaugagcuc

SEQ ID NO: 644 - RNA, 20 nt, Artificial Sequence
  MKO10000644_A_1810041L15Rik
  gRNA
cagcaacuacacggcgcuuc

SEQ ID NO: 645 - RNA, 20 nt, Artificial Sequence
  MKO10000645_A_1810043G02Rik
  gRNA
agagcugacccgcgcgcuga

SEQ ID NO: 646 - RNA, 20 nt, Artificial Sequence
  MKO10000646_A_1810043G02Rik
  gRNA
gccuagagguaaucacacuc

SEQ ID NO: 647 - RNA, 20 nt, Artificial Sequence
  MKO10000647_A_1810043G02Rik
  gRNA
caucucccuccaucagcgcg

SEQ ID NO: 648 - RNA, 20 nt, Artificial Sequence
  MKO10000648_A_1810043H04Rik
  gRNA
cggcggcgaagcagcuccgc

SEQ ID NO: 649 - RNA, 20 nt, Artificial Sequence
  MKO10000649_A_1810043H04Rik
  gRNA
ccucgaacucgcgaacgcag

SEQ ID NO: 650 - RNA, 20 nt, Artificial Sequence
  MKO10000650_A_1810043H04Rik
  gRNA
ccgagccuuccccgagcauc

SEQ ID NO: 651 - RNA, 20 nt, Artificial Sequence
  MKO10000651_A_1810046K07Rik
  gRNA
uuccagugcaugcagcgagu

SEQ ID NO: 652 - RNA, 20 nt, Artificial Sequence
  MKO10000652_A_1810046K07Rik
  gRNA
acaggaucgccagugauguc

SEQ ID NO: 653 - RNA, 20 nt, Artificial Sequence
  MKO10000653_A_1810046K07Rik
  gRNA
ucgaaugaccucuacaccuc

SEQ ID NO: 654 - RNA, 20 nt, Artificial Sequence
  MKO10000654_A_1810055G02Rik
  gRNA
cucaggcugguagcacgcgc

SEQ ID NO: 655 - RNA, 20 nt, Artificial Sequence
  MKO10000655_A_1810055G02Rik
  gRNA
uagucccucaaacgccaccc

SEQ ID NO: 656 - RNA, 20 nt, Artificial Sequence
  MKO10000656_A_1810055G02Rik
  gRNA
guggcucugcagacaucaua

SEQ ID NO: 657 - RNA, 20 nt, Artificial Sequence
  MKO10000657_A_1810062G17Rik
  gRNA
cccgaccuccugcauacgca

SEQ ID NO: 658 - RNA, 20 nt, Artificial Sequence
  MKO10000658_A_1810062G17Rik
  gRNA
ccacaaaugacucaucgucc

SEQ ID NO: 659 - RNA, 20 nt, Artificial Sequence
  MKO10000659_A_1810062G17Rik
  gRNA
ccuggacgaugagucauuug

SEQ ID NO: 660 - RNA, 20 nt, Artificial Sequence
  MKO10000660_A_1810065E05Rik
  gRNA
acuggcauucucggcgacac

SEQ ID NO: 661 - RNA, 20 nt, Artificial Sequence
  MKO10000661_A_1810065E05Rik
  gRNA
uaucaguaguacagcaucgc

SEQ ID NO: 662 - RNA, 20 nt, Artificial Sequence
  MKO10000662_A_1810065E05Rik
  gRNA
aguccaaaacggucauauuc

SEQ ID NO: 663 - RNA, 20 nt, Artificial Sequence
  MKO10000663_A_42431
  gRNA
uccgcgacagguagccuacc

SEQ ID NO: 664 - RNA, 20 nt, Artificial Sequence
  MKO10000664_A_42431
  gRNA
ccuuagucgaucucaacacc

SEQ ID NO: 665 - RNA, 20 nt, Artificial Sequence
  MKO10000665_A_42431
  gRNA
accugaagacgcaagccuac

SEQ ID NO: 666 - RNA, 20 nt, Artificial Sequence
  MKO10000666_A_42615
  gRNA
cgacuguugagauugaagag

SEQ ID NO: 667 - RNA, 20 nt, Artificial Sequence
  MKO10000667_A_42615
  gRNA
ggcgucacaucauugauaac

SEQ ID NO: 668 - RNA, 20 nt, Artificial Sequence
  MKO10000668_A_42615
  gRNA
cgcuaccuacaugaugagag

SEQ ID NO: 669 - RNA, 20 nt, Artificial Sequence
  MKO10000669_A_2010001E11Rik
  gRNA
caauccuccaacgccaccac

SEQ ID NO: 670 - RNA, 20 nt, Artificial Sequence
  MKO10000670_A_2010001E11Rik
  gRNA
uaccgcgaacacggagccug

SEQ ID NO: 671 - RNA, 20 nt, Artificial Sequence
  MKO10000671_A_2010001E11Rik
  gRNA
uggugcuucaauugguguug

SEQ ID NO: 672 - RNA, 20 nt, Artificial Sequence
  MKO10000672_A_2010002M12Rik
  gRNA
cgugaucccaucuacagcau

SEQ ID NO: 673 - RNA, 20 nt, Artificial Sequence
  MKO10000673_A_2010002M12Rik
  gRNA
acuggcugaaggacgcaagg

SEQ ID NO: 674 - RNA, 20 nt, Artificial Sequence
  MKO10000674_A_2010002M12Rik
  gRNA
uucugagucccagcaacaug

SEQ ID NO: 675 - RNA, 20 nt, Artificial Sequence
  MKO10000675_A_2010003K11Rik
  gRNA
cuccagcccuuccgugccau

SEQ ID NO: 676 - RNA, 20 nt, Artificial Sequence
  MKO10000676_A_2010003K11Rik
  gRNA
ccgugagaaguccaggucgc

SEQ ID NO: 677 - RNA, 20 nt, Artificial Sequence
  MKO10000677_A_2010003K11Rik
  gRNA
uuaguuguugguguccaaca

SEQ ID NO: 678 - RNA, 20 nt, Artificial Sequence
  MKO10000678_A_2010005H15Rik
  gRNA
guaggacagcucaucuuucc

SEQ ID NO: 679 - RNA, 20 nt, Artificial Sequence
  MKO10000679_A_2010005H15Rik
  gRNA
cuccacauaaaagucuucac

SEQ ID NO: 680 - RNA, 20 nt, Artificial Sequence
  MKO10000680_A_2010005H15Rik
  gRNA
ucaccuuauuagcaaucucc

SEQ ID NO: 681 - RNA, 20 nt, Artificial Sequence
  MKO10000681_A_2010012O05Rik
  gRNA
agcucgaaacaugguacuac

SEQ ID NO: 682 - RNA, 20 nt, Artificial Sequence
  MKO10000682_A_2010012O05Rik
  gRNA
ggcauacucacugguacuga

SEQ ID NO: 683 - RNA, 20 nt, Artificial Sequence
  MKO10000683_A_2010012O05Rik
  gRNA
uacaucuuccgaguguaaga

SEQ ID NO: 684 - RNA, 20 nt, Artificial Sequence
  MKO10000684_A_2010015L04Rik
  gRNA
ucuuccgaagaugaaacgcc

SEQ ID NO: 685 - RNA, 20 nt, Artificial Sequence
  MKO10000685_A_2010015L04Rik
  gRNA
agcugcauaucugucgucag

SEQ ID NO: 686 - RNA, 20 nt, Artificial Sequence
  MKO10000686_A_2010015L04Rik
  gRNA
uaugucaaguucagcgaaaa

SEQ ID NO: 687 - RNA, 20 nt, Artificial Sequence
  MKO10000687_A_2010106E10Rik
  gRNA
auagcacuggccauaaucgu

SEQ ID NO: 688 - RNA, 20 nt, Artificial Sequence
  MKO10000688_A_2010106E10Rik
  gRNA
gauugccacaccaacgauua

SEQ ID NO: 689 - RNA, 20 nt, Artificial Sequence
  MKO10000689_A_2010106E10Rik
  gRNA
caugcacaaacaauagacuc

SEQ ID NO: 690 - RNA, 20 nt, Artificial Sequence
  MKO10000690_A_2010107E04Rik
  gRNA
gccucaucguauauaaaauc

SEQ ID NO: 691 - RNA, 20 nt, Artificial Sequence
  MKO10000691_A_2010107E04Rik
  gRNA
ggagcaguuagugauggcca

SEQ ID NO: 692 - RNA, 20 nt, Artificial Sequence
  MKO10000692_A_2010107E04Rik
  gRNA
aaagguccugcaccugccca

SEQ ID NO: 693 - RNA, 20 nt, Artificial Sequence
  MKO10000693_A_2010107G12Rik
  gRNA
cgcgccgaccauuucccucg

SEQ ID NO: 694 - RNA, 20 nt, Artificial Sequence
  MKO10000694_A_2010107G12Rik
  gRNA
ggccauguauccauaugccg

SEQ ID NO: 695 - RNA, 20 nt, Artificial Sequence
  MKO10000695_A_2010107G12Rik
  gRNA
auggcccguacagacaccaa

SEQ ID NO: 696 - RNA, 20 nt, Artificial Sequence
  MKO10000696_A_2010107G23Rik
  gRNA
gguagaccaggcccacaagc

SEQ ID NO: 697 - RNA, 20 nt, Artificial Sequence
  MKO10000697_A_2010107G23Rik
  gRNA
aggaugaugacccacgagug

SEQ ID NO: 698 - RNA, 20 nt, Artificial Sequence
  MKO10000698_A_2010107G23Rik
  gRNA
gaaccccgagcaucauaagc

SEQ ID NO: 699 - RNA, 20 nt, Artificial Sequence
  MKO10000699_A_2010109A12Rik
  gRNA
ccacgauaaguuaugcagaa

SEQ ID NO: 700 - RNA, 20 nt, Artificial Sequence
  MKO10000700_A_2010109A12Rik
  gRNA
ccuuucugcauaacuuaucg

SEQ ID NO: 701 - RNA, 20 nt, Artificial Sequence
  MKO10000701_A_2010109A12Rik
  gRNA
ggggccaucuccaagagacg

SEQ ID NO: 702 - RNA, 20 nt, Artificial Sequence
  MKO10000702_A_2010109I03Rik
  gRNA
auucaugacacuucaacgcc

SEQ ID NO: 703 - RNA, 20 nt, Artificial Sequence
  MKO10000703_A_2010109I03Rik
  gRNA
gccucuacugcuugaccaac

SEQ ID NO: 704 - RNA, 20 nt, Artificial Sequence
  MKO10000704_A_2010109I03Rik
  gRNA
ccagcaauccccaacugacg

SEQ ID NO: 705 - RNA, 20 nt, Artificial Sequence
  MKO10000705_A_2010111I01Rik
  gRNA
aaccucaaguccgcuuccga

SEQ ID NO: 706 - RNA, 20 nt, Artificial Sequence
  MKO10000706_A_2010111I01Rik
  gRNA
uagccauuggggcccgagac

SEQ ID NO: 707 - RNA, 20 nt, Artificial Sequence
  MKO10000707_A_2010111I01Rik
  gRNA
acuggggcaaacacucgaua

SEQ ID NO: 708 - RNA, 20 nt, Artificial Sequence
  MKO10000708_A_2010300C02Rik
  gRNA
gaugucccugcugcacgaug

SEQ ID NO: 709 - RNA, 20 nt, Artificial Sequence
  MKO10000709_A_2010300C02Rik
  gRNA
aacggcaaugaccucgcucu

SEQ ID NO: 710 - RNA, 20 nt, Artificial Sequence
  MKO10000710_A_2010300C02Rik
  gRNA
gagcgaggucauugccguug

SEQ ID NO: 711 - RNA, 20 nt, Artificial Sequence
  MKO10000711_A_2010315B03Rik
  gRNA
acagcauaucaaccuaacca

SEQ ID NO: 712 - RNA, 20 nt, Artificial Sequence
  MKO10000712_A_2010315B03Rik
  gRNA
caagucauugucgucuucaa

SEQ ID NO: 713 - RNA, 20 nt, Artificial Sequence
  MKO10000713_A_2010315B03Rik
  gRNA
acucaagccugcucagcuac

SEQ ID NO: 714 - RNA, 20 nt, Artificial Sequence
  MKO10000714_A_2200002D01Rik
  gRNA
caggcgcugcucacaagccg

SEQ ID NO: 715 - RNA, 20 nt, Artificial Sequence
  MKO10000715_A_2200002D01Rik
  gRNA
gcucuccaggaguaugccgc

SEQ ID NO: 716 - RNA, 20 nt, Artificial Sequence
  MKO10000716_A_2200002D01Rik
  gRNA
acacuguccucuuaaagcgc

SEQ ID NO: 717 - RNA, 20 nt, Artificial Sequence
  MKO10000717_A_2200002J24Rik
  gRNA
ccgguugcacugaugcgauc

SEQ ID NO: 718 - RNA, 20 nt, Artificial Sequence
  MKO10000718_A_2200002J24Rik
  gRNA
ccagaucgcaucagugcaac

SEQ ID NO: 719 - RNA, 20 nt, Artificial Sequence
  MKO10000719_A_2200002J24Rik
  gRNA
agcccagaggaacuccacgc

SEQ ID NO: 720 - RNA, 20 nt, Artificial Sequence
  MKO10000720_A_2210010C04Rik
  gRNA
cagccgaauucaggugcgcc

SEQ ID NO: 721 - RNA, 20 nt, Artificial Sequence
  MKO10000721_A_2210010C04Rik
  gRNA
aggcauuuaguuggcagcga

SEQ ID NO: 722 - RNA, 20 nt, Artificial Sequence
  MKO10000722_A_2210010C04Rik
  gRNA
gaggaaugcucuccccuacc

SEQ ID NO: 723 - RNA, 20 nt, Artificial Sequence
  MKO10000723_A_2210013O21Rik
  gRNA
ccgcggugggauuaucccga

SEQ ID NO: 724 - RNA, 20 nt, Artificial Sequence
  MKO10000724_A_2210013O21Rik
  gRNA
uuggguucccgcguauuucc

SEQ ID NO: 725 - RNA, 20 nt, Artificial Sequence
  MKO10000725_A_2210013O21Rik
  gRNA
gugcaaugacaagcuucugc

SEQ ID NO: 726 - RNA, 20 nt, Artificial Sequence
  MKO10000726_A_2210016F16Rik
  gRNA
acgaaccucgccgacucgcg

SEQ ID NO: 727 - RNA, 20 nt, Artificial Sequence
  MKO10000727_A_2210016F16Rik
  gRNA
gaacagucgcgacgugcucg

SEQ ID NO: 728 - RNA, 20 nt, Artificial Sequence
  MKO10000728_A_2210016F16Rik
  gRNA
auauaucccgcaccugcucg

SEQ ID NO: 729 - RNA, 20 nt, Artificial Sequence
  MKO10000729_A_2210016L21Rik
  gRNA
ggaacucaggagugguccga

SEQ ID NO: 730 - RNA, 20 nt, Artificial Sequence
  MKO10000730_A_2210016L21Rik
  gRNA
gcaugaggugaaccagcacg

SEQ ID NO: 731 - RNA, 20 nt, Artificial Sequence
  MKO10000731_A_2210016L21Rik
  gRNA
uggcgcuuccggcagggucu

SEQ ID NO: 732 - RNA, 20 nt, Artificial Sequence
  MKO10000732_A_2210018M11Rik
  gRNA
uaccaaucuacguccuucga

SEQ ID NO: 733 - RNA, 20 nt, Artificial Sequence
  MKO10000733_A_2210018M11Rik
  gRNA
agcgccaccgugcugaaguu

SEQ ID NO: 734 - RNA, 20 nt, Artificial Sequence
  MKO10000734_A_2210018M11Rik
  gRNA
aucagugcacuucgggcaca

SEQ ID NO: 735 - RNA, 20 nt, Artificial Sequence
  MKO10000735_A_2210404O07Rik
  gRNA
uuuggcgcaccagacacgau

SEQ ID NO: 736 - RNA, 20 nt, Artificial Sequence
  MKO10000736_A_2210404O07Rik
  gRNA
aaucgugucuggugcgccaa

SEQ ID NO: 737 - RNA, 20 nt, Artificial Sequence
  MKO10000737_A_2210404O07Rik
  gRNA
acuguuccugacacccgcug

SEQ ID NO: 738 - RNA, 20 nt, Artificial Sequence
  MKO10000738_A_2210404O09Rik
  gRNA
uugcauguguccuaaauuug

SEQ ID NO: 739 - RNA, 20 nt, Artificial Sequence
  MKO10000739_A_2210404O09Rik
  gRNA
uuuagaagguguacuuucag

SEQ ID NO: 740 - RNA, 20 nt, Artificial Sequence
  MKO10000740_A_2210404O09Rik
  gRNA
acagacucagauaacauuca

SEQ ID NO: 741 - RNA, 20 nt, Artificial Sequence
  MKO10000741_A_2210407C18Rik
  gRNA
accucgugcauuucgaccaa

SEQ ID NO: 742 - RNA, 20 nt, Artificial Sequence
  MKO10000742_A_2210407C18Rik
  gRNA
aguugucguggagcacguau

SEQ ID NO: 743 - RNA, 20 nt, Artificial Sequence
  MKO10000743_A_2210407C18Rik
  gRNA
aauaacugggagugaugcag

SEQ ID NO: 744 - RNA, 20 nt, Artificial Sequence
  MKO10000744_A_2210408I21Rik
  gRNA
uucgacgauucuuaguaaac

SEQ ID NO: 745 - RNA, 20 nt, Artificial Sequence
  MKO10000745_A_2210408I21Rik
  gRNA
uuucuucuguaaccguaucc

SEQ ID NO: 746 - RNA, 20 nt, Artificial Sequence
  MKO10000746_A_2210408I21Rik
  gRNA
guuguuuguagcugugcauc

SEQ ID NO: 747 - RNA, 20 nt, Artificial Sequence
  MKO10000747_A_2300002M23Rik
  gRNA
auacuggcaauuggcccccc

SEQ ID NO: 748 - RNA, 20 nt, Artificial Sequence
  MKO10000748_A_2300002M23Rik
  gRNA
cccaauugucgauauccagc

SEQ ID NO: 749 - RNA, 20 nt, Artificial Sequence
  MKO10000749_A_2300002M23Rik
  gRNA
agcaagaugcagagccacgc

SEQ ID NO: 750 - RNA, 20 nt, Artificial Sequence
  MKO10000750_A_2300003K06Rik
  gRNA
gcugaccaugguaucugagu

SEQ ID NO: 751 - RNA, 20 nt, Artificial Sequence
  MKO10000751_A_2300003K06Rik
  gRNA
gugcuguaaacccaccugcu

SEQ ID NO: 752 - RNA, 20 nt, Artificial Sequence
  MKO10000752_A_2300003K06Rik
  gRNA
acaggaaggccuguaacagc

SEQ ID NO: 753 - RNA, 20 nt, Artificial Sequence
  MKO10000753_A_2300005B03Rik
  gRNA
cucgcccgucuagcugccca

SEQ ID NO: 754 - RNA, 20 nt, Artificial Sequence
  MKO10000754_A_2300005B03Rik
  gRNA
uagcacaucuucgucaccag

SEQ ID NO: 755 - RNA, 20 nt, Artificial Sequence
  MKO10000755_A_2300005B03Rik
  gRNA
gccaguccaaucucugcaac

SEQ ID NO: 756 - RNA, 20 nt, Artificial Sequence
  MKO10000756_A_2300009A05Rik
  gRNA
gggcccacgaggcuacgcug

SEQ ID NO: 757 - RNA, 20 nt, Artificial Sequence
  MKO10000757_A_2300009A05Rik
  gRNA
ucguuguggaccgcacugua

SEQ ID NO: 758 - RNA, 20 nt, Artificial Sequence
  MKO10000758_A_2300009A05Rik
  gRNA
gagacuguucauaccaguua

SEQ ID NO: 759 - RNA, 20 nt, Artificial Sequence
  MKO10000759_A_2310002J15Rik
  gRNA
augucaucaccacgcccuac

SEQ ID NO: 760 - RNA, 20 nt, Artificial Sequence
  MKO10000760_A_2310002J15Rik
  gRNA
ccagcauaagucagucccga

SEQ ID NO: 761 - RNA, 20 nt, Artificial Sequence
  MKO10000761_A_2310002J15Rik
  gRNA
ccaucgggacugacuuaugc

SEQ ID NO: 762 - RNA, 20 nt, Artificial Sequence
  MKO10000762_A_2310002L09Rik
  gRNA
uguuauacgcuaguucagag

SEQ ID NO: 763 - RNA, 20 nt, Artificial Sequence
  MKO10000763_A_2310002L09Rik
  gRNA
aagcacguaccagcauuucg

SEQ ID NO: 764 - RNA, 20 nt, Artificial Sequence
  MKO10000764_A_2310002L09Rik
  gRNA
ccauccugaccggccguauc

SEQ ID NO: 765 - RNA, 20 nt, Artificial Sequence
  MKO10000765_A_2310003H01Rik
  gRNA
gguguaccaguuucccgacc

SEQ ID NO: 766 - RNA, 20 nt, Artificial Sequence
  MKO10000766_A_2310003H01Rik
  gRNA
ggggcaacgucacuucccgc

SEQ ID NO: 767 - RNA, 20 nt, Artificial Sequence
  MKO10000767_A_2310003H01Rik
  gRNA
cacacgcauccggguccaca

SEQ ID NO: 768 - RNA, 20 nt, Artificial Sequence
  MKO10000768_A_2310005G13Rik
  gRNA
uguguugccaguuccgcagu

SEQ ID NO: 769 - RNA, 20 nt, Artificial Sequence
  MKO10000769_A_2310005G13Rik
  gRNA
gcugaaguucagugcguuau

SEQ ID NO: 770 - RNA, 20 nt, Artificial Sequence
  MKO10000770_A_2310005G13Rik
  gRNA
gcaacacaucaucauguacg

SEQ ID NO: 771 - RNA, 20 nt, Artificial Sequence
  MKO10000771_A_2310007B03Rik
  gRNA
uuacgcggucgagaauggag

SEQ ID NO: 772 - RNA, 20 nt, Artificial Sequence
  MKO10000772_A_2310007B03Rik
  gRNA
cguccaccacgcaucgacaa

SEQ ID NO: 773 - RNA, 20 nt, Artificial Sequence
  MKO10000773_A_2310007B03Rik
  gRNA
auggauucguaaggacucuu

SEQ ID NO: 774 - RNA, 20 nt, Artificial Sequence
  MKO10000774_A_2310007L24Rik
  gRNA
gguccacaccgacagucacg

SEQ ID NO: 775 - RNA, 20 nt, Artificial Sequence
  MKO10000775_A_2310007L24Rik
  gRNA
accaacaguccccguugcac

SEQ ID NO: 776 - RNA, 20 nt, Artificial Sequence
  MKO10000776_A_2310007L24Rik
  gRNA
caucugcuccucgugacugu

SEQ ID NO: 777 - RNA, 20 nt, Artificial Sequence
  MKO10000777_A_2310009B15Rik
  gRNA
acgcuggcgaggguaucgcu

SEQ ID NO: 778 - RNA, 20 nt, Artificial Sequence
  MKO10000778_A_2310009B15Rik
  gRNA
ccggcuaugugguucucaca

SEQ ID NO: 779 - RNA, 20 nt, Artificial Sequence
  MKO10000779_A_2310009B15Rik
  gRNA
cgccggcgccauggccgccc

SEQ ID NO: 780 - RNA, 20 nt, Artificial Sequence
  MKO10000780_A_2310011J03Rik
  gRNA
uaccacgcguuucuucgccu

SEQ ID NO: 781 - RNA, 20 nt, Artificial Sequence
  MKO10000781_A_2310011J03Rik
  gRNA
gccgcugaccagcuugccga

SEQ ID NO: 782 - RNA, 20 nt, Artificial Sequence
  MKO10000782_A_2310011J03Rik
  gRNA
gugccccucgcacguccucc

SEQ ID NO: 783 - RNA, 20 nt, Artificial Sequence
  MKO10000783_A_2310014L17Rik
  gRNA
cugugcgcuuugaccgacgc

SEQ ID NO: 784 - RNA, 20 nt, Artificial Sequence
  MKO10000784_A_2310014L17Rik
  gRNA
aucugcgugucacccuucga

SEQ ID NO: 785 - RNA, 20 nt, Artificial Sequence
  MKO10000785_A_2310014L17Rik
  gRNA
cuuuguggggcgucgugucc

SEQ ID NO: 786 - RNA, 20 nt, Artificial Sequence
  MKO10000786_A_2310022A10Rik
  gRNA
acucaccacuagaagcgccu

SEQ ID NO: 787 - RNA, 20 nt, Artificial Sequence
  MKO10000787_A_2310022A10Rik
  gRNA
cuucgccgaggcgcuucuag

SEQ ID NO: 788 - RNA, 20 nt, Artificial Sequence
  MKO10000788_A_2310022A10Rik
  gRNA
uaccuggcgguguaccaccu

SEQ ID NO: 789 - RNA, 20 nt, Artificial Sequence
  MKO10000789_A_2310022B05Rik
  gRNA
cgggccggguauggcgucga

SEQ ID NO: 790 - RNA, 20 nt, Artificial Sequence
  MKO10000790_A_2310022B05Rik
  gRNA
ggcgaucgcggccucgcguu

SEQ ID NO: 791 - RNA, 20 nt, Artificial Sequence
  MKO10000791_A_2310022B05Rik
  gRNA
agaucaaugccgagcgcucu

SEQ ID NO: 792 - RNA, 20 nt, Artificial Sequence
  MKO10000792_A_2310030G06Rik
  gRNA
caagucacucuccuccgacg

SEQ ID NO: 793 - RNA, 20 nt, Artificial Sequence
  MKO10000793_A_2310030G06Rik
  gRNA
guacaacacuugcucauacg

SEQ ID NO: 794 - RNA, 20 nt, Artificial Sequence
  MKO10000794_A_2310030G06Rik
  gRNA
ccauggcgguugugucuccc

SEQ ID NO: 795 - RNA, 20 nt, Artificial Sequence
  MKO10000795_A_2310033P09Rik
  gRNA
cuucucgggauagcgccaca

SEQ ID NO: 796 - RNA, 20 nt, Artificial Sequence
  MKO10000796_A_2310033P09Rik
  gRNA
ucgaccuuguccucagcgcg

SEQ ID NO: 797 - RNA, 20 nt, Artificial Sequence
  MKO10000797_A_2310033P09Rik
  gRNA
acuucguggagaucugcaaa

SEQ ID NO: 798 - RNA, 20 nt, Artificial Sequence
  MKO10000798_A_2310034C09Rik
  gRNA
ggcuucagaccccucaauug

SEQ ID NO: 799 - RNA, 20 nt, Artificial Sequence
  MKO10000799_A_2310034C09Rik
  gRNA
aaccuuguuauagaccaacc

SEQ ID NO: 800 - RNA, 20 nt, Artificial Sequence
  MKO10000800_A_2310034C09Rik
  gRNA
gcuaucuguagugauuaauc

SEQ ID NO: 801 - RNA, 20 nt, Artificial Sequence
  MKO10000801_A_2310035C23Rik
  gRNA
cgauggcaucgauugacaau

SEQ ID NO: 802 - RNA, 20 nt, Artificial Sequence
  MKO10000802_A_2310035C23Rik
  gRNA
gagaaguaaucgcgcagucg

SEQ ID NO: 803 - RNA, 20 nt, Artificial Sequence
  MKO10000803_A_2310035C23Rik
  gRNA
uaaaucaaguccugaaauuc

SEQ ID NO: 804 - RNA, 20 nt, Artificial Sequence
  MKO10000804_A_2310036O22Rik
  gRNA
cgaggugucgggcucgaguc

SEQ ID NO: 805 - RNA, 20 nt, Artificial Sequence
  MKO10000805_A_2310036O22Rik
  gRNA
auucccugggcccgccgcgg

SEQ ID NO: 806 - RNA, 20 nt, Artificial Sequence
  MKO10000806_A_2310036O22Rik
  gRNA
ugaugauaaaacucggcccc

SEQ ID NO: 807 - RNA, 20 nt, Artificial Sequence
  MKO10000807_A_2310039H08Rik
  gRNA
cgaccaucgaggagcgaucc

SEQ ID NO: 808 - RNA, 20 nt, Artificial Sequence
  MKO10000808_A_2310039H08Rik
  gRNA
aguccagccgcccaacucga

SEQ ID NO: 809 - RNA, 20 nt, Artificial Sequence
  MKO10000809_A_2310039H08Rik
  gRNA
ccuccgucgaguugggcggc

SEQ ID NO: 810 - RNA, 20 nt, Artificial Sequence
  MKO10000810_A_2310042D19Rik
  gRNA
gcacgccucuucuuacgacc

SEQ ID NO: 811 - RNA, 20 nt, Artificial Sequence
  MKO10000811_A_2310042D19Rik
  gRNA
cuucaccaguugcgaccuag

SEQ ID NO: 812 - RNA, 20 nt, Artificial Sequence
  MKO10000812_A_2310042D19Rik
  gRNA
uauccgcuacuuccgccguc

SEQ ID NO: 813 - RNA, 20 nt, Artificial Sequence
  MKO10000813_A_2310042E22Rik
  gRNA
aauuuaccaaaagccaugac

SEQ ID NO: 814 - RNA, 20 nt, Artificial Sequence
  MKO10000814_A_2310042E22Rik
  gRNA
augugcaugcacacucgaga

SEQ ID NO: 815 - RNA, 20 nt, Artificial Sequence
  MKO10000815_A_2310042E22Rik
  gRNA
agaaaaugguuaugaaugcc

SEQ ID NO: 816 - RNA, 20 nt, Artificial Sequence
  MKO10000816_A_2310044G17Rik
  gRNA
ggauaauacucggccagucu

SEQ ID NO: 817 - RNA, 20 nt, Artificial Sequence
  MKO10000817_A_2310044G17Rik
  gRNA
gaggcuuaccgcgugucaga

SEQ ID NO: 818 - RNA, 20 nt, Artificial Sequence
  MKO10000818_A_2310044G17Rik
  gRNA
aagaagcuagcgcgaccacu

SEQ ID NO: 819 - RNA, 20 nt, Artificial Sequence
  MKO10000819_A_2310045N01Rik
  gRNA
ccagggcgccauauacaccg

SEQ ID NO: 820 - RNA, 20 nt, Artificial Sequence
  MKO10000820_A_2310045N01Rik
  gRNA
cagcguguacuuccguagug

SEQ ID NO: 821 - RNA, 20 nt, Artificial Sequence
  MKO10000821_A_2310045N01Rik
  gRNA
ccuugccaacgagccgucag

SEQ ID NO: 822 - RNA, 20 nt, Artificial Sequence
  MKO10000822_A_2310047M10Rik
  gRNA
uauccagaccuaccgcgacg

SEQ ID NO: 823 - RNA, 20 nt, Artificial Sequence
  MKO10000823_A_2310047M10Rik
  gRNA
ccgagauauccgacgcacgc

SEQ ID NO: 824 - RNA, 20 nt, Artificial Sequence
  MKO10000824_A_2310047M10Rik
  gRNA
caccuuacuugcgcgcugcg

SEQ ID NO: 825 - RNA, 20 nt, Artificial Sequence
  MKO10000825_A_2310050C09Rik
  gRNA
gggaguugggcauuucacgu

SEQ ID NO: 826 - RNA, 20 nt, Artificial Sequence
  MKO10000826_A_2310050C09Rik
  gRNA
ggcacuucacauaaguaguc

SEQ ID NO: 827 - RNA, 20 nt, Artificial Sequence
  MKO10000827_A_2310050C09Rik
  gRNA
uaucucacguaaguuugagc

SEQ ID NO: 828 - RNA, 20 nt, Artificial Sequence
  MKO10000828_A_2310057J18Rik
  gRNA
uccucuucagaacgaagucc

SEQ ID NO: 829 - RNA, 20 nt, Artificial Sequence
  MKO10000829_A_2310057J18Rik
  gRNA
gacugucaaucugccguccc

SEQ ID NO: 830 - RNA, 20 nt, Artificial Sequence
  MKO10000830_A_2310057J18Rik
  gRNA
gggcuaugucaguaucaaca

SEQ ID NO: 831 - RNA, 20 nt, Artificial Sequence
  MKO10000831_A_2310057M21Rik
  gRNA
uccgcgugggacauaaugcc

SEQ ID NO: 832 - RNA, 20 nt, Artificial Sequence
  MKO10000832_A_2310057M21Rik
  gRNA
cauuaugucccacgcggaga

SEQ ID NO: 833 - RNA, 20 nt, Artificial Sequence
  MKO10000833_A_2310057M21Rik
  gRNA
augggguccagguuaucgcc

SEQ ID NO: 834 - RNA, 20 nt, Artificial Sequence
  MKO10000834_A_2310057N15Rik
  gRNA
cagacugaucuauaacaaga

SEQ ID NO: 835 - RNA, 20 nt, Artificial Sequence
  MKO10000835_A_2310057N15Rik
  gRNA
auucuacuacccaguguaug

SEQ ID NO: 836 - RNA, 20 nt, Artificial Sequence
  MKO10000836_A_2310057N15Rik
  gRNA
ccacuggauccacaucccac

SEQ ID NO: 837 - RNA, 20 nt, Artificial Sequence
  MKO10000837_A_2310061I04Rik
  gRNA
uaucacgccuguagaaacgc

SEQ ID NO: 838 - RNA, 20 nt, Artificial Sequence
  MKO10000838_A_2310061I04Rik
  gRNA
caagcccgcuggcgucuaau

SEQ ID NO: 839 - RNA, 20 nt, Artificial Sequence
  MKO10000839_A_2310061I04Rik
  gRNA
ggcaaggcggucccucaaaa

SEQ ID NO: 840 - RNA, 20 nt, Artificial Sequence
  MKO10000840_A_2310061N02Rik
  gRNA
uuggacgguagcagggacgc

SEQ ID NO: 841 - RNA, 20 nt, Artificial Sequence
  MKO10000841_A_2310061N02Rik
  gRNA
cucucccagaaaccgccauc

SEQ ID NO: 842 - RNA, 20 nt, Artificial Sequence
  MKO10000842_A_2310061N02Rik
  gRNA
ccugugaguuaccgagucug

SEQ ID NO: 843 - RNA, 20 nt, Artificial Sequence
  MKO10000843_A_2310067B10Rik
  gRNA
cuugccgcccgaugaggacg

SEQ ID NO: 844 - RNA, 20 nt, Artificial Sequence
  MKO10000844_A_2310067B10Rik
  gRNA
ugagggccuuccggguagac

SEQ ID NO: 845 - RNA, 20 nt, Artificial Sequence
  MKO10000845_A_2310067B10Rik
  gRNA
ggauuuggucgaugaucccc

SEQ ID NO: 846 - RNA, 20 nt, Artificial Sequence
  MKO10000846_A_2310079G19Rik
  gRNA
acgccccgccauuccagcuu

SEQ ID NO: 847 - RNA, 20 nt, Artificial Sequence
  MKO10000847_A_2310079G19Rik
  gRNA
uccacagcucuucgucuugu

SEQ ID NO: 848 - RNA, 20 nt, Artificial Sequence
  MKO10000848_A_2310079G19Rik
  gRNA
gucugcucuccgauuacuuc

SEQ ID NO: 849 - RNA, 20 nt, Artificial Sequence
  MKO10000849_A_2410002F23Rik
  gRNA
aggacuuagucaugacgcac

SEQ ID NO: 850 - RNA, 20 nt, Artificial Sequence
  MKO10000850_A_2410002F23Rik
  gRNA
gacccacgucagcaauaguc

SEQ ID NO: 851 - RNA, 20 nt, Artificial Sequence
  MKO10000851_A_2410002F23Rik
  gRNA
gauccagacuauugcugacg

SEQ ID NO: 852 - RNA, 20 nt, Artificial Sequence
  MKO10000852_A_2410004B18Rik
  gRNA
ggcggccucggcuccgacga

SEQ ID NO: 853 - RNA, 20 nt, Artificial Sequence
  MKO10000853_A_2410004B18Rik
  gRNA
uccuugcgacccgcgucuuc

SEQ ID NO: 854 - RNA, 20 nt, Artificial Sequence
  MKO10000854_A_2410004B18Rik
  gRNA
cucugggggcggcacgcagu

SEQ ID NO: 855 - RNA, 20 nt, Artificial Sequence
  MKO10000855_A_2410004P03Rik
  gRNA
uucuugguagcccacgaugu

SEQ ID NO: 856 - RNA, 20 nt, Artificial Sequence
  MKO10000856_A_2410004P03Rik
  gRNA
cccaugggcagccaacaucg

SEQ ID NO: 857 - RNA, 20 nt, Artificial Sequence
  MKO10000857_A_2410004P03Rik
  gRNA
ccugaaagacuaugacccuc

SEQ ID NO: 858 - RNA, 20 nt, Artificial Sequence
  MKO10000858_A_2410012M07Rik
  gRNA
cgaauccaggcuguccaaaa

SEQ ID NO: 859 - RNA, 20 nt, Artificial Sequence
  MKO10000859_A_2410012M07Rik
  gRNA
gcagcaggucgacgccgucc

SEQ ID NO: 860 - RNA, 20 nt, Artificial Sequence
  MKO10000860_A_2410012M07Rik
  gRNA
ucgcagggcccggaagcgac

SEQ ID NO: 861 - RNA, 20 nt, Artificial Sequence
  MKO10000861_A_2410015M20Rik
  gRNA
caaccuccucggccuuccgc

SEQ ID NO: 862 - RNA, 20 nt, Artificial Sequence
  MKO10000862_A_2410015M20Rik
  gRNA
cuuggagggggccaccgaca

SEQ ID NO: 863 - RNA, 20 nt, Artificial Sequence
  MKO10000863_A_2410015M20Rik
  gRNA
cgaccacacucgagccacca

SEQ ID NO: 864 - RNA, 20 nt, Artificial Sequence
  MKO10000864_A_2410016O06Rik
  gRNA
gacgccgcgcgcuacgucga

SEQ ID NO: 865 - RNA, 20 nt, Artificial Sequence
  MKO10000865_A_2410016O06Rik
  gRNA
ucuggcgcgucuaccgaccg

SEQ ID NO: 866 - RNA, 20 nt, Artificial Sequence
  MKO10000866_A_2410016O06Rik
  gRNA
ccguccaucgacguagcgcg

SEQ ID NO: 867 - RNA, 20 nt, Artificial Sequence
  MKO10000867_A_2410018M08Rik
  gRNA
agcucucgccgcgucgcugu

SEQ ID NO: 868 - RNA, 20 nt, Artificial Sequence
  MKO10000868_A_2410018M08Rik
  gRNA
cgucugucgauucaucgagc

SEQ ID NO: 869 - RNA, 20 nt, Artificial Sequence
  MKO10000869_A_2410018M08Rik
  gRNA
cacuucccgcgugacccuuc

SEQ ID NO: 870 - RNA, 20 nt, Artificial Sequence
  MKO10000870_A_2410076I21Rik
  gRNA
gaccugauacaacgaucgug

SEQ ID NO: 871 - RNA, 20 nt, Artificial Sequence
  MKO10000871_A_2410076I21Rik
  gRNA
guccucacgaucguuguauc

SEQ ID NO: 872 - RNA, 20 nt, Artificial Sequence
  MKO10000872_A_2410076I21Rik
  gRNA
cucagugacacaucgagcuc

SEQ ID NO: 873 - RNA, 20 nt, Artificial Sequence
  MKO10000873_A_2410089E03Rik
  gRNA
aaccauuaguggaugucgcc

SEQ ID NO: 874 - RNA, 20 nt, Artificial Sequence
  MKO10000874_A_2410089E03Rik
  gRNA
uuccuggcgacauccacuaa

SEQ ID NO: 875 - RNA, 20 nt, Artificial Sequence
  MKO10000875_A_2410089E03Rik
  gRNA
aggcaacgaaacugcuucuu

SEQ ID NO: 876 - RNA, 20 nt, Artificial Sequence
  MKO10000876_A_2410124H12Rik
  gRNA
gauacaaccgucgucgaccc

SEQ ID NO: 877 - RNA, 20 nt, Artificial Sequence
  MKO10000877_A_2410124H12Rik
  gRNA
cgacgguuguaucgcauuua

SEQ ID NO: 878 - RNA, 20 nt, Artificial Sequence
  MKO10000878_A_2410124H12Rik
  gRNA
augcuauggaugcgcucaug

SEQ ID NO: 879 - RNA, 20 nt, Artificial Sequence
  MKO10000879_A_2410127L17Rik
  gRNA
cuuccaacuuuguacucaac

SEQ ID NO: 880 - RNA, 20 nt, Artificial Sequence
  MKO10000880_A_2410127L17Rik
  gRNA
auaccuguugaguacaaagu

SEQ ID NO: 881 - RNA, 20 nt, Artificial Sequence
  MKO10000881_A_2410127L17Rik
  gRNA
aauauuuaccaucucuccuu

SEQ ID NO: 882 - RNA, 20 nt, Artificial Sequence
  MKO10000882_A_2410131K14Rik
  gRNA
cgcaacagccauucgccagc

SEQ ID NO: 883 - RNA, 20 nt, Artificial Sequence
  MKO10000883_A_2410131K14Rik
  gRNA
gcuguucccggucuugaacc

SEQ ID NO: 884 - RNA, 20 nt, Artificial Sequence
  MKO10000884_A_2410131K14Rik
  gRNA
ccucacgccgggaagaguuc

SEQ ID NO: 885 - RNA, 20 nt, Artificial Sequence
  MKO10000885_A_2410137M14Rik
  gRNA
caccuucaagcguugaauga

SEQ ID NO: 886 - RNA, 20 nt, Artificial Sequence
  MKO10000886_A_2410137M14Rik
  gRNA
accagcagugauccccguga

SEQ ID NO: 887 - RNA, 20 nt, Artificial Sequence
  MKO10000887_A_2410137M14Rik
  gRNA
ucugucugcaaccauacccc

SEQ ID NO: 888 - RNA, 20 nt, Artificial Sequence
  MKO10000888_A_2410141K09Rik
  gRNA
cagaguucucaucuugaagu

SEQ ID NO: 889 - RNA, 20 nt, Artificial Sequence
  MKO10000889_A_2410141K09Rik
  gRNA
uuacacccgcaggccacaug

SEQ ID NO: 890 - RNA, 20 nt, Artificial Sequence
  MKO10000890_A_2410141K09Rik
  gRNA
agaacucugaucccgagccg

SEQ ID NO: 891 - RNA, 20 nt, Artificial Sequence
  MKO10000891_A_2510002D24Rik
  gRNA
ucggcgcgguagaccucgca

SEQ ID NO: 892 - RNA, 20 nt, Artificial Sequence
  MKO10000892_A_2510002D24Rik
  gRNA
cuacaccacuacuacgucca

SEQ ID NO: 893 - RNA, 20 nt, Artificial Sequence
  MKO10000893_A_2510002D24Rik
  gRNA
agagggagguuccaguccgu

SEQ ID NO: 894 - RNA, 20 nt, Artificial Sequence
  MKO10000894_A_2510003E04Rik
  gRNA
gggaagagaucgaaaccgcc

SEQ ID NO: 895 - RNA, 20 nt, Artificial Sequence
  MKO10000895_A_2510003E04Rik
  gRNA
aaaugcucagucgggucaag

SEQ ID NO: 896 - RNA, 20 nt, Artificial Sequence
  MKO10000896_A_2510003E04Rik
  gRNA
cguugauggcccacuccaug

SEQ ID NO: 897 - RNA, 20 nt, Artificial Sequence
  MKO10000897_A_2510009E07Rik
  gRNA
acuuccagauccgacugcga

SEQ ID NO: 898 - RNA, 20 nt, Artificial Sequence
  MKO10000898_A_2510009E07Rik
  gRNA
acucggggaucaacgccauu

SEQ ID NO: 899 - RNA, 20 nt, Artificial Sequence
  MKO10000899_A_2510009E07Rik
  gRNA
cagauggacagcccgucgca

SEQ ID NO: 900 - RNA, 20 nt, Artificial Sequence
  MKO10000900_A_2510039O18Rik
  gRNA
acgaaguccggcgucacggc

SEQ ID NO: 901 - RNA, 20 nt, Artificial Sequence
  MKO10000901_A_2510039O18Rik
  gRNA
guguggaccggcccgaguag

SEQ ID NO: 902 - RNA, 20 nt, Artificial Sequence
  MKO10000902_A_2510039O18Rik
  gRNA
cgucaagaucuacgccugug

SEQ ID NO: 903 - RNA, 20 nt, Artificial Sequence
  MKO10000903_A_2510049J12Rik
  gRNA
cuaaggaacgucccucgcgu

SEQ ID NO: 904 - RNA, 20 nt, Artificial Sequence
  MKO10000904_A_2510049J12Rik
  gRNA
uuccuccucaaaccgacgcg

SEQ ID NO: 905 - RNA, 20 nt, Artificial Sequence
  MKO10000905_A_2510049J12Rik
  gRNA
uuaguacagccuagcauguu

SEQ ID NO: 906 - RNA, 20 nt, Artificial Sequence
  MKO10000906_A_2610002J02Rik
  gRNA
ggcccccuaacugccgcccu

SEQ ID NO: 907 - RNA, 20 nt, Artificial Sequence
  MKO10000907_A_2610002J02Rik
  gRNA
guucgaccagaauuuagugc

SEQ ID NO: 908 - RNA, 20 nt, Artificial Sequence
  MKO10000908_A_2610002J02Rik
  gRNA
ccaauccgcggucccgcuca

SEQ ID NO: 909 - RNA, 20 nt, Artificial Sequence
  MKO10000909_A_2610002M06Rik
  gRNA
agauuuaacuacaccugcca

SEQ ID NO: 910 - RNA, 20 nt, Artificial Sequence
  MKO10000910_A_2610002M06Rik
  gRNA
cucuuaccuguggugucgua

SEQ ID NO: 911 - RNA, 20 nt, Artificial Sequence
  MKO10000911_A_2610002M06Rik
  gRNA
uacuacccuuacgacaccac

SEQ ID NO: 912 - RNA, 20 nt, Artificial Sequence
  MKO10000912_A_2610008E11Rik
  gRNA
ccaggagucggugucauucg

SEQ ID NO: 913 - RNA, 20 nt, Artificial Sequence
  MKO10000913_A_2610008E11Rik
  gRNA
aacgugaauuugggccaugg

SEQ ID NO: 914 - RNA, 20 nt, Artificial Sequence
  MKO10000914_A_2610008E11Rik
  gRNA
auggcucagaagccucgcuu

SEQ ID NO: 915 - RNA, 20 nt, Artificial Sequence
  MKO10000915_A_2610015P09Rik
  gRNA
uuggcggcaagcaguagauc

SEQ ID NO: 916 - RNA, 20 nt, Artificial Sequence
  MKO10000916_A_2610015P09Rik
  gRNA
gaaggauccucgucuuacca

SEQ ID NO: 917 - RNA, 20 nt, Artificial Sequence
  MKO10000917_A_2610015P09Rik
  gRNA
cuuaagacgcgagaaacaac

SEQ ID NO: 918 - RNA, 20 nt, Artificial Sequence
  MKO10000918_A_2610018G03Rik
  gRNA
ccaaaacggagucccuacga

SEQ ID NO: 919 - RNA, 20 nt, Artificial Sequence
  MKO10000919_A_2610018G03Rik
  gRNA
ugauaaccguacucagcaag

SEQ ID NO: 920 - RNA, 20 nt, Artificial Sequence
  MKO10000920_A_2610018G03Rik
  gRNA
uucacaaaauuagagcgcau

SEQ ID NO: 921 - RNA, 20 nt, Artificial Sequence
  MKO10000921_A_2610020H08Rik
  gRNA
acagauagcaguccccucuu

SEQ ID NO: 922 - RNA, 20 nt, Artificial Sequence
  MKO10000922_A_2610020H08Rik
  gRNA
uguuaugaaaccaguauacu

SEQ ID NO: 923 - RNA, 20 nt, Artificial Sequence
  MKO10000923_A_2610020H08Rik
  gRNA
agaacuaacacgcaucucac

SEQ ID NO: 924 - RNA, 20 nt, Artificial Sequence
  MKO10000924_A_2610028H24Rik
  gRNA
uccgaggucaggaaguauua

SEQ ID NO: 925 - RNA, 20 nt, Artificial Sequence
  MKO10000925_A_2610028H24Rik
  gRNA
accgggugcuggaugauccu

SEQ ID NO: 926 - RNA, 20 nt, Artificial Sequence
  MKO10000926_A_2610028H24Rik
  gRNA
ggcaccucuggguucagggu

SEQ ID NO: 927 - RNA, 20 nt, Artificial Sequence
  MKO10000927_A_2610034B18Rik
  gRNA
gagccggucugugucgcccu

SEQ ID NO: 928 - RNA, 20 nt, Artificial Sequence
  MKO10000928_A_2610034B18Rik
  gRNA
cuggagugcgauuaaaaacu

SEQ ID NO: 929 - RNA, 20 nt, Artificial Sequence
  MKO10000929_A_2610034B18Rik
  gRNA
gggagcucguggauguaucu

SEQ ID NO: 930 - RNA, 20 nt, Artificial Sequence
  MKO10000930_A_2610034M16Rik
  gRNA
gaccgugaaaaaucguuacc

SEQ ID NO: 931 - RNA, 20 nt, Artificial Sequence
  MKO10000931_A_2610034M16Rik
  gRNA
cggacugugagacuauucaa

SEQ ID NO: 932 - RNA, 20 nt, Artificial Sequence
  MKO10000932_A_2610034M16Rik
  gRNA
uaacccccgaaagcuauccc

SEQ ID NO: 933 - RNA, 20 nt, Artificial Sequence
  MKO10000933_A_2610044O15Rik8
  gRNA
guuguaguuaagauucauag

SEQ ID NO: 934 - RNA, 20 nt, Artificial Sequence
  MKO10000934_A_2610044O15Rik8
  gRNA
gaggacacuaagcugaauga

SEQ ID NO: 935 - RNA, 20 nt, Artificial Sequence
  MKO10000935_A_2610044O15Rik8
  gRNA
uaccagaaucucacugauau

SEQ ID NO: 936 - RNA, 20 nt, Artificial Sequence
  MKO10000936_A_2610301B20Rik
  gRNA
cacaggcuacacaacgcagu

SEQ ID NO: 937 - RNA, 20 nt, Artificial Sequence
  MKO10000937_A_2610301B20Rik
  gRNA
gcgcuuccacugagauacac

SEQ ID NO: 938 - RNA, 20 nt, Artificial Sequence
  MKO10000938_A_2610301B20Rik
  gRNA
agucauuguagcucacuauc

SEQ ID NO: 939 - RNA, 20 nt, Artificial Sequence
  MKO10000939_A_2610305D13Rik
  gRNA
gaugaauacgcagacuaacu

SEQ ID NO: 940 - RNA, 20 nt, Artificial Sequence
  MKO10000940_A_2610305D13Rik
  gRNA
uuuacacaaaaguucuaucu

SEQ ID NO: 941 - RNA, 20 nt, Artificial Sequence
  MKO10000941_A_2610305D13Rik
  gRNA
guccaaaaacacauccuuga

SEQ ID NO: 942 - RNA, 20 nt, Artificial Sequence
  MKO10000942_A_2610318N02Rik
  gRNA
gucuuucaucaacgucaaag

SEQ ID NO: 943 - RNA, 20 nt, Artificial Sequence
  MKO10000943_A_2610318N02Rik
  gRNA
cugaccggcuugccagacag

SEQ ID NO: 944 - RNA, 20 nt, Artificial Sequence
  MKO10000944_A_2610318N02Rik
  gRNA
caugguugaucugacccccu

SEQ ID NO: 945 - RNA, 20 nt, Artificial Sequence
  MKO10000945_A_2610507B11Rik
  gRNA
cggaacucaccaccgucugc

SEQ ID NO: 946 - RNA, 20 nt, Artificial Sequence
  MKO10000946_A_2610507B11Rik
  gRNA
guggugucagcgcaaguugc

SEQ ID NO: 947 - RNA, 20 nt, Artificial Sequence
  MKO10000947_A_2610507B11Rik
  gRNA
agaguacucacggcagauca

SEQ ID NO: 948 - RNA, 20 nt, Artificial Sequence
  MKO10000948_A_2610524H06Rik
  gRNA
ggagcagagccgguccuacg

SEQ ID NO: 949 - RNA, 20 nt, Artificial Sequence
  MKO10000949_A_2610524H06Rik
  gRNA
gcucugcuccggcggcaacc

SEQ ID NO: 950 - RNA, 20 nt, Artificial Sequence
  MKO10000950_A_2610524H06Rik
  gRNA
cucugguucgauuaagcuuc

SEQ ID NO: 951 - RNA, 20 nt, Artificial Sequence
  MKO10000951_A_2610528A11Rik
  gRNA
cggaggaggcccuauaucug

SEQ ID NO: 952 - RNA, 20 nt, Artificial Sequence
  MKO10000952_A_2610528A11Rik
  gRNA
ggcaccacccaugacuugac

SEQ ID NO: 953 - RNA, 20 nt, Artificial Sequence
  MKO10000953_A_2610528A11Rik
  gRNA
acagcagcgccugaguuuca

SEQ ID NO: 954 - RNA, 20 nt, Artificial Sequence
  MKO10000954_A_2610528J11Rik
  gRNA
cagcgggcgaugccuguaac

SEQ ID NO: 955 - RNA, 20 nt, Artificial Sequence
  MKO10000955_A_2610528J11Rik
  gRNA
ggccaucaaugcaucaaccg

SEQ ID NO: 956 - RNA, 20 nt, Artificial Sequence
  MKO10000956_A_2610528J11Rik
  gRNA
acuuguguuuccuccaauca

SEQ ID NO: 957 - RNA, 20 nt, Artificial Sequence
  MKO10000957_A_2700029M09Rik
  gRNA
gguccuuaugauauccuugc

SEQ ID NO: 958 - RNA, 20 nt, Artificial Sequence
  MKO10000958_A_2700029M09Rik
  gRNA
ucauuuguacccacguauac

SEQ ID NO: 959 - RNA, 20 nt, Artificial Sequence
  MKO10000959_A_2700029M09Rik
  gRNA
ugaugaacuuccuguauacg

SEQ ID NO: 960 - RNA, 20 nt, Artificial Sequence
  MKO10000960_A_2700049A03Rik
  gRNA
caagacguuuauuugcagcc

SEQ ID NO: 961 - RNA, 20 nt, Artificial Sequence
  MKO10000961_A_2700049A03Rik
  gRNA
aguucuaauggaacguuaug

SEQ ID NO: 962 - RNA, 20 nt, Artificial Sequence
  MKO10000962_A_2700049A03Rik
  gRNA
ucuugcagaaguuaaaucca

SEQ ID NO: 963 - RNA, 20 nt, Artificial Sequence
  MKO10000963_A_2700050L05Rik
  gRNA
agacgugcaaacgcuguucg

SEQ ID NO: 964 - RNA, 20 nt, Artificial Sequence
  MKO10000964_A_2700050L05Rik
  gRNA
uuacgagagagugccaaacu

SEQ ID NO: 965 - RNA, 20 nt, Artificial Sequence
  MKO10000965_A_2700050L05Rik
  gRNA
ggugcacagccaugcucacg

SEQ ID NO: 966 - RNA, 20 nt, Artificial Sequence
  MKO10000966_A_2700060E02Rik
  gRNA
aucggcaagaagcgauugac

SEQ ID NO: 967 - RNA, 20 nt, Artificial Sequence
  MKO10000967_A_2700060E02Rik
  gRNA
aauuuagaaacuuuaucguu

SEQ ID NO: 968 - RNA, 20 nt, Artificial Sequence
  MKO10000968_A_2700060E02Rik
  gRNA
ucaccauccaaguugaucag

SEQ ID NO: 969 - RNA, 20 nt, Artificial Sequence
  MKO10000969_A_2700062C07Rik
  gRNA
ccuaccgugugucgaacugu

SEQ ID NO: 970 - RNA, 20 nt, Artificial Sequence
  MKO10000970_A_2700062C07Rik
  gRNA
ugggccuacaguucgacaca

SEQ ID NO: 971 - RNA, 20 nt, Artificial Sequence
  MKO10000971_A_2700062C07Rik
  gRNA
cgucuucgggcuggccuugu

SEQ ID NO: 972 - RNA, 20 nt, Artificial Sequence
  MKO10000972_A_2700081O15Rik
  gRNA
ggcgcaacuaccagccgcgc

SEQ ID NO: 973 - RNA, 20 nt, Artificial Sequence
  MKO10000973_A_2700081O15Rik
  gRNA
agauccgcgccgcugucucg

SEQ ID NO: 974 - RNA, 20 nt, Artificial Sequence
  MKO10000974_A_2700081O15Rik
  gRNA
gcaucccgaaccggccucgg

SEQ ID NO: 975 - RNA, 20 nt, Artificial Sequence
  MKO10000975_A_2700089E24Rik
  gRNA
ccccguccgcccuagcgcuc

SEQ ID NO: 976 - RNA, 20 nt, Artificial Sequence
  MKO10000976_A_2700089E24Rik
  gRNA
gagcccgcgauguagaagua

SEQ ID NO: 977 - RNA, 20 nt, Artificial Sequence
  MKO10000977_A_2700089E24Rik
  gRNA
ccugcggccgccaccccgua

SEQ ID NO: 978 - RNA, 20 nt, Artificial Sequence
  MKO10000978_A_2700094K13Rik
  gRNA
uaaggcgggggccgcgccua

SEQ ID NO: 979 - RNA, 20 nt, Artificial Sequence
  MKO10000979_A_2700094K13Rik
  gRNA
gguggacaagcgcgagaaac

SEQ ID NO: 980 - RNA, 20 nt, Artificial Sequence
  MKO10000980_A_2700094K13Rik
  gRNA
aguacgagcugacgcgugua

SEQ ID NO: 981 - RNA, 20 nt, Artificial Sequence
  MKO10000981_A_2700097O09Rik
  gRNA
gcguacccaaaggcgcuguu

SEQ ID NO: 982 - RNA, 20 nt, Artificial Sequence
  MKO10000982_A_2700097O09Rik
  gRNA
cucacaccgaacagcgccuu

SEQ ID NO: 983 - RNA, 20 nt, Artificial Sequence
  MKO10000983_A_2700097O09Rik
  gRNA
ccuuuauucugucaccgaac

SEQ ID NO: 984 - RNA, 20 nt, Artificial Sequence
  MKO10000984_A_2810004N23Rik
  gRNA
gcgggagcgagcuaucaugc

SEQ ID NO: 985 - RNA, 20 nt, Artificial Sequence
  MKO10000985_A_2810004N23Rik
  gRNA
ugauagcucgcucccgcucc

SEQ ID NO: 986 - RNA, 20 nt, Artificial Sequence
  MKO10000986_A_2810004N23Rik
  gRNA
guaguucacguaaguguucu

SEQ ID NO: 987 - RNA, 20 nt, Artificial Sequence
  MKO10000987_A_2810006K23Rik
  gRNA
cucgaagaacaguucgugaa

SEQ ID NO: 988 - RNA, 20 nt, Artificial Sequence
  MKO10000988_A_2810006K23Rik
  gRNA
gugcucaaacacgugcccuc

SEQ ID NO: 989 - RNA, 20 nt, Artificial Sequence
  MKO10000989_A_2810006K23Rik
  gRNA
cguucacaaagagaagcucg

SEQ ID NO: 990 - RNA, 20 nt, Artificial Sequence
  MKO10000990_A_2810007J24Rik
  gRNA
gcucauuggcaauuguagau

SEQ ID NO: 991 - RNA, 20 nt, Artificial Sequence
  MKO10000991_A_2810007J24Rik
  gRNA
cuacuucaaugcucuaaaac

SEQ ID NO: 992 - RNA, 20 nt, Artificial Sequence
  MKO10000992_A_2810007J24Rik
  gRNA
uugccaaugagcgcacacca

SEQ ID NO: 993 - RNA, 20 nt, Artificial Sequence
  MKO10000993_A_2810021J22Rik
  gRNA
ccuucgaugugcgcacugua

SEQ ID NO: 994 - RNA, 20 nt, Artificial Sequence
  MKO10000994_A_2810021J22Rik
  gRNA
ccauacagugcgcacaucga

SEQ ID NO: 995 - RNA, 20 nt, Artificial Sequence
  MKO10000995_A_2810021J22Rik
  gRNA
gaggagaaugagcaguauug

SEQ ID NO: 996 - RNA, 20 nt, Artificial Sequence
  MKO10000996_A_2810403A07Rik
  gRNA
uucucggccgcauucugaga

SEQ ID NO: 997 - RNA, 20 nt, Artificial Sequence
  MKO10000997_A_2810403A07Rik
  gRNA
accaccgccgccgcuccuuc

SEQ ID NO: 998 - RNA, 20 nt, Artificial Sequence
  MKO10000998_A_2810403A07Rik
  gRNA
gugucuguccucgugucagc

SEQ ID NO: 999 - RNA, 20 nt, Artificial Sequence
  MKO10000999_A_2810408A11Rik
  gRNA
accuuaggaagucucagcgc

SEQ ID NO: 1000 - RNA, 20 nt, Artificial Sequence
  MKO10001000_A_2810408A11Rik
  gRNA
agcccagaacccccuaccac

SEQ ID NO: 1001 - RNA, 20 nt, Artificial Sequence
  MKO10001001_A_2810408A11Rik
  gRNA
aaccguuggugcuuaagaca

SEQ ID NO: 1002 - RNA, 20 nt, Artificial Sequence
  MKO10001002_A_2810408M09Rik
  gRNA
aggcauggcuggcacguccu

SEQ ID NO: 1003 - RNA, 20 nt, Artificial Sequence
  MKO10001003_A_2810408M09Rik
  gRNA
gccgaggcgcgcgucuuccg

SEQ ID NO: 1004 - RNA, 20 nt, Artificial Sequence
  MKO10001004_A_2810408M09Rik
  gRNA
cuucaaacacggucucggug

SEQ ID NO: 1005 - RNA, 20 nt, Artificial Sequence
  MKO10001005_A_2810417H13Rik
  gRNA
ucuucaaguucgucgagaaa

SEQ ID NO: 1006 - RNA, 20 nt, Artificial Sequence
  MKO10001006_A_2810417H13Rik
  gRNA
accaaagcaaacuacguucc

SEQ ID NO: 1007 - RNA, 20 nt, Artificial Sequence
  MKO10001007_A_2810417H13Rik
  gRNA
uccuggaacguaguuugcuu

SEQ ID NO: 1008 - RNA, 20 nt, Artificial Sequence
  MKO10001008_A_2810428I15Rik
  gRNA
agacgccccgaucgcuacac

SEQ ID NO: 1009 - RNA, 20 nt, Artificial Sequence
  MKO10001009_A_2810428I15Rik
  gRNA
cuucgccgcugccucgcggg

SEQ ID NO: 1010 - RNA, 20 nt, Artificial Sequence
  MKO10001010_A_2810428I15Rik
  gRNA
cgcacguggcgggcgagcac

SEQ ID NO: 1011 - RNA, 20 nt, Artificial Sequence
  MKO10001011_A_2810459M11Rik
  gRNA
cuugcaccgggcccccgacc

SEQ ID NO: 1012 - RNA, 20 nt, Artificial Sequence
  MKO10001012_A_2810459M11Rik
  gRNA
cgcgucauccgcacccgugu

SEQ ID NO: 1013 - RNA, 20 nt, Artificial Sequence
  MKO10001013_A_2810459M11Rik
  gRNA
caagcuccucuuccgagaac

SEQ ID NO: 1014 - RNA, 20 nt, Artificial Sequence
  MKO10001014_A_2810474O19Rik
  gRNA
cgucaaacacagauccgugc

SEQ ID NO: 1015 - RNA, 20 nt, Artificial Sequence
  MKO10001015_A_2810474O19Rik
  gRNA
ugacuaucaauuaccugauu

SEQ ID NO: 1016 - RNA, 20 nt, Artificial Sequence
  MKO10001016_A_2810474O19Rik
  gRNA
acuuccugggacuauuuaac

SEQ ID NO: 1017 - RNA, 20 nt, Artificial Sequence
  MKO10001017_A_2900011O08Rik
  gRNA
augccgagguggaacgcuua

SEQ ID NO: 1018 - RNA, 20 nt, Artificial Sequence
  MKO10001018_A_2900011O08Rik
  gRNA
uccgucgagagucagaacuc

SEQ ID NO: 1019 - RNA, 20 nt, Artificial Sequence
  MKO10001019_A_2900011O08Rik
  gRNA
ccaccuuaagcguuccaccu

SEQ ID NO: 1020 - RNA, 20 nt, Artificial Sequence
  MKO10001020_A_2900026A02Rik
  gRNA
ugaguaagcgaagccgucgc

SEQ ID NO: 1021 - RNA, 20 nt, Artificial Sequence
  MKO10001021_A_2900026A02Rik
  gRNA
gucacgcugcuccaccgacg

SEQ ID NO: 1022 - RNA, 20 nt, Artificial Sequence
  MKO10001022_A_2900026A02Rik
  gRNA
acggacgcugcgcugcuguc

SEQ ID NO: 1023 - RNA, 20 nt, Artificial Sequence
  MKO10001023_A_2900092C05Rik
  gRNA
guauacuuacuauaucacgu

SEQ ID NO: 1024 - RNA, 20 nt, Artificial Sequence
  MKO10001024_A_2900092C05Rik
  gRNA
cagucgacugguaaaaguug

SEQ ID NO: 1025 - RNA, 20 nt, Artificial Sequence
  MKO10001025_A_2900092C05Rik
  gRNA
gcugggauuauuacuucugu

SEQ ID NO: 1026 - RNA, 20 nt, Artificial Sequence
  MKO10001026_A_42432
  gRNA
ugaguccgacggccuccagc

SEQ ID NO: 1027 - RNA, 20 nt, Artificial Sequence
  MKO10001027_A_42432
  gRNA
gcacauuggccggucauuga

SEQ ID NO: 1028 - RNA, 20 nt, Artificial Sequence
  MKO10001028_A_42432
  gRNA
cuucuuguuuauaacgcccc

SEQ ID NO: 1029 - RNA, 20 nt, Artificial Sequence
  MKO10001029_A_42616
  gRNA
gguacguacgaguguccugu

SEQ ID NO: 1030 - RNA, 20 nt, Artificial Sequence
  MKO10001030_A_42616
  gRNA
gggccccagcuuacgaccac

SEQ ID NO: 1031 - RNA, 20 nt, Artificial Sequence
  MKO10001031_A_42616
  gRNA
ugaauuccgacuucuccucc

SEQ ID NO: 1032 - RNA, 20 nt, Artificial Sequence
  MKO10001032_A_3010026O09Rik
  gRNA
cuaagccccucgagucccgu

SEQ ID NO: 1033 - RNA, 20 nt, Artificial Sequence
  MKO10001033_A_3010026O09Rik
  gRNA
uccucucaggcuuacgguga

SEQ ID NO: 1034 - RNA, 20 nt, Artificial Sequence
  MKO10001034_A_3010026O09Rik
  gRNA
uguccagauacuucaaccaa

SEQ ID NO: 1035 - RNA, 20 nt, Artificial Sequence
  MKO10001035_A_3110001I22Rik
  gRNA
ugaacuaagugagcgcugug

SEQ ID NO: 1036 - RNA, 20 nt, Artificial Sequence
  MKO10001036_A_3110001I22Rik
  gRNA
uucuucacugugccguuugu

SEQ ID NO: 1037 - RNA, 20 nt, Artificial Sequence
  MKO10001037_A_3110001I22Rik
  gRNA
ccagugaugaaucuacccug

SEQ ID NO: 1038 - RNA, 20 nt, Artificial Sequence
  MKO10001038_A_3110002H16Rik
  gRNA
gcuacaggaguggucguuaa

SEQ ID NO: 1039 - RNA, 20 nt, Artificial Sequence
  MKO10001039_A_3110002H16Rik
  gRNA
aucgucuucauaacugacca

SEQ ID NO: 1040 - RNA, 20 nt, Artificial Sequence
  MKO10001040_A_3110002H16Rik
  gRNA
ccagcagaauccgaguaugu

SEQ ID NO: 1041 - RNA, 20 nt, Artificial Sequence
  MKO10001041_A_3110007F17Rik
  gRNA
gcaagagagcugcaagaaau

SEQ ID NO: 1042 - RNA, 20 nt, Artificial Sequence
  MKO10001042_A_3110007F17Rik
  gRNA
ccacauauuugaugccagca

SEQ ID NO: 1043 - RNA, 20 nt, Artificial Sequence
  MKO10001043_A_3110007F17Rik
  gRNA
gaccaacaacauuugcaacc

SEQ ID NO: 1044 - RNA, 20 nt, Artificial Sequence
  MKO10001044_A_3110009E18Rik
  gRNA
ccgcuuucaccaggacgaga

SEQ ID NO: 1045 - RNA, 20 nt, Artificial Sequence
  MKO10001045_A_3110009E18Rik
  gRNA
aucucuccacauggcugcgg

SEQ ID NO: 1046 - RNA, 20 nt, Artificial Sequence
  MKO10001046_A_3110009E18Rik
  gRNA
ucauccguucauuugagcau

SEQ ID NO: 1047 - RNA, 20 nt, Artificial Sequence
  MKO10001047_A_3110021N24Rik
  gRNA
cuggaccccacgucccgcua

SEQ ID NO: 1048 - RNA, 20 nt, Artificial Sequence
  MKO10001048_A_3110021N24Rik
  gRNA
cccguggcccgccccugacg

SEQ ID NO: 1049 - RNA, 20 nt, Artificial Sequence
  MKO10001049_A_3110021N24Rik
  gRNA
aacuguagguucauucacac

SEQ ID NO: 1050 - RNA, 20 nt, Artificial Sequence
  MKO10001050_A_3110035E14Rik
  gRNA
ccgaccuguacccgccacca

SEQ ID NO: 1051 - RNA, 20 nt, Artificial Sequence
  MKO10001051_A_3110035E14Rik
  gRNA
uucaccgagauccuagccac

SEQ ID NO: 1052 - RNA, 20 nt, Artificial Sequence
  MKO10001052_A_3110035E14Rik
  gRNA
ugccucaacgcugugagcgc

SEQ ID NO: 1053 - RNA, 20 nt, Artificial Sequence
  MKO10001053_A_3110040N11Rik
  gRNA
acuggccuugcuugucgcac

SEQ ID NO: 1054 - RNA, 20 nt, Artificial Sequence
  MKO10001054_A_3110040N11Rik
  gRNA
cauugcagcaccuccguccg

SEQ ID NO: 1055 - RNA, 20 nt, Artificial Sequence
  MKO10001055_A_3110040N11Rik
  gRNA
auagccauucaugccaaacc

SEQ ID NO: 1056 - RNA, 20 nt, Artificial Sequence
  MKO10001056_A_3110043O21Rik
  gRNA
aguaucauucccaugcuuac

SEQ ID NO: 1057 - RNA, 20 nt, Artificial Sequence
  MKO10001057_A_3110043O21Rik
  gRNA
ugcacugcugccaacuacaa

SEQ ID NO: 1058 - RNA, 20 nt, Artificial Sequence
  MKO10001058_A_3110043O21Rik
  gRNA
aaugacuuccccaguaagca

SEQ ID NO: 1059 - RNA, 20 nt, Artificial Sequence
  MKO10001059_A_3110047P20Rik
  gRNA
cgcaggucauagaucuguac

SEQ ID NO: 1060 - RNA, 20 nt, Artificial Sequence
  MKO10001060_A_3110047P20Rik
  gRNA
gccuucugccaguagugaac

SEQ ID NO: 1061 - RNA, 20 nt, Artificial Sequence
  MKO10001061_A_3110047P20Rik
  gRNA
ggccucuuaggugaaaaaua

SEQ ID NO: 1062 - RNA, 20 nt, Artificial Sequence
  MKO10001062_A_3110052M02Rik
  gRNA
uuugugacaaauccuauaac

SEQ ID NO: 1063 - RNA, 20 nt, Artificial Sequence
  MKO10001063_A_3110052M02Rik
  gRNA
uugaugaacaguaucacaug

SEQ ID NO: 1064 - RNA, 20 nt, Artificial Sequence
  MKO10001064_A_3110052M02Rik
  gRNA
ugugucuguagacuucucac

SEQ ID NO: 1065 - RNA, 20 nt, Artificial Sequence
  MKO10001065_A_3110057O12Rik
  gRNA
cuacccgguacacaucgaua

SEQ ID NO: 1066 - RNA, 20 nt, Artificial Sequence
  MKO10001066_A_3110057O12Rik
  gRNA
cauaccuuaucgauguguac

SEQ ID NO: 1067 - RNA, 20 nt, Artificial Sequence
  MKO10001067_A_3110057O12Rik
  gRNA
cuugcaacaacagauucaau

SEQ ID NO: 1068 - RNA, 20 nt, Artificial Sequence
  MKO10001068_A_3110062M04Rik
  gRNA
aagacgcguugaaguacguc

SEQ ID NO: 1069 - RNA, 20 nt, Artificial Sequence
  MKO10001069_A_3110062M04Rik
  gRNA
agaggggaggacccucguuu

SEQ ID NO: 1070 - RNA, 20 nt, Artificial Sequence
  MKO10001070_A_3110062M04Rik
  gRNA
ugcucugcagggccgcaaac

SEQ ID NO: 1071 - RNA, 20 nt, Artificial Sequence
  MKO10001071_A_3110079O15Rik
  gRNA
cagcagggcagcgaucacga

SEQ ID NO: 1072 - RNA, 20 nt, Artificial Sequence
  MKO10001072_A_3110079O15Rik
  gRNA
uccauaggaucgcuuggacc

SEQ ID NO: 1073 - RNA, 20 nt, Artificial Sequence
  MKO10001073_A_3110079O15Rik
  gRNA
ucaccagagggcaauucaau

SEQ ID NO: 1074 - RNA, 20 nt, Artificial Sequence
  MKO10001074_A_3110082I17Rik
  gRNA
guccucggcgucuccucugc

SEQ ID NO: 1075 - RNA, 20 nt, Artificial Sequence
  MKO10001075_A_3110082I17Rik
  gRNA
gaaggugcagcgccuccgcc

SEQ ID NO: 1076 - RNA, 20 nt, Artificial Sequence
  MKO10001076_A_3110082I17Rik
  gRNA
ccugaugcagaagcucgaug

SEQ ID NO: 1077 - RNA, 20 nt, Artificial Sequence
  MKO10001077_A_3110082J24Rik
  gRNA
cuccccgggguucgccgucc

SEQ ID NO: 1078 - RNA, 20 nt, Artificial Sequence
  MKO10001078_A_3110082J24Rik
  gRNA
uggccgucggggucccggga

SEQ ID NO: 1079 - RNA, 20 nt, Artificial Sequence
  MKO10001079_A_3110082J24Rik
  gRNA
ccaggcggggagcgccgcuu

SEQ ID NO: 1080 - RNA, 20 nt, Artificial Sequence
  MKO10001080_A_3300002I08Rik
  gRNA
gcauguuccgugugccgccg

SEQ ID NO: 1081 - RNA, 20 nt, Artificial Sequence
  MKO10001081_A_3300002I08Rik
  gRNA
agcucaggcaagucccgaca

SEQ ID NO: 1082 - RNA, 20 nt, Artificial Sequence
  MKO10001082_A_3300002I08Rik
  gRNA
gugcuaccuuguugcaacuu

SEQ ID NO: 1083 - RNA, 20 nt, Artificial Sequence
  MKO10001083_A_3425401B19Rik
  gRNA
gcccuacggggcuaacucgg

SEQ ID NO: 1084 - RNA, 20 nt, Artificial Sequence
  MKO10001084_A_3425401B19Rik
  gRNA
uacuccgugccgccaaacaa

SEQ ID NO: 1085 - RNA, 20 nt, Artificial Sequence
  MKO10001085_A_3425401B19Rik
  gRNA
acagcaacccaaguacguuc

SEQ ID NO: 1086 - RNA, 20 nt, Artificial Sequence
  MKO10001086_A_3632451O06Rik
  gRNA
augcuuccugaacguauguc

SEQ ID NO: 1087 - RNA, 20 nt, Artificial Sequence
  MKO10001087_A_3632451O06Rik
  gRNA
gccauuggagagcccaauac

SEQ ID NO: 1088 - RNA, 20 nt, Artificial Sequence
  MKO10001088_A_3632451O06Rik
  gRNA
accaucgaagucuuuauaca

SEQ ID NO: 1089 - RNA, 20 nt, Artificial Sequence
  MKO10001089_A_3830403N18Rik
  gRNA
ucacauaaaaagaaaacgca

SEQ ID NO: 1090 - RNA, 20 nt, Artificial Sequence
  MKO10001090_A_3830403N18Rik
  gRNA
guaucuccaacuacuucuuc

SEQ ID NO: 1091 - RNA, 20 nt, Artificial Sequence
  MKO10001091_A_3830403N18Rik
  gRNA
gcaaauccugaagaaguagu

SEQ ID NO: 1092 - RNA, 20 nt, Artificial Sequence
  MKO10001092_A_3830406C13Rik
  gRNA
aagaaaccuccgacucuuga

SEQ ID NO: 1093 - RNA, 20 nt, Artificial Sequence
  MKO10001093_A_3830406C13Rik
  gRNA
accucaagagaaagcaucga

SEQ ID NO: 1094 - RNA, 20 nt, Artificial Sequence
  MKO10001094_A_3830406C13Rik
  gRNA
gccuucgaugcuuucucuug

SEQ ID NO: 1095 - RNA, 20 nt, Artificial Sequence
  MKO10001095_A_3830417A13Rik
  gRNA
uccauguagcaucccgucau

SEQ ID NO: 1096 - RNA, 20 nt, Artificial Sequence
  MKO10001096_A_3830417A13Rik
  gRNA
cauaagcucgugcgccccac

SEQ ID NO: 1097 - RNA, 20 nt, Artificial Sequence
  MKO10001097_A_3830417A13Rik
  gRNA
accuaugacgggaugcuaca

SEQ ID NO: 1098 - RNA, 20 nt, Artificial Sequence
  MKO10001098_A_42433
  gRNA
uuuaaagaugcgauauaccg

SEQ ID NO: 1099 - RNA, 20 nt, Artificial Sequence
  MKO10001099_A_42433
  gRNA
gacccugguggcgcaacauc

SEQ ID NO: 1100 - RNA, 20 nt, Artificial Sequence
  MKO10001100_A_42433
  gRNA
cuaagcccaugccguuguga

SEQ ID NO: 1101 - RNA, 20 nt, Artificial Sequence
  MKO10001101_A_42617
  gRNA
cggaaacugcugggcgccga

SEQ ID NO: 1102 - RNA, 20 nt, Artificial Sequence
  MKO10001102_A_42617
  gRNA
agagcggaucaugcaaaccg

SEQ ID NO: 1103 - RNA, 20 nt, Artificial Sequence
  MKO10001103_A_42617
  gRNA
uugucuuggacuccgcugag

SEQ ID NO: 1104 - RNA, 20 nt, Artificial Sequence
  MKO10001104_A_4430402I18Rik
  gRNA
cguucuagcaugggaagagu

SEQ ID NO: 1105 - RNA, 20 nt, Artificial Sequence
  MKO10001105_A_4430402I18Rik
  gRNA
uuaguacagcuagugucucc

SEQ ID NO: 1106 - RNA, 20 nt, Artificial Sequence
  MKO10001106_A_4430402I18Rik
  gRNA
uagcuguacuaauucaaacc

SEQ ID NO: 1107 - RNA, 20 nt, Artificial Sequence
  MKO10001107_A_4632428N05Rik
  gRNA
acgguacuuacggcggugag

SEQ ID NO: 1108 - RNA, 20 nt, Artificial Sequence
  MKO10001108_A_4632428N05Rik
  gRNA
cuacggguccauggagcuac

SEQ ID NO: 1109 - RNA, 20 nt, Artificial Sequence
  MKO10001109_A_4632428N05Rik
  gRNA
augugaccaucuacaagacg

SEQ ID NO: 1110 - RNA, 20 nt, Artificial Sequence
  MKO10001110_A_4632434I11Rik
  gRNA
uuacggccacugguuuacac

SEQ ID NO: 1111 - RNA, 20 nt, Artificial Sequence
  MKO10001111_A_4632434I11Rik
  gRNA
gaaggauucgcuguuucuuc

SEQ ID NO: 1112 - RNA, 20 nt, Artificial Sequence
  MKO10001112_A_4632434I11Rik
  gRNA
acacugcaucuccguuuccg

SEQ ID NO: 1113 - RNA, 20 nt, Artificial Sequence
  MKO10001113_A_4732456N10Rik
  gRNA
ggaaauccacagacguacag

SEQ ID NO: 1114 - RNA, 20 nt, Artificial Sequence
  MKO10001114_A_4732456N10Rik
  gRNA
ucucugccgcuguacgucug

SEQ ID NO: 1115 - RNA, 20 nt, Artificial Sequence
  MKO10001115_A_4732456N10Rik
  gRNA
aagccuacaucaccaaccug

SEQ ID NO: 1116 - RNA, 20 nt, Artificial Sequence
  MKO10001116_A_4833403I15Rik
  gRNA
acgauucgucaaauaucaac

SEQ ID NO: 1117 - RNA, 20 nt, Artificial Sequence
  MKO10001117_A_4833403I15Rik
  gRNA
cuugagcaucaucgcccaug

SEQ ID NO: 1118 - RNA, 20 nt, Artificial Sequence
  MKO10001118_A_4833403I15Rik
  gRNA
gcuccauuugagucgcuacc

SEQ ID NO: 1119 - RNA, 20 nt, Artificial Sequence
  MKO10001119_A_4833420G17Rik
  gRNA
uugaaaaccgauccgucucc

SEQ ID NO: 1120 - RNA, 20 nt, Artificial Sequence
  MKO10001120_A_4833420G17Rik
  gRNA
aaagguacgcguguccaucc

SEQ ID NO: 1121 - RNA, 20 nt, Artificial Sequence
  MKO10001121_A_4833420G17Rik
  gRNA
cugaagaguuucgaaaaucu

SEQ ID NO: 1122 - RNA, 20 nt, Artificial Sequence
  MKO10001122_A_4833423E24Rik
  gRNA
cuaacgucuugcgcaauuca

SEQ ID NO: 1123 - RNA, 20 nt, Artificial Sequence
  MKO10001123_A_4833423E24Rik
  gRNA
ugaauugcgcaagacguuag

SEQ ID NO: 1124 - RNA, 20 nt, Artificial Sequence
  MKO10001124_A_4833423E24Rik
  gRNA
ugaugugggcccacucuuuc

SEQ ID NO: 1125 - RNA, 20 nt, Artificial Sequence
  MKO10001125_A_4833424O15Rik
  gRNA
cgccgaaccguccgauuucu

SEQ ID NO: 1126 - RNA, 20 nt, Artificial Sequence
  MKO10001126_A_4833424O15Rik
  gRNA
cguaauuaccgucagauacg

SEQ ID NO: 1127 - RNA, 20 nt, Artificial Sequence
  MKO10001127_A_4833424O15Rik
  gRNA
cuacgcugccacguaucuga

SEQ ID NO: 1128 - RNA, 20 nt, Artificial Sequence
  MKO10001128_A_4833427G06Rik
  gRNA
auacuuacuguccugaucaa

SEQ ID NO: 1129 - RNA, 20 nt, Artificial Sequence
  MKO10001129_A_4833427G06Rik
  gRNA
uucauuaccuuauaaaccua

SEQ ID NO: 1130 - RNA, 20 nt, Artificial Sequence
  MKO10001130_A_4833427G06Rik
  gRNA
gagagcaaaguaucuccaaa

SEQ ID NO: 1131 - RNA, 20 nt, Artificial Sequence
  MKO10001131_A_4833439L19Rik
  gRNA
agggcgcuuacuugugauca

SEQ ID NO: 1132 - RNA, 20 nt, Artificial Sequence
  MKO10001132_A_4833439L19Rik
  gRNA
gggaugcugcccauguccga

SEQ ID NO: 1133 - RNA, 20 nt, Artificial Sequence
  MKO10001133_A_4833439L19Rik
  gRNA
caucauagcugaaugcccga

SEQ ID NO: 1134 - RNA, 20 nt, Artificial Sequence
  MKO10001134_A_4921501E09Rik
  gRNA
cuugggguacgccgagaaac

SEQ ID NO: 1135 - RNA, 20 nt, Artificial Sequence
  MKO10001135_A_4921501E09Rik
  gRNA
agauaguucguaagcuuucc

SEQ ID NO: 1136 - RNA, 20 nt, Artificial Sequence
  MKO10001136_A_4921501E09Rik
  gRNA
cucucaaagccgcaaucuuc

SEQ ID NO: 1137 - RNA, 20 nt, Artificial Sequence
  MKO10001137_A_4921504E06Rik
  gRNA
gauuauuacaucacuucacg

SEQ ID NO: 1138 - RNA, 20 nt, Artificial Sequence
  MKO10001138_A_4921504E06Rik
  gRNA
gaugccauagcuauuaucaa

SEQ ID NO: 1139 - RNA, 20 nt, Artificial Sequence
  MKO10001139_A_4921504E06Rik
  gRNA
gaaagauuugacucaaucca

SEQ ID NO: 1140 - RNA, 20 nt, Artificial Sequence
  MKO10001140_A_4921506M07Rik
  gRNA
gccaucgcacgagaucgcgc

SEQ ID NO: 1141 - RNA, 20 nt, Artificial Sequence
  MKO10001141_A_4921506M07Rik
  gRNA
ccauugcgaugucguaguuc

SEQ ID NO: 1142 - RNA, 20 nt, Artificial Sequence
  MKO10001142_A_4921506M07Rik
  gRNA
aaagguuuaccgucguccuc

SEQ ID NO: 1143 - RNA, 20 nt, Artificial Sequence
  MKO10001143_A_4921507P07Rik
  gRNA
aagguccuuaggcgauguaa

SEQ ID NO: 1144 - RNA, 20 nt, Artificial Sequence
  MKO10001144_A_4921507P07Rik
  gRNA
ccccgccaaauccguaaugc

SEQ ID NO: 1145 - RNA, 20 nt, Artificial Sequence
  MKO10001145_A_4921507P07Rik
  gRNA
uccgaccuuuacaucgccua

SEQ ID NO: 1146 - RNA, 20 nt, Artificial Sequence
  MKO10001146_A_4921509C19Rik
  gRNA
cucugauuaaaccguuccuc

SEQ ID NO: 1147 - RNA, 20 nt, Artificial Sequence
  MKO10001147_A_4921509C19Rik
  gRNA
ccccucuauaauggugcuca

SEQ ID NO: 1148 - RNA, 20 nt, Artificial Sequence
  MKO10001148_A_4921509C19Rik
  gRNA
ucuguuugaagagcauuuag

SEQ ID NO: 1149 - RNA, 20 nt, Artificial Sequence
  MKO10001149_A_4921511H03Rik
  gRNA
aucacagucuccgucuauag

SEQ ID NO: 1150 - RNA, 20 nt, Artificial Sequence
  MKO10001150_A_4921511H03Rik
  gRNA
gccacacaauaucggaaucc

SEQ ID NO: 1151 - RNA, 20 nt, Artificial Sequence
  MKO10001151_A_4921511H03Rik
  gRNA
uccccauucuagaaacggga

SEQ ID NO: 1152 - RNA, 20 nt, Artificial Sequence
  MKO10001152_A_4921511M17Rik
  gRNA
aucaacucaucguugauacu

SEQ ID NO: 1153 - RNA, 20 nt, Artificial Sequence
  MKO10001153_A_4921511M17Rik
  gRNA
cuacagauuuaucaaugaga

SEQ ID NO: 1154 - RNA, 20 nt, Artificial Sequence
  MKO10001154_A_4921511M17Rik
  gRNA
uaucacuucacgcaucuaga

SEQ ID NO: 1155 - RNA, 20 nt, Artificial Sequence
  MKO10001155_A_4921517D22Rik
  gRNA
auuucaaggggcuugcgacg

SEQ ID NO: 1156 - RNA, 20 nt, Artificial Sequence
  MKO10001156_A_4921517D22Rik
  gRNA
ccaaaucaucguacuccacc

SEQ ID NO: 1157 - RNA, 20 nt, Artificial Sequence
  MKO10001157_A_4921517D22Rik
  gRNA
aaauucauaccaaacaucgg

SEQ ID NO: 1158 - RNA, 20 nt, Artificial Sequence
  MKO10001158_A_4921524J17Rik
  gRNA
gugccccgagugcgaccaac

SEQ ID NO: 1159 - RNA, 20 nt, Artificial Sequence
  MKO10001159_A_4921524J17Rik
  gRNA
gagaaaucaccgccgucuac

SEQ ID NO: 1160 - RNA, 20 nt, Artificial Sequence
  MKO10001160_A_4921524J17Rik
  gRNA
gcccaccuguuggucgcacu

SEQ ID NO: 1161 - RNA, 20 nt, Artificial Sequence
  MKO10001161_A_4921524L21Rik
  gRNA
uucaauagugacgacuaagu

SEQ ID NO: 1162 - RNA, 20 nt, Artificial Sequence
  MKO10001162_A_4921524L21Rik
  gRNA
acgucuucccuugucgcccc

SEQ ID NO: 1163 - RNA, 20 nt, Artificial Sequence
  MKO10001163_A_4921524L21Rik
  gRNA
cugccaagaagaugcgcugu

SEQ ID NO: 1164 - RNA, 20 nt, Artificial Sequence
  MKO10001164_A_4921530D09Rik
  gRNA
ucuguccgcgucgccgaacc

SEQ ID NO: 1165 - RNA, 20 nt, Artificial Sequence
  MKO10001165_A_4921530D09Rik
  gRNA
cucggcggagguugcugcgc

SEQ ID NO: 1166 - RNA, 20 nt, Artificial Sequence
  MKO10001166_A_4921530D09Rik
  gRNA
ccaccagauuauccgccaac

SEQ ID NO: 1167 - RNA, 20 nt, Artificial Sequence
  MKO10001167_A_4921530L21Rik
  gRNA
uauucuucccccgacaguuu

SEQ ID NO: 1168 - RNA, 20 nt, Artificial Sequence
  MKO10001168_A_4921530L21Rik
  gRNA
uuggcaacagaaucgagcca

SEQ ID NO: 1169 - RNA, 20 nt, Artificial Sequence
  MKO10001169_A_4921530L21Rik
  gRNA
gcagagccuuagccucauuc

SEQ ID NO: 1170 - RNA, 20 nt, Artificial Sequence
  MKO10001170_A_4921536K21Rik
  gRNA
cgcacagcguaucugcgaga

SEQ ID NO: 1171 - RNA, 20 nt, Artificial Sequence
  MKO10001171_A_4921536K21Rik
  gRNA
cgcagauacgcugugcguug

SEQ ID NO: 1172 - RNA, 20 nt, Artificial Sequence
  MKO10001172_A_4921536K21Rik
  gRNA
accgaagagacuaccgcuuc

SEQ ID NO: 1173 - RNA, 20 nt, Artificial Sequence
  MKO10001173_A_4921539E11Rik
  gRNA
uauaucucuucguuaucuua

SEQ ID NO: 1174 - RNA, 20 nt, Artificial Sequence
  MKO10001174_A_4921539E11Rik
  gRNA
aacgucucuccuccauuuac

SEQ ID NO: 1175 - RNA, 20 nt, Artificial Sequence
  MKO10001175_A_4921539E11Rik
  gRNA
ugaauccaaugcuaguaaga

SEQ ID NO: 1176 - RNA, 20 nt, Artificial Sequence
  MKO10001176_A_4922501C03Rik
  gRNA
cacaauugaaagcuuuacau

SEQ ID NO: 1177 - RNA, 20 nt, Artificial Sequence
  MKO10001177_A_4922501C03Rik
  gRNA
cgucaagccuuucucaagcc

SEQ ID NO: 1178 - RNA, 20 nt, Artificial Sequence
  MKO10001178_A_4922501C03Rik
  gRNA
gaagacauaucagccuguua

SEQ ID NO: 1179 - RNA, 20 nt, Artificial Sequence
  MKO10001179_A_4922501L14Rik
  gRNA
cguauuuaacagcguugucc

SEQ ID NO: 1180 - RNA, 20 nt, Artificial Sequence
  MKO10001180_A_4922501L14Rik
  gRNA
cuacuucggguucgugugug

SEQ ID NO: 1181 - RNA, 20 nt, Artificial Sequence
  MKO10001181_A_4922501L14Rik
  gRNA
acggugcuugaacucgcagc

SEQ ID NO: 1182 - RNA, 20 nt, Artificial Sequence
  MKO10001182_A_4922502D21Rik
  gRNA
aaacaagacaugugacgacg

SEQ ID NO: 1183 - RNA, 20 nt, Artificial Sequence
  MKO10001183_A_4922502D21Rik
  gRNA
cguaguuuguuccagucuuu

SEQ ID NO: 1184 - RNA, 20 nt, Artificial Sequence
  MKO10001184_A_4922502D21Rik
  gRNA
gugugccuucgugcaucaaa

SEQ ID NO: 1185 - RNA, 20 nt, Artificial Sequence
  MKO10001185_A_4922505E12Rik
  gRNA
accgaacagcgcuccuugcc

SEQ ID NO: 1186 - RNA, 20 nt, Artificial Sequence
  MKO10001186_A_4922505E12Rik
  gRNA
ggucgcgguuacuccuauuc

SEQ ID NO: 1187 - RNA, 20 nt, Artificial Sequence
  MKO10001187_A_4922505E12Rik
  gRNA
cgcgggcuggguugaucccg

SEQ ID NO: 1188 - RNA, 20 nt, Artificial Sequence
  MKO10001188_A_4930402F06Rik
  gRNA
acugguccgcuccgauugug

SEQ ID NO: 1189 - RNA, 20 nt, Artificial Sequence
  MKO10001189_A_4930402F06Rik
  gRNA
uagcucaguugcacacguau

SEQ ID NO: 1190 - RNA, 20 nt, Artificial Sequence
  MKO10001190_A_4930402F06Rik
  gRNA
cguggcguuaaaccagucug

SEQ ID NO: 1191 - RNA, 20 nt, Artificial Sequence
  MKO10001191_A_4930402H24Rik
  gRNA
caaaagauagcgguaguuga

SEQ ID NO: 1192 - RNA, 20 nt, Artificial Sequence
  MKO10001192_A_4930402H24Rik
  gRNA
uacucaccuugggagcuaua

SEQ ID NO: 1193 - RNA, 20 nt, Artificial Sequence
  MKO10001193_A_4930402H24Rik
  gRNA
uuucuccagugugccacgua

SEQ ID NO: 1194 - RNA, 20 nt, Artificial Sequence
  MKO10001194_A_4930402K13Rik
  gRNA
gcaacaccgacacuauggua

SEQ ID NO: 1195 - RNA, 20 nt, Artificial Sequence
  MKO10001195_A_4930402K13Rik
  gRNA
uccagcauccgguuagaucu

SEQ ID NO: 1196 - RNA, 20 nt, Artificial Sequence
  MKO10001196_A_4930402K13Rik
  gRNA
accaagaucuaaccggaugc

SEQ ID NO: 1197 - RNA, 20 nt, Artificial Sequence
  MKO10001197_A_4930404A10Rik
  gRNA
cuuuacaggaccagccgagc

SEQ ID NO: 1198 - RNA, 20 nt, Artificial Sequence
  MKO10001198_A_4930404A10Rik
  gRNA
ccaucgccagaacuguucag

SEQ ID NO: 1199 - RNA, 20 nt, Artificial Sequence
  MKO10001199_A_4930404A10Rik
  gRNA
ucgaguacugagcuaguuuc

SEQ ID NO: 1200 - RNA, 20 nt, Artificial Sequence
  MKO10001200_A_4930404N11Rik
  gRNA
ucuugacacuccguaccgcg

SEQ ID NO: 1201 - RNA, 20 nt, Artificial Sequence
  MKO10001201_A_4930404N11Rik
  gRNA
cggcacauagucggaccgcc

SEQ ID NO: 1202 - RNA, 20 nt, Artificial Sequence
  MKO10001202_A_4930404N11Rik
  gRNA
agcagccgugccaacgcgug

SEQ ID NO: 1203 - RNA, 20 nt, Artificial Sequence
  MKO10001203_A_4930407I10Rik
  gRNA
ucccgguucgugcgugaucc

SEQ ID NO: 1204 - RNA, 20 nt, Artificial Sequence
  MKO10001204_A_4930407I10Rik
  gRNA
gggccucccucgacgcaucc

SEQ ID NO: 1205 - RNA, 20 nt, Artificial Sequence
  MKO10001205_A_4930407I10Rik
  gRNA
gaauggaccuaucacagcac

SEQ ID NO: 1206 - RNA, 20 nt, Artificial Sequence
  MKO10001206_A_4930412D23Rik
  gRNA
ugcgcuaaccgaauguccaa

SEQ ID NO: 1207 - RNA, 20 nt, Artificial Sequence
  MKO10001207_A_4930412D23Rik
  gRNA
auggcgaauuugguauuucg

SEQ ID NO: 1208 - RNA, 20 nt, Artificial Sequence
  MKO10001208_A_4930412D23Rik
  gRNA
ccaugaugcccucguuccuu

SEQ ID NO: 1209 - RNA, 20 nt, Artificial Sequence
  MKO10001209_A_4930415F15Rik
  gRNA
agucgaccgcuuccgucacc

SEQ ID NO: 1210 - RNA, 20 nt, Artificial Sequence
  MKO10001210_A_4930415F15Rik
  gRNA
uucaggucugcgaauauccc

SEQ ID NO: 1211 - RNA, 20 nt, Artificial Sequence
  MKO10001211_A_4930415F15Rik
  gRNA
cucucauuucuuguaguaag

SEQ ID NO: 1212 - RNA, 20 nt, Artificial Sequence
  MKO10001212_A_4930415L06Rik
  gRNA
caaaaugacguggccuagcg

SEQ ID NO: 1213 - RNA, 20 nt, Artificial Sequence
  MKO10001213_A_4930415L06Rik
  gRNA
aguaaaagucuacgucauga

SEQ ID NO: 1214 - RNA, 20 nt, Artificial Sequence
  MKO10001214_A_4930415L06Rik
  gRNA
cuuaguccgagcuuaugcaa

SEQ ID NO: 1215 - RNA, 20 nt, Artificial Sequence
  MKO10001215_A_4930415O20Rik
  gRNA
uugugggcacuucauccuuc

SEQ ID NO: 1216 - RNA, 20 nt, Artificial Sequence
  MKO10001216_A_4930415O20Rik
  gRNA
ucauuaaaagcccaaugacc

SEQ ID NO: 1217 - RNA, 20 nt, Artificial Sequence
  MKO10001217_A_4930415O20Rik
  gRNA
cccccgauuaucucagaaga

SEQ ID NO: 1218 - RNA, 20 nt, Artificial Sequence
  MKO10001218_A_4930422G04Rik
  gRNA
uaccgaugacgagccuaaag

SEQ ID NO: 1219 - RNA, 20 nt, Artificial Sequence
  MKO10001219_A_4930422G04Rik
  gRNA
guggacucgagaagguucuc

SEQ ID NO: 1220 - RNA, 20 nt, Artificial Sequence
  MKO10001220_A_4930422G04Rik
  gRNA
gcgguauuuaaucacaguug

SEQ ID NO: 1221 - RNA, 20 nt, Artificial Sequence
  MKO10001221_A_4930426D05Rik
  gRNA
aagagcucagaggcgaccga

SEQ ID NO: 1222 - RNA, 20 nt, Artificial Sequence
  MKO10001222_A_4930426D05Rik
  gRNA
caaagcggaggcgcuucaug

SEQ ID NO: 1223 - RNA, 20 nt, Artificial Sequence
  MKO10001223_A_4930426D05Rik
  gRNA
cggcgauccagaagccgcgc

SEQ ID NO: 1224 - RNA, 20 nt, Artificial Sequence
  MKO10001224_A_4930427A07Rik
  gRNA
acagauccaccuguacacgc

SEQ ID NO: 1225 - RNA, 20 nt, Artificial Sequence
  MKO10001225_A_4930427A07Rik
  gRNA
uguggcaucccugcguguac

SEQ ID NO: 1226 - RNA, 20 nt, Artificial Sequence
  MKO10001226_A_4930427A07Rik
  gRNA
cugucuuggcuccucgcccg

SEQ ID NO: 1227 - RNA, 20 nt, Artificial Sequence
  MKO10001227_A_4930428D18Rik
  gRNA
aaaccguugcaauagccaaa

SEQ ID NO: 1228 - RNA, 20 nt, Artificial Sequence
  MKO10001228_A_4930428D18Rik
  gRNA
uagagaccaguagcaauugu

SEQ ID NO: 1229 - RNA, 20 nt, Artificial Sequence
  MKO10001229_A_4930428D18Rik
  gRNA
agguaucaugguaguuguau

SEQ ID NO: 1230 - RNA, 20 nt, Artificial Sequence
  MKO10001230_A_4930430A15Rik
  gRNA
cguauauauaccuucaucag

SEQ ID NO: 1231 - RNA, 20 nt, Artificial Sequence
  MKO10001231_A_4930430A15Rik
  gRNA
gcuccuaggcuguucaaaac

SEQ ID NO: 1232 - RNA, 20 nt, Artificial Sequence
  MKO10001232_A_4930430A15Rik
  gRNA
agauauggucaaccuacuuu

SEQ ID NO: 1233 - RNA, 20 nt, Artificial Sequence
  MKO10001233_A_4930430D24Rik
  gRNA
agauagcagaagcgguugca

SEQ ID NO: 1234 - RNA, 20 nt, Artificial Sequence
  MKO10001234_A_4930430D24Rik
  gRNA
accccuaugaaguguccuac

SEQ ID NO: 1235 - RNA, 20 nt, Artificial Sequence
  MKO10001235_A_4930430D24Rik
  gRNA
cugcaaguuccucugcacca

SEQ ID NO: 1236 - RNA, 20 nt, Artificial Sequence
  MKO10001236_A_4930430F08Rik
  gRNA
gcaauauugcuggcacucgu

SEQ ID NO: 1237 - RNA, 20 nt, Artificial Sequence
  MKO10001237_A_4930430F08Rik
  gRNA
uucuaucuagucgagcccaa

SEQ ID NO: 1238 - RNA, 20 nt, Artificial Sequence
  MKO10001238_A_4930430F08Rik
  gRNA
uuacgaguuuggaauugccc

SEQ ID NO: 1239 - RNA, 20 nt, Artificial Sequence
  MKO10001239_A_4930432K09Rik
  gRNA
ccaucucugaauaucccguu

SEQ ID NO: 1240 - RNA, 20 nt, Artificial Sequence
  MKO10001240_A_4930432K09Rik
  gRNA
aucacccucguccacugaag

SEQ ID NO: 1241 - RNA, 20 nt, Artificial Sequence
  MKO10001241_A_4930432K09Rik
  gRNA
gcaggaacugcuacgggcuc

SEQ ID NO: 1242 - RNA, 20 nt, Artificial Sequence
  MKO10001242_A_4930432K21Rik
  gRNA
gcucuuugggugauccugcg

SEQ ID NO: 1243 - RNA, 20 nt, Artificial Sequence
  MKO10001243_A_4930432K21Rik
  gRNA
gcugcaacagagugcuccac

SEQ ID NO: 1244 - RNA, 20 nt, Artificial Sequence
  MKO10001244_A_4930432K21Rik
  gRNA
cggccauauagcccaagaaa

SEQ ID NO: 1245 - RNA, 20 nt, Artificial Sequence
  MKO10001245_A_4930432M17Rik
  gRNA
auaauccgucauugacaaag

SEQ ID NO: 1246 - RNA, 20 nt, Artificial Sequence
  MKO10001246_A_4930432M17Rik
  gRNA
gaaagcaugacgugaaaucc

SEQ ID NO: 1247 - RNA, 20 nt, Artificial Sequence
  MKO10001247_A_4930432M17Rik
  gRNA
ugcccccuuugauacagucu

SEQ ID NO: 1248 - RNA, 20 nt, Artificial Sequence
  MKO10001248_A_4930433I11Rik
  gRNA
uacauuagaucgcauggcac

SEQ ID NO: 1249 - RNA, 20 nt, Artificial Sequence
  MKO10001249_A_4930433I11Rik
  gRNA
cuaaagacuccacaguuguc

SEQ ID NO: 1250 - RNA, 20 nt, Artificial Sequence
  MKO10001250_A_4930433I11Rik
  gRNA
auggaaauuucccgauacua

SEQ ID NO: 1251 - RNA, 20 nt, Artificial Sequence
  MKO10001251_A_4930435E12Rik
  gRNA
uuaguguucggcucucgaug

SEQ ID NO: 1252 - RNA, 20 nt, Artificial Sequence
  MKO10001252_A_4930435E12Rik
  gRNA
ucauguugcacuucgcuaug

SEQ ID NO: 1253 - RNA, 20 nt, Artificial Sequence
  MKO10001253_A_4930435E12Rik
  gRNA
auagcgaagugcaacaugau

SEQ ID NO: 1254 - RNA, 20 nt, Artificial Sequence
  MKO10001254_A_4930444G20Rik
  gRNA
cucgggagcucuugaucucg

SEQ ID NO: 1255 - RNA, 20 nt, Artificial Sequence
  MKO10001255_A_4930444G20Rik
  gRNA
caauagcuuauuccccaaua

SEQ ID NO: 1256 - RNA, 20 nt, Artificial Sequence
  MKO10001256_A_4930444G20Rik
  gRNA
aaaaagccuauuacagaccg

SEQ ID NO: 1257 - RNA, 20 nt, Artificial Sequence
  MKO10001257_A_4930444P10Rik
  gRNA
ggaguaugacacuauucgcc

SEQ ID NO: 1258 - RNA, 20 nt, Artificial Sequence
  MKO10001258_A_4930444P10Rik
  gRNA
uuggaacccguuagcagucu

SEQ ID NO: 1259 - RNA, 20 nt, Artificial Sequence
  MKO10001259_A_4930444P10Rik
  gRNA
ugccauacugcacgacuccu

SEQ ID NO: 1260 - RNA, 20 nt, Artificial Sequence
  MKO10001260_A_4930447A16Rik
  gRNA
ucagagacgcaacaauccug

SEQ ID NO: 1261 - RNA, 20 nt, Artificial Sequence
  MKO10001261_A_4930447A16Rik
  gRNA
ugugcauccuccccaacgca

SEQ ID NO: 1262 - RNA, 20 nt, Artificial Sequence
  MKO10001262_A_4930447A16Rik
  gRNA
guaaugucugcagagugacc

SEQ ID NO: 1263 - RNA, 20 nt, Artificial Sequence
  MKO10001263_A_4930447C04Rik
  gRNA
uacuuaugucuugcucauac

SEQ ID NO: 1264 - RNA, 20 nt, Artificial Sequence
  MKO10001264_A_4930447C04Rik
  gRNA
agcuauaaacaaaguagaug

SEQ ID NO: 1265 - RNA, 20 nt, Artificial Sequence
  MKO10001265_A_4930447C04Rik
  gRNA
uuucuugguaagcaguaagc

SEQ ID NO: 1266 - RNA, 20 nt, Artificial Sequence
  MKO10001266_A_4930449I24Rik
  gRNA
guaagacacgaauaauugcc

SEQ ID NO: 1267 - RNA, 20 nt, Artificial Sequence
  MKO10001267_A_4930449I24Rik
  gRNA
cucugggaggcaggagaguc

SEQ ID NO: 1268 - RNA, 20 nt, Artificial Sequence
  MKO10001268_A_4930449I24Rik
  gRNA
ccacucacguucucaucagc

SEQ ID NO: 1269 - RNA, 20 nt, Artificial Sequence
  MKO10001269_A_4930451C15Rik
  gRNA
gugccgaagguucaauucag

SEQ ID NO: 1270 - RNA, 20 nt, Artificial Sequence
  MKO10001270_A_4930451C15Rik
  gRNA
guuccaggggguccgggcau

SEQ ID NO: 1271 - RNA, 20 nt, Artificial Sequence
  MKO10001271_A_4930451C15Rik
  gRNA
caagggcagugcagaucgcc

SEQ ID NO: 1272 - RNA, 20 nt, Artificial Sequence
  MKO10001272_A_4930451G09Rik
  gRNA
gcugaccgcugccaagacca

SEQ ID NO: 1273 - RNA, 20 nt, Artificial Sequence
  MKO10001273_A_4930451G09Rik
  gRNA
aucaaaggacuuggcccauc

SEQ ID NO: 1274 - RNA, 20 nt, Artificial Sequence
  MKO10001274_A_4930451G09Rik
  gRNA
ccugacucaucgacaccaac

SEQ ID NO: 1275 - RNA, 20 nt, Artificial Sequence
  MKO10001275_A_4930451I11Rik
  gRNA
ccuauaacguucguuaagac

SEQ ID NO: 1276 - RNA, 20 nt, Artificial Sequence
  MKO10001276_A_4930451I11Rik
  gRNA
ccugucuuaacgaacguuau

SEQ ID NO: 1277 - RNA, 20 nt, Artificial Sequence
  MKO10001277_A_4930451I11Rik
  gRNA
cgugggggguuaugaagcug

SEQ ID NO: 1278 - RNA, 20 nt, Artificial Sequence
  MKO10001278_A_4930452B06Rik
  gRNA
ugggcaguccgucugugauu

SEQ ID NO: 1279 - RNA, 20 nt, Artificial Sequence
  MKO10001279_A_4930452B06Rik
  gRNA
cggauuugcuuauucuccuu

SEQ ID NO: 1280 - RNA, 20 nt, Artificial Sequence
  MKO10001280_A_4930452B06Rik
  gRNA
caacagaauccaguuaccga

SEQ ID NO: 1281 - RNA, 20 nt, Artificial Sequence
  MKO10001281_A_4930453H23Rik
  gRNA
aauagauuagaaucacgauc

SEQ ID NO: 1282 - RNA, 20 nt, Artificial Sequence
  MKO10001282_A_4930453H23Rik
  gRNA
cuguauuauuaucacucggu

SEQ ID NO: 1283 - RNA, 20 nt, Artificial Sequence
  MKO10001283_A_4930453H23Rik
  gRNA
ggccgauugauaccuuucag

SEQ ID NO: 1284 - RNA, 20 nt, Artificial Sequence
  MKO10001284_A_4930453N24Rik
  gRNA
cgccuaccuuggcgguccac

SEQ ID NO: 1285 - RNA, 20 nt, Artificial Sequence
  MKO10001285_A_4930453N24Rik
  gRNA
auguccuccgucuuuguaac

SEQ ID NO: 1286 - RNA, 20 nt, Artificial Sequence
  MKO10001286_A_4930453N24Rik
  gRNA
ggacauccagcucuuuaagc

SEQ ID NO: 1287 - RNA, 20 nt, Artificial Sequence
  MKO10001287_A_4930467E23Rik
  gRNA
ccaauagcuaccuuaaucaa

SEQ ID NO: 1288 - RNA, 20 nt, Artificial Sequence
  MKO10001288_A_4930467E23Rik
  gRNA
ugcccacaaccauccagacg

SEQ ID NO: 1289 - RNA, 20 nt, Artificial Sequence
  MKO10001289_A_4930467E23Rik
  gRNA
caaugucuacguugugcuca

SEQ ID NO: 1290 - RNA, 20 nt, Artificial Sequence
  MKO10001290_A_4930468A15Rik
  gRNA
uuacuuaucgaucauucgca

SEQ ID NO: 1291 - RNA, 20 nt, Artificial Sequence
  MKO10001291_A_4930468A15Rik
  gRNA
gccucccucaauggcgagua

SEQ ID NO: 1292 - RNA, 20 nt, Artificial Sequence
  MKO10001292_A_4930468A15Rik
  gRNA
uugcgaugaguagcagaugu

SEQ ID NO: 1293 - RNA, 20 nt, Artificial Sequence
  MKO10001293_A_4930469G21Rik
  gRNA
ccacguugucccgucacaaa

SEQ ID NO: 1294 - RNA, 20 nt, Artificial Sequence
  MKO10001294_A_4930469G21Rik
  gRNA
aaaaauucucagacgagcuc

SEQ ID NO: 1295 - RNA, 20 nt, Artificial Sequence
  MKO10001295_A_4930469G21Rik
  gRNA
cgaauccacucuuucuaacg

SEQ ID NO: 1296 - RNA, 20 nt, Artificial Sequence
  MKO10001296_A_4930474N05Rik
  gRNA
aaaauggccacaggcguuga

SEQ ID NO: 1297 - RNA, 20 nt, Artificial Sequence
  MKO10001297_A_4930474N05Rik
  gRNA
acucuugccuucaacgccug

SEQ ID NO: 1298 - RNA, 20 nt, Artificial Sequence
  MKO10001298_A_4930474N05Rik
  gRNA
uauuuacaacguuuaaguuc

SEQ ID NO: 1299 - RNA, 20 nt, Artificial Sequence
  MKO10001299_A_4930480E11Rik
  gRNA
accagcuuccucgauuaccc

SEQ ID NO: 1300 - RNA, 20 nt, Artificial Sequence
  MKO10001300_A_4930480E11Rik
  gRNA
ucugagaauucgucauaagu

SEQ ID NO: 1301 - RNA, 20 nt, Artificial Sequence
  MKO10001301_A_4930480E11Rik
  gRNA
uagaagaccacaauacaagu

SEQ ID NO: 1302 - RNA, 20 nt, Artificial Sequence
  MKO10001302_A_4930486L24Rik
  gRNA
acgcgaggaagcccuuauga

SEQ ID NO: 1303 - RNA, 20 nt, Artificial Sequence
  MKO10001303_A_4930486L24Rik
  gRNA
uagaucccaugcaguccagc

SEQ ID NO: 1304 - RNA, 20 nt, Artificial Sequence
  MKO10001304_A_4930486L24Rik
  gRNA
aggguuauugugccucuagu

SEQ ID NO: 1305 - RNA, 20 nt, Artificial Sequence
  MKO10001305_A_4930502E18Rik
  gRNA
gugacugcguucaauccacg

SEQ ID NO: 1306 - RNA, 20 nt, Artificial Sequence
  MKO10001306_A_4930502E18Rik
  gRNA
gaccccaguacaaguauugu

SEQ ID NO: 1307 - RNA, 20 nt, Artificial Sequence
  MKO10001307_A_4930502E18Rik
  gRNA
gccagucucaacgucagcac

SEQ ID NO: 1308 - RNA, 20 nt, Artificial Sequence
  MKO10001308_A_4930503B20Rik
  gRNA
ucugaggacgacgcauuccg

SEQ ID NO: 1309 - RNA, 20 nt, Artificial Sequence
  MKO10001309_A_4930503B20Rik
  gRNA
ucccgauggaaccgaaacaa

SEQ ID NO: 1310 - RNA, 20 nt, Artificial Sequence
  MKO10001310_A_4930503B20Rik
  gRNA
auuucucgucaucaagagca

SEQ ID NO: 1311 - RNA, 20 nt, Artificial Sequence
  MKO10001311_A_4930503E14Rik
  gRNA
cacgcagauguucucuucga

SEQ ID NO: 1312 - RNA, 20 nt, Artificial Sequence
  MKO10001312_A_4930503E14Rik
  gRNA
aggcuauuucacagggagaa

SEQ ID NO: 1313 - RNA, 20 nt, Artificial Sequence
  MKO10001313_A_4930503E14Rik
  gRNA
auggcagauuccuucugccu

SEQ ID NO: 1314 - RNA, 20 nt, Artificial Sequence
  MKO10001314_A_4930503L19Rik
  gRNA
cugacguuaaguauccaauu

SEQ ID NO: 1315 - RNA, 20 nt, Artificial Sequence
  MKO10001315_A_4930503L19Rik
  gRNA
caaauuggauacuuaacguc

SEQ ID NO: 1316 - RNA, 20 nt, Artificial Sequence
  MKO10001316_A_4930503L19Rik
  gRNA
aacuugaagcagaacgaacg

SEQ ID NO: 1317 - RNA, 20 nt, Artificial Sequence
  MKO10001317_A_4930504O13Rik
  gRNA
aauuacgaugaacgagauag

SEQ ID NO: 1318 - RNA, 20 nt, Artificial Sequence
  MKO10001318_A_4930504O13Rik
  gRNA
cucguucaucguaauuuccc

SEQ ID NO: 1319 - RNA, 20 nt, Artificial Sequence
  MKO10001319_A_4930504O13Rik
  gRNA
ugcacccugccaccccgagc

SEQ ID NO: 1320 - RNA, 20 nt, Artificial Sequence
  MKO10001320_A_4930505A04Rik
  gRNA
gucacuccgcuggacacuuu

SEQ ID NO: 1321 - RNA, 20 nt, Artificial Sequence
  MKO10001321_A_4930505A04Rik
  gRNA
ugcauccggcuguguuugac

SEQ ID NO: 1322 - RNA, 20 nt, Artificial Sequence
  MKO10001322_A_4930505A04Rik
  gRNA
ggcuaugccaauaguuccua

SEQ ID NO: 1323 - RNA, 20 nt, Artificial Sequence
  MKO10001323_A_4930506M07Rik
  gRNA
aaggucuucauauucgccaa

SEQ ID NO: 1324 - RNA, 20 nt, Artificial Sequence
  MKO10001324_A_4930506M07Rik
  gRNA
ccuaccuugcuccuucaagc

SEQ ID NO: 1325 - RNA, 20 nt, Artificial Sequence
  MKO10001325_A_4930506M07Rik
  gRNA
acccgccaaaaugaacagcu

SEQ ID NO: 1326 - RNA, 20 nt, Artificial Sequence
  MKO10001326_A_4930513O06Rik
  gRNA
uugaucgucgaaugcugaca

SEQ ID NO: 1327 - RNA, 20 nt, Artificial Sequence
  MKO10001327_A_4930513O06Rik
  gRNA
uuaaccuuauucugaucucu

SEQ ID NO: 1328 - RNA, 20 nt, Artificial Sequence
  MKO10001328_A_4930513O06Rik
  gRNA
ucccaauaaaguugaaagug

SEQ ID NO: 1329 - RNA, 20 nt, Artificial Sequence
  MKO10001329_A_4930519F16Rik
  gRNA
auucuugaaaagccuaucga

SEQ ID NO: 1330 - RNA, 20 nt, Artificial Sequence
  MKO10001330_A_4930519F16Rik
  gRNA
gguauuucauccccaucgau

SEQ ID NO: 1331 - RNA, 20 nt, Artificial Sequence
  MKO10001331_A_4930519F16Rik
  gRNA
auuacccagcagucuucccg

SEQ ID NO: 1332 - RNA, 20 nt, Artificial Sequence
  MKO10001332_A_4930519G04Rik
  gRNA
cagaccgucauugggaucug

SEQ ID NO: 1333 - RNA, 20 nt, Artificial Sequence
  MKO10001333_A_4930519G04Rik
  gRNA
uaccuccaugaugacccugu

SEQ ID NO: 1334 - RNA, 20 nt, Artificial Sequence
  MKO10001334_A_4930519G04Rik
  gRNA
cccguuuguggccacccagc

SEQ ID NO: 1335 - RNA, 20 nt, Artificial Sequence
  MKO10001335_A_4930522H14Rik
  gRNA
ccguagaagaagccgaagac

SEQ ID NO: 1336 - RNA, 20 nt, Artificial Sequence
  MKO10001336_A_4930522H14Rik
  gRNA
cccgaguaaaggauucuuua

SEQ ID NO: 1337 - RNA, 20 nt, Artificial Sequence
  MKO10001337_A_4930522H14Rik
  gRNA
uagucacuuaaccuacuuua

SEQ ID NO: 1338 - RNA, 20 nt, Artificial Sequence
  MKO10001338_A_4930523C07Rik
  gRNA
auccggaucagacacgaaag

SEQ ID NO: 1339 - RNA, 20 nt, Artificial Sequence
  MKO10001339_A_4930523C07Rik
  gRNA
gcucacuagacaagcaguga

SEQ ID NO: 1340 - RNA, 20 nt, Artificial Sequence
  MKO10001340_A_4930523C07Rik
  gRNA
cgucuucaacacagucugcc

SEQ ID NO: 1341 - RNA, 20 nt, Artificial Sequence
  MKO10001341_A_4930524B15Rik
  gRNA
cgggucacguagauuaagcg

SEQ ID NO: 1342 - RNA, 20 nt, Artificial Sequence
  MKO10001342_A_4930524B15Rik
  gRNA
auuccgccccuuuccagcgg

SEQ ID NO: 1343 - RNA, 20 nt, Artificial Sequence
  MKO10001343_A_4930524B15Rik
  gRNA
ugaagccuccaagcuaauga

SEQ ID NO: 1344 - RNA, 20 nt, Artificial Sequence
  MKO10001344_A_4930524N10Rik
  gRNA
acagcccuauaaacucgacc

SEQ ID NO: 1345 - RNA, 20 nt, Artificial Sequence
  MKO10001345_A_4930524N10Rik
  gRNA
auuguccaggucgaguuuau

SEQ ID NO: 1346 - RNA, 20 nt, Artificial Sequence
  MKO10001346_A_4930524N10Rik
  gRNA
gcuauacccucaacacuaaa

SEQ ID NO: 1347 - RNA, 20 nt, Artificial Sequence
  MKO10001347_A_4930525M21Rik
  gRNA
agauagcagaaucagcuuua

SEQ ID NO: 1348 - RNA, 20 nt, Artificial Sequence
  MKO10001348_A_4930525M21Rik
  gRNA
uucuaaaaacuacaauauga

SEQ ID NO: 1349 - RNA, 20 nt, Artificial Sequence
  MKO10001349_A_4930525M21Rik
  gRNA
aucccuaugaaguguccuac

SEQ ID NO: 1350 - RNA, 20 nt, Artificial Sequence
  MKO10001350_A_4930526D03Rik
  gRNA
uucggguguagcgcaaccgc

SEQ ID NO: 1351 - RNA, 20 nt, Artificial Sequence
  MKO10001351_A_4930526D03Rik
  gRNA
gcgcgggucaggcaugucgu

SEQ ID NO: 1352 - RNA, 20 nt, Artificial Sequence
  MKO10001352_A_4930526D03Rik
  gRNA
cgcgcgcgcugccauccgac

SEQ ID NO: 1353 - RNA, 20 nt, Artificial Sequence
  MKO10001353_A_4930529M08Rik
  gRNA
caacuggaacgucgccaagc

SEQ ID NO: 1354 - RNA, 20 nt, Artificial Sequence
  MKO10001354_A_4930529M08Rik
  gRNA
cugcuuggcgacguuccagu

SEQ ID NO: 1355 - RNA, 20 nt, Artificial Sequence
  MKO10001355_A_4930529M08Rik
  gRNA
agcugcauauucgcaaagcc

SEQ ID NO: 1356 - RNA, 20 nt, Artificial Sequence
  MKO10001356_A_4930538K18Rik
  gRNA
gcguggaugggccucugaau

SEQ ID NO: 1357 - RNA, 20 nt, Artificial Sequence
  MKO10001357_A_4930538K18Rik
  gRNA
ggguaggcccuuguauccag

SEQ ID NO: 1358 - RNA, 20 nt, Artificial Sequence
  MKO10001358_A_4930538K18Rik
  gRNA
cuagacucacccaguuugug

SEQ ID NO: 1359 - RNA, 20 nt, Artificial Sequence
  MKO10001359_A_4930539E08Rik
  gRNA
uaucucauggggggcgcuug

SEQ ID NO: 1360 - RNA, 20 nt, Artificial Sequence
  MKO10001360_A_4930539E08Rik
  gRNA
uagcccgguggagaccccga

SEQ ID NO: 1361 - RNA, 20 nt, Artificial Sequence
  MKO10001361_A_4930539E08Rik
  gRNA
cucgcuggcuacuaacacac

SEQ ID NO: 1362 - RNA, 20 nt, Artificial Sequence
  MKO10001362_A_4930544D05Rik
  gRNA
ggccgcagcucacgaauauc

SEQ ID NO: 1363 - RNA, 20 nt, Artificial Sequence
  MKO10001363_A_4930544D05Rik
  gRNA
caauguagaucucggcccug

SEQ ID NO: 1364 - RNA, 20 nt, Artificial Sequence
  MKO10001364_A_4930544D05Rik
  gRNA
cgacaagucgcccacccaga

SEQ ID NO: 1365 - RNA, 20 nt, Artificial Sequence
  MKO10001365_A_4930544G11Rik
  gRNA
caaugcuguucgccaacccu

SEQ ID NO: 1366 - RNA, 20 nt, Artificial Sequence
  MKO10001366_A_4930544G11Rik
  gRNA
cgauacaagaguuagccaag

SEQ ID NO: 1367 - RNA, 20 nt, Artificial Sequence
  MKO10001367_A_4930544G11Rik
  gRNA
caaggguuggcgaacagcau

SEQ ID NO: 1368 - RNA, 20 nt, Artificial Sequence
  MKO10001368_A_4930547C10Rik
  gRNA
aucagucggugcaggcuacu

SEQ ID NO: 1369 - RNA, 20 nt, Artificial Sequence
  MKO10001369_A_4930547C10Rik
  gRNA
cuucacguuucucgcuucag

SEQ ID NO: 1370 - RNA, 20 nt, Artificial Sequence
  MKO10001370_A_4930547C10Rik
  gRNA
guacuacuaauucacugaau

SEQ ID NO: 1371 - RNA, 20 nt, Artificial Sequence
  MKO10001371_A_4930548H24Rik
  gRNA
gcaaauucagucgaccugcu

SEQ ID NO: 1372 - RNA, 20 nt, Artificial Sequence
  MKO10001372_A_4930548H24Rik
  gRNA
acucuaguuuguaguacucc

SEQ ID NO: 1373 - RNA, 20 nt, Artificial Sequence
  MKO10001373_A_4930548H24Rik
  gRNA
ggaccuauugaagcuaaucc

SEQ ID NO: 1374 - RNA, 20 nt, Artificial Sequence
  MKO10001374_A_4930549C01Rik
  gRNA
auaaaauaaaucgccgccgg

SEQ ID NO: 1375 - RNA, 20 nt, Artificial Sequence
  MKO10001375_A_4930549C01Rik
  gRNA
aaaaucagguguucgucaua

SEQ ID NO: 1376 - RNA, 20 nt, Artificial Sequence
  MKO10001376_A_4930549C01Rik
  gRNA
aaagcuuaucaaccaagcca

SEQ ID NO: 1377 - RNA, 20 nt, Artificial Sequence
  MKO10001377_A_4930550C14Rik
  gRNA
cguccaaguccgauucaggu

SEQ ID NO: 1378 - RNA, 20 nt, Artificial Sequence
  MKO10001378_A_4930550C14Rik
  gRNA
auguaccucacuaucugacg

SEQ ID NO: 1379 - RNA, 20 nt, Artificial Sequence
  MKO10001379_A_4930550C14Rik
  gRNA
uccaccacuccgcuuucaag

SEQ ID NO: 1380 - RNA, 20 nt, Artificial Sequence
  MKO10001380_A_4930550L24Rik
  gRNA
cuuugcuugaugcagacgcu

SEQ ID NO: 1381 - RNA, 20 nt, Artificial Sequence
  MKO10001381_A_4930550L24Rik
  gRNA
auugcugauccgcccaucau

SEQ ID NO: 1382 - RNA, 20 nt, Artificial Sequence
  MKO10001382_A_4930550L24Rik
  gRNA
uuccuucaccgcuuuguaua

SEQ ID NO: 1383 - RNA, 20 nt, Artificial Sequence
  MKO10001383_A_4930555G01Rik
  gRNA
uggguugaaguauuucuagc

SEQ ID NO: 1384 - RNA, 20 nt, Artificial Sequence
  MKO10001384_A_4930555G01Rik
  gRNA
ccucauacauguaaacauuc

SEQ ID NO: 1385 - RNA, 20 nt, Artificial Sequence
  MKO10001385_A_4930555G01Rik
  gRNA
guuaucuucuaucaguucca

SEQ ID NO: 1386 - RNA, 20 nt, Artificial Sequence
  MKO10001386_A_4930557A04Rik
  gRNA
cucuaugaggcaccaagacc

SEQ ID NO: 1387 - RNA, 20 nt, Artificial Sequence
  MKO10001387_A_4930557A04Rik
  gRNA
cguagaagaguucaggcauu

SEQ ID NO: 1388 - RNA, 20 nt, Artificial Sequence
  MKO10001388_A_4930557A04Rik
  gRNA
aguucaucgauguuaucagu

SEQ ID NO: 1389 - RNA, 20 nt, Artificial Sequence
  MKO10001389_A_4930558K02Rik
  gRNA
caacugugcgcuacaugucg

SEQ ID NO: 1390 - RNA, 20 nt, Artificial Sequence
  MKO10001390_A_4930558K02Rik
  gRNA
uguucugacuucguacaaga

SEQ ID NO: 1391 - RNA, 20 nt, Artificial Sequence
  MKO10001391_A_4930558K02Rik
  gRNA
caaugguuuguuuaccaggc

SEQ ID NO: 1392 - RNA, 20 nt, Artificial Sequence
  MKO10001392_A_4930562C15Rik
  gRNA
ggccccggaaccacgccgua

SEQ ID NO: 1393 - RNA, 20 nt, Artificial Sequence
  MKO10001393_A_4930562C15Rik
  gRNA
uuccaacacacccuucgaug

SEQ ID NO: 1394 - RNA, 20 nt, Artificial Sequence
  MKO10001394_A_4930562C15Rik
  gRNA
agcuuaccacuucccgcugc

SEQ ID NO: 1395 - RNA, 20 nt, Artificial Sequence
  MKO10001395_A_4930563D23Rik
  gRNA
ccauaaccaacaaggugcgc

SEQ ID NO: 1396 - RNA, 20 nt, Artificial Sequence
  MKO10001396_A_4930563D23Rik
  gRNA
cugagaucgcugcaacacaa

SEQ ID NO: 1397 - RNA, 20 nt, Artificial Sequence
  MKO10001397_A_4930563D23Rik
  gRNA
cuacacgcugggggcaguca

SEQ ID NO: 1398 - RNA, 20 nt, Artificial Sequence
  MKO10001398_A_4930563E22Rik
  gRNA
cugcgcgcgcagauaucgag

SEQ ID NO: 1399 - RNA, 20 nt, Artificial Sequence
  MKO10001399_A_4930563E22Rik
  gRNA
aaacguccucccgccacguc

SEQ ID NO: 1400 - RNA, 20 nt, Artificial Sequence
  MKO10001400_A_4930563E22Rik
  gRNA
uccccgcagaaugggggcgc

SEQ ID NO: 1401 - RNA, 20 nt, Artificial Sequence
  MKO10001401_A_4930564B18Rik
  gRNA
agggacucccauccgucgac

SEQ ID NO: 1402 - RNA, 20 nt, Artificial Sequence
  MKO10001402_A_4930564B18Rik
  gRNA
cuuacccgacuuagucuugu

SEQ ID NO: 1403 - RNA, 20 nt, Artificial Sequence
  MKO10001403_A_4930564B18Rik
  gRNA
gaugccgaggaugagucuau

SEQ ID NO: 1404 - RNA, 20 nt, Artificial Sequence
  MKO10001404_A_4930564C03Rik
  gRNA
caaaagguaaugcgagucca

SEQ ID NO: 1405 - RNA, 20 nt, Artificial Sequence
  MKO10001405_A_4930564C03Rik
  gRNA
ucaucucuuucuucacucga

SEQ ID NO: 1406 - RNA, 20 nt, Artificial Sequence
  MKO10001406_A_4930564C03Rik
  gRNA
cguacaugacuucucaaaaa

SEQ ID NO: 1407 - RNA, 20 nt, Artificial Sequence
  MKO10001407_A_4930564D02Rik
  gRNA
ccaagagucagccgcugcuu

SEQ ID NO: 1408 - RNA, 20 nt, Artificial Sequence
  MKO10001408_A_4930564D02Rik
  gRNA
accuuagaacugcaagcuug

SEQ ID NO: 1409 - RNA, 20 nt, Artificial Sequence
  MKO10001409_A_4930564D02Rik
  gRNA
aagacaaauggauaagaaga

SEQ ID NO: 1410 - RNA, 20 nt, Artificial Sequence
  MKO10001410_A_4930567H17Rik
  gRNA
augagcgcaccagccacuca

SEQ ID NO: 1411 - RNA, 20 nt, Artificial Sequence
  MKO10001411_A_4930567H17Rik
  gRNA
gcuuucaggauguaucugca

SEQ ID NO: 1412 - RNA, 20 nt, Artificial Sequence
  MKO10001412_A_4930567H17Rik
  gRNA
cugcacaauccagaauagac

SEQ ID NO: 1413 - RNA, 20 nt, Artificial Sequence
  MKO10001413_A_4930568D16Rik
  gRNA
cagacuuuaugaagcgucuc

SEQ ID NO: 1414 - RNA, 20 nt, Artificial Sequence
  MKO10001414_A_4930568D16Rik
  gRNA
caaucuaccauacuuugagu

SEQ ID NO: 1415 - RNA, 20 nt, Artificial Sequence
  MKO10001415_A_4930568D16Rik
  gRNA
uaaguuccuucccauaagac

SEQ ID NO: 1416 - RNA, 20 nt, Artificial Sequence
  MKO10001416_A_4930571K23Rik
  gRNA
ucagcccauucaagauccga

SEQ ID NO: 1417 - RNA, 20 nt, Artificial Sequence
  MKO10001417_A_4930571K23Rik
  gRNA
guccuugcugcacuccccgu

SEQ ID NO: 1418 - RNA, 20 nt, Artificial Sequence
  MKO10001418_A_4930571K23Rik
  gRNA
agccgacggggagugcagca

SEQ ID NO: 1419 - RNA, 20 nt, Artificial Sequence
  MKO10001419_A_4930578C19Rik
  gRNA
cagcauagcgucgaaccaca

SEQ ID NO: 1420 - RNA, 20 nt, Artificial Sequence
  MKO10001420_A_4930578C19Rik
  gRNA
gucgaugaugccuagcgcac

SEQ ID NO: 1421 - RNA, 20 nt, Artificial Sequence
  MKO10001421_A_4930578C19Rik
  gRNA
ccgcagguuugacaacucac

SEQ ID NO: 1422 - RNA, 20 nt, Artificial Sequence
  MKO10001422_A_4930578I06Rik
  gRNA
ugcgcgccagagcauacugc

SEQ ID NO: 1423 - RNA, 20 nt, Artificial Sequence
  MKO10001423_A_4930578I06Rik
  gRNA
accugcggaggcuccugaac

SEQ ID NO: 1424 - RNA, 20 nt, Artificial Sequence
  MKO10001424_A_4930578I06Rik
  gRNA
uuugcucaugagcgacuguc

SEQ ID NO: 1425 - RNA, 20 nt, Artificial Sequence
  MKO10001425_A_4930579F01Rik
  gRNA
ucuguugcucaucgcgucug

SEQ ID NO: 1426 - RNA, 20 nt, Artificial Sequence
  MKO10001426_A_4930579F01Rik
  gRNA
accaguuuagcccuuccgag

SEQ ID NO: 1427 - RNA, 20 nt, Artificial Sequence
  MKO10001427_A_4930579F01Rik
  gRNA
cgugcacauucccaacuacc

SEQ ID NO: 1428 - RNA, 20 nt, Artificial Sequence
  MKO10001428_A_4930579G24Rik
  gRNA
caugcugagggacgacgaag

SEQ ID NO: 1429 - RNA, 20 nt, Artificial Sequence
  MKO10001429_A_4930579G24Rik
  gRNA
uugagcugauaccgcagacg

SEQ ID NO: 1430 - RNA, 20 nt, Artificial Sequence
  MKO10001430_A_4930579G24Rik
  gRNA
ccucccucaucuccgucguc

SEQ ID NO: 1431 - RNA, 20 nt, Artificial Sequence
  MKO10001431_A_4930590J08Rik
  gRNA
cgccucagcccguccgagcc

SEQ ID NO: 1432 - RNA, 20 nt, Artificial Sequence
  MKO10001432_A_4930590J08Rik
  gRNA
gagacaucauccacgggcuu

SEQ ID NO: 1433 - RNA, 20 nt, Artificial Sequence
  MKO10001433_A_4930590J08Rik
  gRNA
uucagcaggugccaauccuu

SEQ ID NO: 1434 - RNA, 20 nt, Artificial Sequence
  MKO10001434_A_4930591A17Rik
  gRNA
acccgcuagggccucaacgc

SEQ ID NO: 1435 - RNA, 20 nt, Artificial Sequence
  MKO10001435_A_4930591A17Rik
  gRNA
ucacucgccacccguguucc

SEQ ID NO: 1436 - RNA, 20 nt, Artificial Sequence
  MKO10001436_A_4930591A17Rik
  gRNA
ucacgagucacaauuccugc

SEQ ID NO: 1437 - RNA, 20 nt, Artificial Sequence
  MKO10001437_A_4930595M18Rik
  gRNA
ugcucaacccgauuguagcu

SEQ ID NO: 1438 - RNA, 20 nt, Artificial Sequence
  MKO10001438_A_4930595M18Rik
  gRNA
gucuuucgcauucgcucuga

SEQ ID NO: 1439 - RNA, 20 nt, Artificial Sequence
  MKO10001439_A_4930595M18Rik
  gRNA
auuauauguuugcgacaaau

SEQ ID NO: 1440 - RNA, 20 nt, Artificial Sequence
  MKO10001440_A_4930596D02Rik
  gRNA
cggacauuaagauccgaauc

SEQ ID NO: 1441 - RNA, 20 nt, Artificial Sequence
  MKO10001441_A_4930596D02Rik
  gRNA
uauccgccccagaagaucca

SEQ ID NO: 1442 - RNA, 20 nt, Artificial Sequence
  MKO10001442_A_4930596D02Rik
  gRNA
gagcaugaacaugccagauu

SEQ ID NO: 1443 - RNA, 20 nt, Artificial Sequence
  MKO10001443_A_4931406B18Rik
  gRNA
gaggaauaaagccgacgcua

SEQ ID NO: 1444 - RNA, 20 nt, Artificial Sequence
  MKO10001444_A_4931406B18Rik
  gRNA
cgaagucuccuaaugauuuc

SEQ ID NO: 1445 - RNA, 20 nt, Artificial Sequence
  MKO10001445_A_4931406B18Rik
  gRNA
augguacagcucaaagucac

SEQ ID NO: 1446 - RNA, 20 nt, Artificial Sequence
  MKO10001446_A_4931406C07Rik
  gRNA
cagguccauuucagacgcuu

SEQ ID NO: 1447 - RNA, 20 nt, Artificial Sequence
  MKO10001447_A_4931406C07Rik
  gRNA
uugaacccaagcgucugaaa

SEQ ID NO: 1448 - RNA, 20 nt, Artificial Sequence
  MKO10001448_A_4931406C07Rik
  gRNA
gaacacaaccaaccugugaa

SEQ ID NO: 1449 - RNA, 20 nt, Artificial Sequence
  MKO10001449_A_4931406P16Rik
  gRNA
aagugcgauccuaucugcac

SEQ ID NO: 1450 - RNA, 20 nt, Artificial Sequence
  MKO10001450_A_4931406P16Rik
  gRNA
gaagcugugcgauccuggcg

SEQ ID NO: 1451 - RNA, 20 nt, Artificial Sequence
  MKO10001451_A_4931406P16Rik
  gRNA
gauaggaucgcacuuccuga

SEQ ID NO: 1452 - RNA, 20 nt, Artificial Sequence
  MKO10001452_A_4931408C20Rik
  gRNA
uucuucgaggaacuuauagc

SEQ ID NO: 1453 - RNA, 20 nt, Artificial Sequence
  MKO10001453_A_4931408C20Rik
  gRNA
gaaauuccccgaccaguuac

SEQ ID NO: 1454 - RNA, 20 nt, Artificial Sequence
  MKO10001454_A_4931408C20Rik
  gRNA
cugcuccauguccauaguag

SEQ ID NO: 1455 - RNA, 20 nt, Artificial Sequence
  MKO10001455_A_4931409K22Rik
  gRNA
gcaccucuucgagagucacg

SEQ ID NO: 1456 - RNA, 20 nt, Artificial Sequence
  MKO10001456_A_4931409K22Rik
  gRNA
cgcagcaaccgacgcuucug

SEQ ID NO: 1457 - RNA, 20 nt, Artificial Sequence
  MKO10001457_A_4931409K22Rik
  gRNA
ccacuuucaugcgagaaauc

SEQ ID NO: 1458 - RNA, 20 nt, Artificial Sequence
  MKO10001458_A_4931414P19Rik
  gRNA
aacuucgaagucgccgauac

SEQ ID NO: 1459 - RNA, 20 nt, Artificial Sequence
  MKO10001459_A_4931414P19Rik
  gRNA
ggguucaauacaacgagugc

SEQ ID NO: 1460 - RNA, 20 nt, Artificial Sequence
  MKO10001460_A_4931414P19Rik
  gRNA
caccagaucucgcuuccgcc

SEQ ID NO: 1461 - RNA, 20 nt, Artificial Sequence
  MKO10001461_A_4931417E11Rik
  gRNA
gcaucagcacccgacaugag

SEQ ID NO: 1462 - RNA, 20 nt, Artificial Sequence
  MKO10001462_A_4931417E11Rik
  gRNA
ccuucgaugauuauccguga

SEQ ID NO: 1463 - RNA, 20 nt, Artificial Sequence
  MKO10001463_A_4931417E11Rik
  gRNA
uugacacguauaggugccac

SEQ ID NO: 1464 - RNA, 20 nt, Artificial Sequence
  MKO10001464_A_4931423N10Rik
  gRNA
uaacaucacaccccugauga

SEQ ID NO: 1465 - RNA, 20 nt, Artificial Sequence
  MKO10001465_A_4931423N10Rik
  gRNA
cuaugguauaccuucaucag

SEQ ID NO: 1466 - RNA, 20 nt, Artificial Sequence
  MKO10001466_A_4931423N10Rik
  gRNA
gcuuuacguuaugcuauuga

SEQ ID NO: 1467 - RNA, 20 nt, Artificial Sequence
  MKO10001467_A_4931428F04Rik
  gRNA
uacugcguccgugccaagcg

SEQ ID NO: 1468 - RNA, 20 nt, Artificial Sequence
  MKO10001468_A_4931428F04Rik
  gRNA
ugaauaauucgcggcaaccg

SEQ ID NO: 1469 - RNA, 20 nt, Artificial Sequence
  MKO10001469_A_4931428F04Rik
  gRNA
ggagaacagccgacccacac

SEQ ID NO: 1470 - RNA, 20 nt, Artificial Sequence
  MKO10001470_A_4931429I11Rik
  gRNA
accuccgauaugaucccaac

SEQ ID NO: 1471 - RNA, 20 nt, Artificial Sequence
  MKO10001471_A_4931429I11Rik
  gRNA
cgcuucuaaccccaauuuac

SEQ ID NO: 1472 - RNA, 20 nt, Artificial Sequence
  MKO10001472_A_4931429I11Rik
  gRNA
gaagauggcccguaguaauu

SEQ ID NO: 1473 - RNA, 20 nt, Artificial Sequence
  MKO10001473_A_4931429L15Rik
  gRNA
cuggaccgugacaaacccug

SEQ ID NO: 1474 - RNA, 20 nt, Artificial Sequence
  MKO10001474_A_4931429L15Rik
  gRNA
uugcugaauggcaucccccc

SEQ ID NO: 1475 - RNA, 20 nt, Artificial Sequence
  MKO10001475_A_4931429L15Rik
  gRNA
aggacacccaaguccuagug

SEQ ID NO: 1476 - RNA, 20 nt, Artificial Sequence
  MKO10001476_A_4931431F19Rik
  gRNA
ucagaagcccgcgcaaucgc

SEQ ID NO: 1477 - RNA, 20 nt, Artificial Sequence
  MKO10001477_A_4931431F19Rik
  gRNA
caccaacccucgagcgcugc

SEQ ID NO: 1478 - RNA, 20 nt, Artificial Sequence
  MKO10001478_A_4931431F19Rik
  gRNA
ucaguaugucuugaucccgg

SEQ ID NO: 1479 - RNA, 20 nt, Artificial Sequence
  MKO10001479_A_4931440F15Rik
  gRNA
gggcgucuucccgucacugc

SEQ ID NO: 1480 - RNA, 20 nt, Artificial Sequence
  MKO10001480_A_4931440F15Rik
  gRNA
ccuggacguggugcgcugcc

SEQ ID NO: 1481 - RNA, 20 nt, Artificial Sequence
  MKO10001481_A_4931440F15Rik
  gRNA
gugaagccguucuugccacg

SEQ ID NO: 1482 - RNA, 20 nt, Artificial Sequence
  MKO10001482_A_4931440L10Rik
  gRNA
agcccaccuucgagcgaaug

SEQ ID NO: 1483 - RNA, 20 nt, Artificial Sequence
  MKO10001483_A_4931440L10Rik
  gRNA
ugucaaccacauucgcucga

SEQ ID NO: 1484 - RNA, 20 nt, Artificial Sequence
  MKO10001484_A_4931440L10Rik
  gRNA
uuugcuugucacgcuucuca

SEQ ID NO: 1485 - RNA, 20 nt, Artificial Sequence
  MKO10001485_A_4932411E22Rik
  gRNA
cccuauuccgacacacucgc

SEQ ID NO: 1486 - RNA, 20 nt, Artificial Sequence
  MKO10001486_A_4932411E22Rik
  gRNA
cagcgccccagauguccuac

SEQ ID NO: 1487 - RNA, 20 nt, Artificial Sequence
  MKO10001487_A_4932411E22Rik
  gRNA
cccuucaucaugccgcucuc

SEQ ID NO: 1488 - RNA, 20 nt, Artificial Sequence
  MKO10001488_A_4932411N23Rik
  gRNA
caccggucuuugaccgaaga

SEQ ID NO: 1489 - RNA, 20 nt, Artificial Sequence
  MKO10001489_A_4932411N23Rik
  gRNA
ccgaugaaagugaaauucgc

SEQ ID NO: 1490 - RNA, 20 nt, Artificial Sequence
  MKO10001490_A_4932411N23Rik
  gRNA
ccuuacuugugaaccaugcu

SEQ ID NO: 1491 - RNA, 20 nt, Artificial Sequence
  MKO10001491_A_4932414N04Rik
  gRNA
agcggccauaccccacaucg

SEQ ID NO: 1492 - RNA, 20 nt, Artificial Sequence
  MKO10001492_A_4932414N04Rik
  gRNA
uauaugaaugaaccgcaucc

SEQ ID NO: 1493 - RNA, 20 nt, Artificial Sequence
  MKO10001493_A_4932414N04Rik
  gRNA
uuuacaggcucuaaaguacg

SEQ ID NO: 1494 - RNA, 20 nt, Artificial Sequence
  MKO10001494_A_4932416K20Rik
  gRNA
uccaucgccacaucgaccuc

SEQ ID NO: 1495 - RNA, 20 nt, Artificial Sequence
  MKO10001495_A_4932416K20Rik
  gRNA
guggcgauggacgaagcacg

SEQ ID NO: 1496 - RNA, 20 nt, Artificial Sequence
  MKO10001496_A_4932416K20Rik
  gRNA
guccccugcuauacuagcuu

SEQ ID NO: 1497 - RNA, 20 nt, Artificial Sequence
  MKO10001497_A_4932418E24Rik
  gRNA
cuuccgccauagcaucgucg

SEQ ID NO: 1498 - RNA, 20 nt, Artificial Sequence
  MKO10001498_A_4932418E24Rik
  gRNA
acaaaaccucgacgaugcua

SEQ ID NO: 1499 - RNA, 20 nt, Artificial Sequence
  MKO10001499_A_4932418E24Rik
  gRNA
cugacgcaugaagucacgua

SEQ ID NO: 1500 - RNA, 20 nt, Artificial Sequence
  MKO10001500_A_4932429P05Rik
  gRNA
cuggagccgcucaauguauu

SEQ ID NO: 1501 - RNA, 20 nt, Artificial Sequence
  MKO10001501_A_4932429P05Rik
  gRNA
cuuaguccgagaguaucuac

SEQ ID NO: 1502 - RNA, 20 nt, Artificial Sequence
  MKO10001502_A_4932429P05Rik
  gRNA
gugcccuaucacaaacaacg

SEQ ID NO: 1503 - RNA, 20 nt, Artificial Sequence
  MKO10001503_A_4932438A13Rik
  gRNA
ggacgccuucaagaauuguu

SEQ ID NO: 1504 - RNA, 20 nt, Artificial Sequence
  MKO10001504_A_4932438A13Rik
  gRNA
gaacgcaguccaaaauugaa

SEQ ID NO: 1505 - RNA, 20 nt, Artificial Sequence
  MKO10001505_A_4932438A13Rik
  gRNA
aucuuacauacuacaauucu

SEQ ID NO: 1506 - RNA, 20 nt, Artificial Sequence
  MKO10001506_A_4932438H23Rik
  gRNA
gggcaacgaugccuagcgcu

SEQ ID NO: 1507 - RNA, 20 nt, Artificial Sequence
  MKO10001507_A_4932438H23Rik
  gRNA
ccagagugaacuucagcacg

SEQ ID NO: 1508 - RNA, 20 nt, Artificial Sequence
  MKO10001508_A_4932438H23Rik
  gRNA
gaggcuucgcauccauacua

SEQ ID NO: 1509 - RNA, 20 nt, Artificial Sequence
  MKO10001509_A_4932443I19Rik
  gRNA
ugaccaccccgugggcuaau

SEQ ID NO: 1510 - RNA, 20 nt, Artificial Sequence
  MKO10001510_A_4932443I19Rik
  gRNA
uagcccacgggguggucagc

SEQ ID NO: 1511 - RNA, 20 nt, Artificial Sequence
  MKO10001511_A_4932443I19Rik
  gRNA
uggccuccgccaugaaaacc

SEQ ID NO: 1512 - RNA, 20 nt, Artificial Sequence
  MKO10001512_A_4933402D24Rik
  gRNA
ugccgagucauucugaccaa

SEQ ID NO: 1513 - RNA, 20 nt, Artificial Sequence
  MKO10001513_A_4933402D24Rik
  gRNA
acugucagcccgcucucaga

SEQ ID NO: 1514 - RNA, 20 nt, Artificial Sequence
  MKO10001514_A_4933402D24Rik
  gRNA
gugcgcucaccuucugagag

SEQ ID NO: 1515 - RNA, 20 nt, Artificial Sequence
  MKO10001515_A_4933402E13Rik
  gRNA
cgcucgacaaaccacgcauu

SEQ ID NO: 1516 - RNA, 20 nt, Artificial Sequence
  MKO10001516_A_4933402E13Rik
  gRNA
auacgcugagugacagcgau

SEQ ID NO: 1517 - RNA, 20 nt, Artificial Sequence
  MKO10001517_A_4933402E13Rik
  gRNA
ucaucgucaucaguuuccgu

SEQ ID NO: 1518 - RNA, 20 nt, Artificial Sequence
  MKO10001518_A_4933402J07Rik
  gRNA
cguacguccugucaagaaga

SEQ ID NO: 1519 - RNA, 20 nt, Artificial Sequence
  MKO10001519_A_4933402J07Rik
  gRNA
gaaagcgcuuacccgacugu

SEQ ID NO: 1520 - RNA, 20 nt, Artificial Sequence
  MKO10001520_A_4933402J07Rik
  gRNA
gauccaugcccuucuccaua

SEQ ID NO: 1521 - RNA, 20 nt, Artificial Sequence
  MKO10001521_A_4933402N03Rik
  gRNA
guuccaaacgccgcaccgag

SEQ ID NO: 1522 - RNA, 20 nt, Artificial Sequence
  MKO10001522_A_4933402N03Rik
  gRNA
cuccccuuucuccccccgau

SEQ ID NO: 1523 - RNA, 20 nt, Artificial Sequence
  MKO10001523_A_4933402N03Rik
  gRNA
gccggagcaugauuaaggag

SEQ ID NO: 1524 - RNA, 20 nt, Artificial Sequence
  MKO10001524_A_4933402N22Rik
  gRNA
ccuacauagccagcuccuga

SEQ ID NO: 1525 - RNA, 20 nt, Artificial Sequence
  MKO10001525_A_4933402N22Rik
  gRNA
aaaagaguuccaauuacaau

SEQ ID NO: 1526 - RNA, 20 nt, Artificial Sequence
  MKO10001526_A_4933402N22Rik
  gRNA
cagugcauaccuauuguaau

SEQ ID NO: 1527 - RNA, 20 nt, Artificial Sequence
  MKO10001527_A_4933402P03Rik
  gRNA
ccgcuugccuaagcgaguag

SEQ ID NO: 1528 - RNA, 20 nt, Artificial Sequence
  MKO10001528_A_4933402P03Rik
  gRNA
accagcagagacuucgcaac

SEQ ID NO: 1529 - RNA, 20 nt, Artificial Sequence
  MKO10001529_A_4933402P03Rik
  gRNA
gguauugcucgcagcaccuc

SEQ ID NO: 1530 - RNA, 20 nt, Artificial Sequence
  MKO10001530_A_4933403O08Rik
  gRNA
ggcaccgcaauacuuguugc

SEQ ID NO: 1531 - RNA, 20 nt, Artificial Sequence
  MKO10001531_A_4933403O08Rik
  gRNA
gauaauucugcacgucccag

SEQ ID NO: 1532 - RNA, 20 nt, Artificial Sequence
  MKO10001532_A_4933403O08Rik
  gRNA
agcuucuacuacguugccuu

SEQ ID NO: 1533 - RNA, 20 nt, Artificial Sequence
  MKO10001533_A_4933405L10Rik
  gRNA
cccgccacucuugcguuucu

SEQ ID NO: 1534 - RNA, 20 nt, Artificial Sequence
  MKO10001534_A_4933405L10Rik
  gRNA
cgcacccgccgccgagaccu

SEQ ID NO: 1535 - RNA, 20 nt, Artificial Sequence
  MKO10001535_A_4933405L10Rik
  gRNA
gguggauaagacgacgcaag

SEQ ID NO: 1536 - RNA, 20 nt, Artificial Sequence
  MKO10001536_A_4933405O20Rik
  gRNA
caccucgacaucuaaugaag

SEQ ID NO: 1537 - RNA, 20 nt, Artificial Sequence
  MKO10001537_A_4933405O20Rik
  gRNA
gcugaccagcuguaucaugc

SEQ ID NO: 1538 - RNA, 20 nt, Artificial Sequence
  MKO10001538_A_4933405O20Rik
  gRNA
uauugcccuucagagcgaca

SEQ ID NO: 1539 - RNA, 20 nt, Artificial Sequence
  MKO10001539_A_4933406J08Rik
  gRNA
ccucgcacccugacacgcug

SEQ ID NO: 1540 - RNA, 20 nt, Artificial Sequence
  MKO10001540_A_4933406J08Rik
  gRNA
gcgaggcaucacagcuaaac

SEQ ID NO: 1541 - RNA, 20 nt, Artificial Sequence
  MKO10001541_A_4933406J08Rik
  gRNA
agcuauugcagcaagauagu

SEQ ID NO: 1542 - RNA, 20 nt, Artificial Sequence
  MKO10001542_A_4933406M09Rik
  gRNA
caucucaugacuaccccguc

SEQ ID NO: 1543 - RNA, 20 nt, Artificial Sequence
  MKO10001543_A_4933406M09Rik
  gRNA
cuuuccggagagcggcaugc

SEQ ID NO: 1544 - RNA, 20 nt, Artificial Sequence
  MKO10001544_A_4933406M09Rik
  gRNA
guggaugugcguccgagucc

SEQ ID NO: 1545 - RNA, 20 nt, Artificial Sequence
  MKO10001545_A_4933408B17Rik
  gRNA
uggacuuaacgacccugaag

SEQ ID NO: 1546 - RNA, 20 nt, Artificial Sequence
  MKO10001546_A_4933408B17Rik
  gRNA
ccgaguucaggaagcucccc

SEQ ID NO: 1547 - RNA, 20 nt, Artificial Sequence
  MKO10001547_A_4933408B17Rik
  gRNA
gauccugaauaggaucaccu

SEQ ID NO: 1548 - RNA, 20 nt, Artificial Sequence
  MKO10001548_A_4933409G03Rik
  gRNA
ccagccuacuaccaccgaag

SEQ ID NO: 1549 - RNA, 20 nt, Artificial Sequence
  MKO10001549_A_4933409G03Rik
  gRNA
cgcuggacaagcacaacuug

SEQ ID NO: 1550 - RNA, 20 nt, Artificial Sequence
  MKO10001550_A_4933409G03Rik
  gRNA
gaacucucaccugacuggga

SEQ ID NO: 1551 - RNA, 20 nt, Artificial Sequence
  MKO10001551_A_4933411G11Rik
  gRNA
uggucaguggagacgccgug

SEQ ID NO: 1552 - RNA, 20 nt, Artificial Sequence
  MKO10001552_A_4933411G11Rik
  gRNA
gugucucuuaccgagcaacu

SEQ ID NO: 1553 - RNA, 20 nt, Artificial Sequence
  MKO10001553_A_4933411G11Rik
  gRNA
uuccuucacagaggaucccg

SEQ ID NO: 1554 - RNA, 20 nt, Artificial Sequence
  MKO10001554_A_4933411K16Rik
  gRNA
uccacaacucaccgucguaa

SEQ ID NO: 1555 - RNA, 20 nt, Artificial Sequence
  MKO10001555_A_4933411K16Rik
  gRNA
agucaauaccacccuccacg

SEQ ID NO: 1556 - RNA, 20 nt, Artificial Sequence
  MKO10001556_A_4933411K16Rik
  gRNA
guuagccacgcgaugccccu

SEQ ID NO: 1557 - RNA, 20 nt, Artificial Sequence
  MKO10001557_A_4933411K20Rik
  gRNA
ccccgaauguucguacugcu

SEQ ID NO: 1558 - RNA, 20 nt, Artificial Sequence
  MKO10001558_A_4933411K20Rik
  gRNA
gggauggccgaucgaucuuc

SEQ ID NO: 1559 - RNA, 20 nt, Artificial Sequence
  MKO10001559_A_4933411K20Rik
  gRNA
uuuggcgucauggaucgguu

SEQ ID NO: 1560 - RNA, 20 nt, Artificial Sequence
  MKO10001560_A_4933412E24Rik
  gRNA
gagagcuccgcaagcuuccg

SEQ ID NO: 1561 - RNA, 20 nt, Artificial Sequence
  MKO10001561_A_4933412E24Rik
  gRNA
acuacccggggacuuaccuc

SEQ ID NO: 1562 - RNA, 20 nt, Artificial Sequence
  MKO10001562_A_4933412E24Rik
  gRNA
agcgucagagaacccauccg

SEQ ID NO: 1563 - RNA, 20 nt, Artificial Sequence
  MKO10001563_A_4933413G19Rik
  gRNA
uacccuaugacaguaacguc

SEQ ID NO: 1564 - RNA, 20 nt, Artificial Sequence
  MKO10001564_A_4933413G19Rik
  gRNA
cgccagacguuacugucaua

SEQ ID NO: 1565 - RNA, 20 nt, Artificial Sequence
  MKO10001565_A_4933413G19Rik
  gRNA
ucuuugcucaggggcaccgu

SEQ ID NO: 1566 - RNA, 20 nt, Artificial Sequence
  MKO10001566_A_4933415F23Rik
  gRNA
ccggggccagggguuucgcc

SEQ ID NO: 1567 - RNA, 20 nt, Artificial Sequence
  MKO10001567_A_4933415F23Rik
  gRNA
guucuaagauccagucgucc

SEQ ID NO: 1568 - RNA, 20 nt, Artificial Sequence
  MKO10001568_A_4933415F23Rik
  gRNA
uacuugacgaugaucuuauc

SEQ ID NO: 1569 - RNA, 20 nt, Artificial Sequence
  MKO10001569_A_4933416C03Rik
  gRNA
aagcccgccgauaugaagca

SEQ ID NO: 1570 - RNA, 20 nt, Artificial Sequence
  MKO10001570_A_4933416C03Rik
  gRNA
gacgccaucuaccugaacga

SEQ ID NO: 1571 - RNA, 20 nt, Artificial Sequence
  MKO10001571_A_4933416C03Rik
  gRNA
cuauugugcagcgccgauga

SEQ ID NO: 1572 - RNA, 20 nt, Artificial Sequence
  MKO10001572_A_4933416I08Rik
  gRNA
uugggauacaccccuauucu

SEQ ID NO: 1573 - RNA, 20 nt, Artificial Sequence
  MKO10001573_A_4933416I08Rik
  gRNA
acuuacuaaucaucgucuuc

SEQ ID NO: 1574 - RNA, 20 nt, Artificial Sequence
  MKO10001574_A_4933416I08Rik
  gRNA
accuugucuccagcacgcag

SEQ ID NO: 1575 - RNA, 20 nt, Artificial Sequence
  MKO10001575_A_4933417A18Rik
  gRNA
aagcaccuaugagccgccca

SEQ ID NO: 1576 - RNA, 20 nt, Artificial Sequence
  MKO10001576_A_4933417A18Rik
  gRNA
acagcacuuugucguccacu

SEQ ID NO: 1577 - RNA, 20 nt, Artificial Sequence
  MKO10001577_A_4933417A18Rik
  gRNA
gcucaauguuccagugcuca

SEQ ID NO: 1578 - RNA, 20 nt, Artificial Sequence
  MKO10001578_A_4933421I07Rik
  gRNA
cucgacucuuguagucgaau

SEQ ID NO: 1579 - RNA, 20 nt, Artificial Sequence
  MKO10001579_A_4933421I07Rik
  gRNA
uucaaugcagucaguccgga

SEQ ID NO: 1580 - RNA, 20 nt, Artificial Sequence
  MKO10001580_A_4933421I07Rik
  gRNA
uggguaucuccaucuccgaa

SEQ ID NO: 1581 - RNA, 20 nt, Artificial Sequence
  MKO10001581_A_4933422H20Rik
  gRNA
gauucagaccaugcgagacg

SEQ ID NO: 1582 - RNA, 20 nt, Artificial Sequence
  MKO10001582_A_4933422H20Rik
  gRNA
cgguucgugaggucccacac

SEQ ID NO: 1583 - RNA, 20 nt, Artificial Sequence
  MKO10001583_A_4933422H20Rik
  gRNA
ugcgggcccguucauccucc

SEQ ID NO: 1584 - RNA, 20 nt, Artificial Sequence
  MKO10001584_A_4933425L06Rik
  gRNA
ggaggccaugaccacgaaua

SEQ ID NO: 1585 - RNA, 20 nt, Artificial Sequence
  MKO10001585_A_4933425L06Rik
  gRNA
uaugacagaauacacccgcc

SEQ ID NO: 1586 - RNA, 20 nt, Artificial Sequence
  MKO10001586_A_4933425L06Rik
  gRNA
gagugccacaucagcaugcg

SEQ ID NO: 1587 - RNA, 20 nt, Artificial Sequence
  MKO10001587_A_4933426M11Rik
  gRNA
ggucuuuacaaggccggggg

SEQ ID NO: 1588 - RNA, 20 nt, Artificial Sequence
  MKO10001588_A_4933426M11Rik
  gRNA
ggucccugcgcuguccauag

SEQ ID NO: 1589 - RNA, 20 nt, Artificial Sequence
  MKO10001589_A_4933426M11Rik
  gRNA
gaagccacuauggacagcgc

SEQ ID NO: 1590 - RNA, 20 nt, Artificial Sequence
  MKO10001590_A_4933427D06Rik
  gRNA
cccucugagaugcccgauca

SEQ ID NO: 1591 - RNA, 20 nt, Artificial Sequence
  MKO10001591_A_4933427D06Rik
  gRNA
uugcuuauguacguucgcag

SEQ ID NO: 1592 - RNA, 20 nt, Artificial Sequence
  MKO10001592_A_4933427D06Rik
  gRNA
guagacgagccuaaagaguc

SEQ ID NO: 1593 - RNA, 20 nt, Artificial Sequence
  MKO10001593_A_4933427D14Rik
  gRNA
ccggauggcugcucgaugag

SEQ ID NO: 1594 - RNA, 20 nt, Artificial Sequence
  MKO10001594_A_4933427D14Rik
  gRNA
ccgcucaucgagcagccauc

SEQ ID NO: 1595 - RNA, 20 nt, Artificial Sequence
  MKO10001595_A_4933427D14Rik
  gRNA
auacaccuuagcgcccgagc

SEQ ID NO: 1596 - RNA, 20 nt, Artificial Sequence
  MKO10001596_A_4933427G17Rik
  gRNA
gcuucaaccauguccgccac

SEQ ID NO: 1597 - RNA, 20 nt, Artificial Sequence
  MKO10001597_A_4933427G17Rik
  gRNA
gggugcugucaaaugcgcac

SEQ ID NO: 1598 - RNA, 20 nt, Artificial Sequence
  MKO10001598_A_4933427G17Rik
  gRNA
cguccucuccgagagcgaac

SEQ ID NO: 1599 - RNA, 20 nt, Artificial Sequence
  MKO10001599_A_4933428G20Rik
  gRNA
cccagaucguuagccccccc

SEQ ID NO: 1600 - RNA, 20 nt, Artificial Sequence
  MKO10001600_A_4933428G20Rik
  gRNA
ccugggggggcuaacgaucu

SEQ ID NO: 1601 - RNA, 20 nt, Artificial Sequence
  MKO10001601_A_4933428G20Rik
  gRNA
caccgacgaugacuccgagc

SEQ ID NO: 1602 - RNA, 20 nt, Artificial Sequence
  MKO10001602_A_4933430I17Rik
  gRNA
cgacaaugagggacgaucuu

SEQ ID NO: 1603 - RNA, 20 nt, Artificial Sequence
  MKO10001603_A_4933430I17Rik
  gRNA
uacaaacggcuucgucccac

SEQ ID NO: 1604 - RNA, 20 nt, Artificial Sequence
  MKO10001604_A_4933430I17Rik
  gRNA
aauugaccugcucugacguu

SEQ ID NO: 1605 - RNA, 20 nt, Artificial Sequence
  MKO10001605_A_4933433C11Rik
  gRNA
aaccggguacuugcgaccga

SEQ ID NO: 1606 - RNA, 20 nt, Artificial Sequence
  MKO10001606_A_4933433C11Rik
  gRNA
agcuacaaggaccucgggcu

SEQ ID NO: 1607 - RNA, 20 nt, Artificial Sequence
  MKO10001607_A_4933433C11Rik
  gRNA
cuggcucagcggcguguacu

SEQ ID NO: 1608 - RNA, 20 nt, Artificial Sequence
  MKO10001608_A_4933434E20Rik
  gRNA
uaacuuaccagaggcacgga

SEQ ID NO: 1609 - RNA, 20 nt, Artificial Sequence
  MKO10001609_A_4933434E20Rik
  gRNA
cuagaugccauccgugccuc

SEQ ID NO: 1610 - RNA, 20 nt, Artificial Sequence
  MKO10001610_A_4933434E20Rik
  gRNA
gucacauacuuugauucccc

SEQ ID NO: 1611 - RNA, 20 nt, Artificial Sequence
  MKO10001611_A_4933434I20Rik
  gRNA
gcccacacaacaagaucauc

SEQ ID NO: 1612 - RNA, 20 nt, Artificial Sequence
  MKO10001612_A_4933434I20Rik
  gRNA
uaacugcagaaaccacguuu

SEQ ID NO: 1613 - RNA, 20 nt, Artificial Sequence
  MKO10001613_A_4933434I20Rik
  gRNA
uuuaaaaucuguuguucgca

SEQ ID NO: 1614 - RNA, 20 nt, Artificial Sequence
  MKO10001614_A_4933436I01Rik
  gRNA
uugccagaaccccuagauac

SEQ ID NO: 1615 - RNA, 20 nt, Artificial Sequence
  MKO10001615_A_4933436I01Rik
  gRNA
caacuacacgaacaaguagc

SEQ ID NO: 1616 - RNA, 20 nt, Artificial Sequence
  MKO10001616_A_4933436I01Rik
  gRNA
cuaucaagacagacgugaaa

SEQ ID NO: 1617 - RNA, 20 nt, Artificial Sequence
  MKO10001617_A_42434
  gRNA
ugucacugcuccauaaguca

SEQ ID NO: 1618 - RNA, 20 nt, Artificial Sequence
  MKO10001618_A_42434
  gRNA
cagguuguaggccauaaaga

SEQ ID NO: 1619 - RNA, 20 nt, Artificial Sequence
  MKO10001619_A_42434
  gRNA
aagaugauagaacagcugag

SEQ ID NO: 1620 - RNA, 20 nt, Artificial Sequence
  MKO10001620_A_42618
  gRNA
gacaucgacaagcaguacgu

SEQ ID NO: 1621 - RNA, 20 nt, Artificial Sequence
  MKO10001621_A_42618
  gRNA
uuucgacuucacgcucaugg

SEQ ID NO: 1622 - RNA, 20 nt, Artificial Sequence
  MKO10001622_A_42618
  gRNA
cuuucugaccgaccuguaua

SEQ ID NO: 1623 - RNA, 20 nt, Artificial Sequence
  MKO10001623_A_5031410I06Rik
  gRNA
ucacagacagacaacauccc

SEQ ID NO: 1624 - RNA, 20 nt, Artificial Sequence
  MKO10001624_A_5031410I06Rik
  gRNA
caauguauaccucuuguuca

SEQ ID NO: 1625 - RNA, 20 nt, Artificial Sequence
  MKO10001625_A_5031410I06Rik
  gRNA
cuggggucaggcccuaccac

SEQ ID NO: 1626 - RNA, 20 nt, Artificial Sequence
  MKO10001626_A_5031414D18Rik
  gRNA
uccagucccacguaaccugc

SEQ ID NO: 1627 - RNA, 20 nt, Artificial Sequence
  MKO10001627_A_5031414D18Rik
  gRNA
gaagacgccagcagguuacg

SEQ ID NO: 1628 - RNA, 20 nt, Artificial Sequence
  MKO10001628_A_5031414D18Rik
  gRNA
gcagcaugaacgucucuagu

SEQ ID NO: 1629 - RNA, 20 nt, Artificial Sequence
  MKO10001629_A_5031439G07Rik
  gRNA
acaugcucuucuacgugcgc

SEQ ID NO: 1630 - RNA, 20 nt, Artificial Sequence
  MKO10001630_A_5031439G07Rik
  gRNA
gcgagccuacccaggcaacg

SEQ ID NO: 1631 - RNA, 20 nt, Artificial Sequence
  MKO10001631_A_5031439G07Rik
  gRNA
gcugugugcacgcgugccga

SEQ ID NO: 1632 - RNA, 20 nt, Artificial Sequence
  MKO10001632_A_5033411D12Rik
  gRNA
uaacauuguagaguacuggc

SEQ ID NO: 1633 - RNA, 20 nt, Artificial Sequence
  MKO10001633_A_5033411D12Rik
  gRNA
aagaucuccuaaauucaucg

SEQ ID NO: 1634 - RNA, 20 nt, Artificial Sequence
  MKO10001634_A_5033411D12Rik
  gRNA
cuggugaugacacacgaucu

SEQ ID NO: 1635 - RNA, 20 nt, Artificial Sequence
  MKO10001635_A_5330417C22Rik
  gRNA
guuagaaacaucgccauaac

SEQ ID NO: 1636 - RNA, 20 nt, Artificial Sequence
  MKO10001636_A_5330417C22Rik
  gRNA
gucuccccggggaacccacu

SEQ ID NO: 1637 - RNA, 20 nt, Artificial Sequence
  MKO10001637_A_5330417C22Rik
  gRNA
ugcuuggcagcguaugugcc

SEQ ID NO: 1638 - RNA, 20 nt, Artificial Sequence
  MKO10001638_A_5430401F13Rik
  gRNA
ucagagcuucgucuacuacg

SEQ ID NO: 1639 - RNA, 20 nt, Artificial Sequence
  MKO10001639_A_5430401F13Rik
  gRNA
aagcucugaugaugacaacu

SEQ ID NO: 1640 - RNA, 20 nt, Artificial Sequence
  MKO10001640_A_5430401F13Rik
  gRNA
ggaagcgcucuucaagaaga

SEQ ID NO: 1641 - RNA, 20 nt, Artificial Sequence
  MKO10001641_A_5430402E10Rik
  gRNA
uaugcucaaaauacgcucuc

SEQ ID NO: 1642 - RNA, 20 nt, Artificial Sequence
  MKO10001642_A_5430402E10Rik
  gRNA
cuauuuagguuaauggggac

SEQ ID NO: 1643 - RNA, 20 nt, Artificial Sequence
  MKO10001643_A_5430402E10Rik
  gRNA
gugucagacacacacuguug

SEQ ID NO: 1644 - RNA, 20 nt, Artificial Sequence
  MKO10001644_A_5430419D17Rik
  gRNA
gccccgaguuccucuguauc

SEQ ID NO: 1645 - RNA, 20 nt, Artificial Sequence
  MKO10001645_A_5430419D17Rik
  gRNA
gcugcuccucagacacgccc

SEQ ID NO: 1646 - RNA, 20 nt, Artificial Sequence
  MKO10001646_A_5430419D17Rik
  gRNA
gccuaagagaagcuccaucc

SEQ ID NO: 1647 - RNA, 20 nt, Artificial Sequence
  MKO10001647_A_5430421N21Rik
  gRNA
cacaucugucaucgucaaga

SEQ ID NO: 1648 - RNA, 20 nt, Artificial Sequence
  MKO10001648_A_5430421N21Rik
  gRNA
augaagaagaaguugcacuc

SEQ ID NO: 1649 - RNA, 20 nt, Artificial Sequence
  MKO10001649_A_5430421N21Rik
  gRNA
ugcauggcaggugcgcuucc

SEQ ID NO: 1650 - RNA, 20 nt, Artificial Sequence
  MKO10001650_A_5430427O19Rik
  gRNA
uccaguaggaugaguaccgc

SEQ ID NO: 1651 - RNA, 20 nt, Artificial Sequence
  MKO10001651_A_5430427O19Rik
  gRNA
uacaacgacuuacauauugc

SEQ ID NO: 1652 - RNA, 20 nt, Artificial Sequence
  MKO10001652_A_5430427O19Rik
  gRNA
uaugugagcugcaaauccuc

SEQ ID NO: 1653 - RNA, 20 nt, Artificial Sequence
  MKO10001653_A_5430435G22Rik
  gRNA
ucaggagcgguuccgcucaa

SEQ ID NO: 1654 - RNA, 20 nt, Artificial Sequence
  MKO10001654_A_5430435G22Rik
  gRNA
ccauagggauaaucuuugcc

SEQ ID NO: 1655 - RNA, 20 nt, Artificial Sequence
  MKO10001655_A_5430435G22Rik
  gRNA
ugacacaacuuugaagcugc

SEQ ID NO: 1656 - RNA, 20 nt, Artificial Sequence
  MKO10001656_A_5530400C23Rik
  gRNA
acaucaugauuaacuacucg

SEQ ID NO: 1657 - RNA, 20 nt, Artificial Sequence
  MKO10001657_A_5530400C23Rik
  gRNA
uugaacaaugauaguacauc

SEQ ID NO: 1658 - RNA, 20 nt, Artificial Sequence
  MKO10001658_A_5530400C23Rik
  gRNA
cggagcaauuuaagaggaug

SEQ ID NO: 1659 - RNA, 20 nt, Artificial Sequence
  MKO10001659_A_5730409E04Rik
  gRNA
ggagaaacaccacgcgcauu

SEQ ID NO: 1660 - RNA, 20 nt, Artificial Sequence
  MKO10001660_A_5730409E04Rik
  gRNA
gauacaucaccaaaugcgcg

SEQ ID NO: 1661 - RNA, 20 nt, Artificial Sequence
  MKO10001661_A_5730409E04Rik
  gRNA
uccagagggcucggaccucg

SEQ ID NO: 1662 - RNA, 20 nt, Artificial Sequence
  MKO10001662_A_5730455P16Rik
  gRNA
gauagugaugauggacguuc

SEQ ID NO: 1663 - RNA, 20 nt, Artificial Sequence
  MKO10001663_A_5730455P16Rik
  gRNA
agaauuccagguuaccgagu

SEQ ID NO: 1664 - RNA, 20 nt, Artificial Sequence
  MKO10001664_A_5730455P16Rik
  gRNA
gcaaugaaacugcgaaguuc

SEQ ID NO: 1665 - RNA, 20 nt, Artificial Sequence
  MKO10001665_A_5730507C01Rik
  gRNA
ccagugccgggcaaccgugg

SEQ ID NO: 1666 - RNA, 20 nt, Artificial Sequence
  MKO10001666_A_5730507C01Rik
  gRNA
uaaacuucccaguugugcaa

SEQ ID NO: 1667 - RNA, 20 nt, Artificial Sequence
  MKO10001667_A_5730507C01Rik
  gRNA
ccggcacugggccgugcucg

SEQ ID NO: 1668 - RNA, 20 nt, Artificial Sequence
  MKO10001668_A_5730508B09Rik
  gRNA
cgccggcggggagugcgacg

SEQ ID NO: 1669 - RNA, 20 nt, Artificial Sequence
  MKO10001669_A_5730508B09Rik
  gRNA
aaagaacggcaacgagucca

SEQ ID NO: 1670 - RNA, 20 nt, Artificial Sequence
  MKO10001670_A_5730508B09Rik
  gRNA
gcggugggaugugcucggcc

SEQ ID NO: 1671 - RNA, 20 nt, Artificial Sequence
  MKO10001671_A_5730559C18Rik
  gRNA
acgcugcuccgauccugcgc

SEQ ID NO: 1672 - RNA, 20 nt, Artificial Sequence
  MKO10001672_A_5730559C18Rik
  gRNA
uguuccgccgccgaucaccc

SEQ ID NO: 1673 - RNA, 20 nt, Artificial Sequence
  MKO10001673_A_5730559C18Rik
  gRNA
gcgggaccuucagcguugcc

SEQ ID NO: 1674 - RNA, 20 nt, Artificial Sequence
  MKO10001674_A_5830403L16Rik
  gRNA
acuucauguaccgcaaacag

SEQ ID NO: 1675 - RNA, 20 nt, Artificial Sequence
  MKO10001675_A_5830403L16Rik
  gRNA
augcuguacaaaccaaucuc

SEQ ID NO: 1676 - RNA, 20 nt, Artificial Sequence
  MKO10001676_A_5830403L16Rik
  gRNA
aauauccaccaucccguccu

SEQ ID NO: 1677 - RNA, 20 nt, Artificial Sequence
  MKO10001677_A_5830411N06Rik
  gRNA
uucguugcccauacagcgaa

SEQ ID NO: 1678 - RNA, 20 nt, Artificial Sequence
  MKO10001678_A_5830411N06Rik
  gRNA
ccugaucaaugugaacgucc

SEQ ID NO: 1679 - RNA, 20 nt, Artificial Sequence
  MKO10001679_A_5830411N06Rik
  gRNA
gacagaggccuuucgcugua

SEQ ID NO: 1680 - RNA, 20 nt, Artificial Sequence
  MKO10001680_A_5830415F09Rik
  gRNA
ugagucguagucagcaaugu

SEQ ID NO: 1681 - RNA, 20 nt, Artificial Sequence
  MKO10001681_A_5830415F09Rik
  gRNA
uguuggccgugccaucaacc

SEQ ID NO: 1682 - RNA, 20 nt, Artificial Sequence
  MKO10001682_A_5830415F09Rik
  gRNA
guaccgccggaagcucugcg

SEQ ID NO: 1683 - RNA, 20 nt, Artificial Sequence
  MKO10001683_A_5830418K08Rik
  gRNA
cgagaaagagcauccaaguc

SEQ ID NO: 1684 - RNA, 20 nt, Artificial Sequence
  MKO10001684_A_5830418K08Rik
  gRNA
aaggcacauaaaagcucgaa

SEQ ID NO: 1685 - RNA, 20 nt, Artificial Sequence
  MKO10001685_A_5830418K08Rik
  gRNA
acgaaaacuaagauugcugc

SEQ ID NO: 1686 - RNA, 20 nt, Artificial Sequence
  MKO10001686_A_5830473C10Rik
  gRNA
uacacaauaccuuuguccgc

SEQ ID NO: 1687 - RNA, 20 nt, Artificial Sequence
  MKO10001687_A_5830473C10Rik
  gRNA
ugaacacgugacuauccacc

SEQ ID NO: 1688 - RNA, 20 nt, Artificial Sequence
  MKO10001688_A_5830473C10Rik
  gRNA
augauacaccccugauucca

SEQ ID NO: 1689 - RNA, 20 nt, Artificial Sequence
  MKO10001689_A_42435
  gRNA
gguagccgugaaggcauauc

SEQ ID NO: 1690 - RNA, 20 nt, Artificial Sequence
  MKO10001690_A_42435
  gRNA
uuggcacugcaauacgauac

SEQ ID NO: 1691 - RNA, 20 nt, Artificial Sequence
  MKO10001691_A_42435
  gRNA
cacguugacagcaugucuag

SEQ ID NO: 1692 - RNA, 20 nt, Artificial Sequence
  MKO10001692_A_42619
  gRNA
agcggccgauauagcucgcc

SEQ ID NO: 1693 - RNA, 20 nt, Artificial Sequence
  MKO10001693_A_42619
  gRNA
caccaccuggcgagcuauau

SEQ ID NO: 1694 - RNA, 20 nt, Artificial Sequence
  MKO10001694_A_42619
  gRNA
uuguauuucauugccccgac

SEQ ID NO: 1695 - RNA, 20 nt, Artificial Sequence
  MKO10001695_A_6030419C18Rik
  gRNA
uccguugaccacccgacgcu

SEQ ID NO: 1696 - RNA, 20 nt, Artificial Sequence
  MKO10001696_A_6030419C18Rik
  gRNA
cauccccaacgggccacgag

SEQ ID NO: 1697 - RNA, 20 nt, Artificial Sequence
  MKO10001697_A_6030419C18Rik
  gRNA
gauucgacagcgcaugaaga

SEQ ID NO: 1698 - RNA, 20 nt, Artificial Sequence
  MKO10001698_A_6030458C11Rik
  gRNA
uauguccagaaucgccccag

SEQ ID NO: 1699 - RNA, 20 nt, Artificial Sequence
  MKO10001699_A_6030458C11Rik
  gRNA
ccguccugcucacguuccgg

SEQ ID NO: 1700 - RNA, 20 nt, Artificial Sequence
  MKO10001700_A_6030458C11Rik
  gRNA
accucaggaagguuacuauc

SEQ ID NO: 1701 - RNA, 20 nt, Artificial Sequence
  MKO10001701_A_6030468B19Rik
  gRNA
cugacuucguccuacgccau

SEQ ID NO: 1702 - RNA, 20 nt, Artificial Sequence
  MKO10001702_A_6030468B19Rik
  gRNA
caauaacggcuauggagacg

SEQ ID NO: 1703 - RNA, 20 nt, Artificial Sequence
  MKO10001703_A_6030468B19Rik
  gRNA
ugcgaagcugaaaacgaugu

SEQ ID NO: 1704 - RNA, 20 nt, Artificial Sequence
  MKO10001704_A_6030498E09Rik
  gRNA
ucccgcuucuauacaucuaa

SEQ ID NO: 1705 - RNA, 20 nt, Artificial Sequence
  MKO10001705_A_6030498E09Rik
  gRNA
ccguacccagacccagucca

SEQ ID NO: 1706 - RNA, 20 nt, Artificial Sequence
  MKO10001706_A_6030498E09Rik
  gRNA
guaaauaugagugugacaau

SEQ ID NO: 1707 - RNA, 20 nt, Artificial Sequence
  MKO10001707_A_6330403A02Rik
  gRNA
cggggggcaucgucguccag

SEQ ID NO: 1708 - RNA, 20 nt, Artificial Sequence
  MKO10001708_A_6330403A02Rik
  gRNA
uggggcacgcaccgaccucc

SEQ ID NO: 1709 - RNA, 20 nt, Artificial Sequence
  MKO10001709_A_6330403A02Rik
  gRNA
gcucacggccaucguuaugg

SEQ ID NO: 1710 - RNA, 20 nt, Artificial Sequence
  MKO10001710_A_6330403K07Rik
  gRNA
cagcgcguuuccgaaacaaa

SEQ ID NO: 1711 - RNA, 20 nt, Artificial Sequence
  MKO10001711_A_6330403K07Rik
  gRNA
acuuaggugcacgcgcagug

SEQ ID NO: 1712 - RNA, 20 nt, Artificial Sequence
  MKO10001712_A_6330403K07Rik
  gRNA
uaaccugcaaacgcgaguuc

SEQ ID NO: 1713 - RNA, 20 nt, Artificial Sequence
  MKO10001713_A_6330408A02Rik
  gRNA
gccgggacgcgccacgcaac

SEQ ID NO: 1714 - RNA, 20 nt, Artificial Sequence
  MKO10001714_A_6330408A02Rik
  gRNA
gccuguugcguggcgcgucc

SEQ ID NO: 1715 - RNA, 20 nt, Artificial Sequence
  MKO10001715_A_6330408A02Rik
  gRNA
accacgagucgaucucgcaa

SEQ ID NO: 1716 - RNA, 20 nt, Artificial Sequence
  MKO10001716_A_6330409D20Rik
  gRNA
gcuagauaugauagagcgcu

SEQ ID NO: 1717 - RNA, 20 nt, Artificial Sequence
  MKO10001717_A_6330409D20Rik
  gRNA
cagccuaugcgacaucaagc

SEQ ID NO: 1718 - RNA, 20 nt, Artificial Sequence
  MKO10001718_A_6330409D20Rik
  gRNA
ucaccugcuugaugucgcau

SEQ ID NO: 1719 - RNA, 20 nt, Artificial Sequence
  MKO10001719_A_6330416G13Rik
  gRNA
gugcacagguauugucgauc

SEQ ID NO: 1720 - RNA, 20 nt, Artificial Sequence
  MKO10001720_A_6330416G13Rik
  gRNA
aggcgugcugcuugcgaccc

SEQ ID NO: 1721 - RNA, 20 nt, Artificial Sequence
  MKO10001721_A_6330416G13Rik
  gRNA
augauguaccuccucacuug

SEQ ID NO: 1722 - RNA, 20 nt, Artificial Sequence
  MKO10001722_A_6430531B16Rik
  gRNA
uugugaagcacuuccgcccu

SEQ ID NO: 1723 - RNA, 20 nt, Artificial Sequence
  MKO10001723_A_6430531B16Rik
  gRNA
accacucuguucccgaaagc

SEQ ID NO: 1724 - RNA, 20 nt, Artificial Sequence
  MKO10001724_A_6430531B16Rik
  gRNA
cugugcaaguccaccagccg

SEQ ID NO: 1725 - RNA, 20 nt, Artificial Sequence
  MKO10001725_A_6430548M08Rik
  gRNA
caaagcgugcgaaccauucc

SEQ ID NO: 1726 - RNA, 20 nt, Artificial Sequence
  MKO10001726_A_6430548M08Rik
  gRNA
cgcacgcuuugugagcgcac

SEQ ID NO: 1727 - RNA, 20 nt, Artificial Sequence
  MKO10001727_A_6430548M08Rik
  gRNA
cucaaacagcacuaccgcga

SEQ ID NO: 1728 - RNA, 20 nt, Artificial Sequence
  MKO10001728_A_6430550D23Rik
  gRNA
gaauugggagucacuccaga

SEQ ID NO: 1729 - RNA, 20 nt, Artificial Sequence
  MKO10001729_A_6430550D23Rik
  gRNA
guuauugcagcuugcugauc

SEQ ID NO: 1730 - RNA, 20 nt, Artificial Sequence
  MKO10001730_A_6430550D23Rik
  gRNA
augaacucagugagcgagca

SEQ ID NO: 1731 - RNA, 20 nt, Artificial Sequence
  MKO10001731_A_6430571L13Rik
  gRNA
uccggccucucacgcaugga

SEQ ID NO: 1732 - RNA, 20 nt, Artificial Sequence
  MKO10001732_A_6430571L13Rik
  gRNA
aucgguaaacaccagccugc

SEQ ID NO: 1733 - RNA, 20 nt, Artificial Sequence
  MKO10001733_A_6430571L13Rik
  gRNA
gguagagccuucagcggcgg

SEQ ID NO: 1734 - RNA, 20 nt, Artificial Sequence
  MKO10001734_A_6430573F11Rik
  gRNA
gguuaccaaugucagcgacg

SEQ ID NO: 1735 - RNA, 20 nt, Artificial Sequence
  MKO10001735_A_6430573F11Rik
  gRNA
ggcagccucgucgcugacau

SEQ ID NO: 1736 - RNA, 20 nt, Artificial Sequence
  MKO10001736_A_6430573F11Rik
  gRNA
cuuugaaauagcuucgcagc

SEQ ID NO: 1737 - RNA, 20 nt, Artificial Sequence
  MKO10001737_A_6720489N17Rik
  gRNA
gcauucucuccguugcgagc

SEQ ID NO: 1738 - RNA, 20 nt, Artificial Sequence
  MKO10001738_A_6720489N17Rik
  gRNA
gucgaucaaagaacacuaac

SEQ ID NO: 1739 - RNA, 20 nt, Artificial Sequence
  MKO10001739_A_6720489N17Rik
  gRNA
aagauuucugugucguaaaa

SEQ ID NO: 1740 - RNA, 20 nt, Artificial Sequence
  MKO10001740_A_6820408C15Rik
  gRNA
uagcauuucacgcacgcuca

SEQ ID NO: 1741 - RNA, 20 nt, Artificial Sequence
  MKO10001741_A_6820408C15Rik
  gRNA
agucgaugcuucgaaaccag

SEQ ID NO: 1742 - RNA, 20 nt, Artificial Sequence
  MKO10001742_A_6820408C15Rik
  gRNA
ccuuugacuugucggagggg

SEQ ID NO: 1743 - RNA, 20 nt, Artificial Sequence
  MKO10001743_A_42436
  gRNA
gccagauuacugccgagugc

SEQ ID NO: 1744 - RNA, 20 nt, Artificial Sequence
  MKO10001744_A_42436
  gRNA
cgccuccuucucgagaacaa

SEQ ID NO: 1745 - RNA, 20 nt, Artificial Sequence
  MKO10001745_A_42436
  gRNA
uugagucaugaucccgcugc

SEQ ID NO: 1746 - RNA, 20 nt, Artificial Sequence
  MKO10001746_A_42620
  gRNA
ucagcaaccgaagaaccuug

SEQ ID NO: 1747 - RNA, 20 nt, Artificial Sequence
  MKO10001747_A_42620
  gRNA
cugacaauaguugauacucc

SEQ ID NO: 1748 - RNA, 20 nt, Artificial Sequence
  MKO10001748_A_42620
  gRNA
gaauucacucuuaugguagu

SEQ ID NO: 1749 - RNA, 20 nt, Artificial Sequence
  MKO10001749_A_7420426K07Rik
  gRNA
agggcuggauaggccguucc

SEQ ID NO: 1750 - RNA, 20 nt, Artificial Sequence
  MKO10001750_A_7420426K07Rik
  gRNA
gaggucagcgcuagugcugc

SEQ ID NO: 1751 - RNA, 20 nt, Artificial Sequence
  MKO10001751_A_7420426K07Rik
  gRNA
ggccuauccagcccucgucc

SEQ ID NO: 1752 - RNA, 20 nt, Artificial Sequence
  MKO10001752_A_7420461P10Rik
  gRNA
auggccauuuccacacuuag

SEQ ID NO: 1753 - RNA, 20 nt, Artificial Sequence
  MKO10001753_A_7420461P10Rik
  gRNA
ccuccgaaucucagaucugc

SEQ ID NO: 1754 - RNA, 20 nt, Artificial Sequence
  MKO10001754_A_7420461P10Rik
  gRNA
ucucugagaucaacaagcgu

SEQ ID NO: 1755 - RNA, 20 nt, Artificial Sequence
  MKO10001755_A_7530416G11Rik
  gRNA
gaacgccuccugauuggaaa

SEQ ID NO: 1756 - RNA, 20 nt, Artificial Sequence
  MKO10001756_A_7530416G11Rik
  gRNA
ucuauuccacggcagacagu

SEQ ID NO: 1757 - RNA, 20 nt, Artificial Sequence
  MKO10001757_A_7530416G11Rik
  gRNA
aauacggggccuacacacaa

SEQ ID NO: 1758 - RNA, 20 nt, Artificial Sequence
  MKO10001758_A_42437
  gRNA
gagccuccauuucgugcauc

SEQ ID NO: 1759 - RNA, 20 nt, Artificial Sequence
  MKO10001759_A_42437
  gRNA
gacacuggagccgucgugga

SEQ ID NO: 1760 - RNA, 20 nt, Artificial Sequence
  MKO10001760_A_42437
  gRNA
aagccugaugcacgaaaugg

SEQ ID NO: 1761 - RNA, 20 nt, Artificial Sequence
  MKO10001761_A_42621
  gRNA
caccgagacgcguuccaagu

SEQ ID NO: 1762 - RNA, 20 nt, Artificial Sequence
  MKO10001762_A_42621
  gRNA
ucuuugacuaucacgacacg

SEQ ID NO: 1763 - RNA, 20 nt, Artificial Sequence
  MKO10001763_A_42621
  gRNA
cucuacuucaucacgcccac

SEQ ID NO: 1764 - RNA, 20 nt, Artificial Sequence
  MKO10001764_A_8030411F24Rik
  gRNA
ccgcgcuuaugucggcacac

SEQ ID NO: 1765 - RNA, 20 nt, Artificial Sequence
  MKO10001765_A_8030411F24Rik
  gRNA
acauacaaguugcucgaagu

SEQ ID NO: 1766 - RNA, 20 nt, Artificial Sequence
  MKO10001766_A_8030411F24Rik
  gRNA
uccaaguagaugcgagaccu

SEQ ID NO: 1767 - RNA, 20 nt, Artificial Sequence
  MKO10001767_A_8030423J24Rik
  gRNA
gacaccgcuagaacgccaac

SEQ ID NO: 1768 - RNA, 20 nt, Artificial Sequence
  MKO10001768_A_8030423J24Rik
  gRNA
ucucccuguuggcguucuag

SEQ ID NO: 1769 - RNA, 20 nt, Artificial Sequence
  MKO10001769_A_8030423J24Rik
  gRNA
aagugcucaccucgguacug

SEQ ID NO: 1770 - RNA, 20 nt, Artificial Sequence
  MKO10001770_A_8030462N17Rik
  gRNA
ccgagacuuucguccaacag

SEQ ID NO: 1771 - RNA, 20 nt, Artificial Sequence
  MKO10001771_A_8030462N17Rik
  gRNA
agaggucgucgaccuuaccu

SEQ ID NO: 1772 - RNA, 20 nt, Artificial Sequence
  MKO10001772_A_8030462N17Rik
  gRNA
cucauaaacucggccaguug

SEQ ID NO: 1773 - RNA, 20 nt, Artificial Sequence
  MKO10001773_A_8430408G22Rik
  gRNA
uacaccugacguagucaucc

SEQ ID NO: 1774 - RNA, 20 nt, Artificial Sequence
  MKO10001774_A_8430408G22Rik
  gRNA
ucucgccccagcaguauccu

SEQ ID NO: 1775 - RNA, 20 nt, Artificial Sequence
  MKO10001775_A_8430408G22Rik
  gRNA
gccgucccaacagacccucc

SEQ ID NO: 1776 - RNA, 20 nt, Artificial Sequence
  MKO10001776_A_8430419L09Rik
  gRNA
agcgcauucaaugcgacguc

SEQ ID NO: 1777 - RNA, 20 nt, Artificial Sequence
  MKO10001777_A_8430419L09Rik
  gRNA
ugaguacgacccccucacgc

SEQ ID NO: 1778 - RNA, 20 nt, Artificial Sequence
  MKO10001778_A_8430419L09Rik
  gRNA
ugagggggucguacucaccg

SEQ ID NO: 1779 - RNA, 20 nt, Artificial Sequence
  MKO10001779_A_8430427H17Rik
  gRNA
cauggaccccgagcggcuca

SEQ ID NO: 1780 - RNA, 20 nt, Artificial Sequence
  MKO10001780_A_8430427H17Rik
  gRNA
aucagugccgcagccgucug

SEQ ID NO: 1781 - RNA, 20 nt, Artificial Sequence
  MKO10001781_A_8430427H17Rik
  gRNA
cugcggagccgcgucaagua

SEQ ID NO: 1782 - RNA, 20 nt, Artificial Sequence
  MKO10001782_A_42438
  gRNA
uuuaccgcaucuucaagcgc

SEQ ID NO: 1783 - RNA, 20 nt, Artificial Sequence
  MKO10001783_A_42438
  gRNA
ggcccgcgguuccuugucgc

SEQ ID NO: 1784 - RNA, 20 nt, Artificial Sequence
  MKO10001784_A_42438
  gRNA
gacagagcguccagcgcgcc

SEQ ID NO: 1785 - RNA, 20 nt, Artificial Sequence
  MKO10001785_A_42622
  gRNA
cgacuugauuucgaucgucu

SEQ ID NO: 1786 - RNA, 20 nt, Artificial Sequence
  MKO10001786_A_42622
  gRNA
ccccgcgucacggaacgaaa

SEQ ID NO: 1787 - RNA, 20 nt, Artificial Sequence
  MKO10001787_A_42622
  gRNA
ccccacauagccgaacucca

SEQ ID NO: 1788 - RNA, 20 nt, Artificial Sequence
  MKO10001788_A_9030025P20Rik
  gRNA
cuaauucuucauaucucaca

SEQ ID NO: 1789 - RNA, 20 nt, Artificial Sequence
  MKO10001789_A_9030025P20Rik
  gRNA
uuucuuugaguucaaaccca

SEQ ID NO: 1790 - RNA, 20 nt, Artificial Sequence
  MKO10001790_A_9030025P20Rik
  gRNA
ccucuggauaaguuguccac

SEQ ID NO: 1791 - RNA, 20 nt, Artificial Sequence
  MKO10001791_A_9030617O03Rik
  gRNA
uccacauaacucccguaguc

SEQ ID NO: 1792 - RNA, 20 nt, Artificial Sequence
  MKO10001792_A_9030617O03Rik
  gRNA
uuauguggagugucggcccg

SEQ ID NO: 1793 - RNA, 20 nt, Artificial Sequence
  MKO10001793_A_9030617O03Rik
  gRNA
accugggucaccgaugugaa

SEQ ID NO: 1794 - RNA, 20 nt, Artificial Sequence
  MKO10001794_A_9030624G23Rik
  gRNA
uuucacagucagguggccag

SEQ ID NO: 1795 - RNA, 20 nt, Artificial Sequence
  MKO10001795_A_9030624G23Rik
  gRNA
cuugcuauucugcuugccca

SEQ ID NO: 1796 - RNA, 20 nt, Artificial Sequence
  MKO10001796_A_9030624G23Rik
  gRNA
gccggacccgaucuccgugu

SEQ ID NO: 1797 - RNA, 20 nt, Artificial Sequence
  MKO10001797_A_9030624J02Rik
  gRNA
cucgaaaucaggucccacga

SEQ ID NO: 1798 - RNA, 20 nt, Artificial Sequence
  MKO10001798_A_9030624J02Rik
  gRNA
uacgcaggcauucccggaac

SEQ ID NO: 1799 - RNA, 20 nt, Artificial Sequence
  MKO10001799_A_9030624J02Rik
  gRNA
agagcgggucggugccaucg

SEQ ID NO: 1800 - RNA, 20 nt, Artificial Sequence
  MKO10001800_A_9130008F23Rik
  gRNA
guuuccguuuggaaucguag

SEQ ID NO: 1801 - RNA, 20 nt, Artificial Sequence
  MKO10001801_A_9130008F23Rik
  gRNA
gagaaccuucccccgacgau

SEQ ID NO: 1802 - RNA, 20 nt, Artificial Sequence
  MKO10001802_A_9130008F23Rik
  gRNA
ugcggucacagaacgcuccu

SEQ ID NO: 1803 - RNA, 20 nt, Artificial Sequence
  MKO10001803_A_9130011E15Rik
  gRNA
ccgaguugucaacgccuugc

SEQ ID NO: 1804 - RNA, 20 nt, Artificial Sequence
  MKO10001804_A_9130011E15Rik
  gRNA
cagaagaauaaaucuacguc

SEQ ID NO: 1805 - RNA, 20 nt, Artificial Sequence
  MKO10001805_A_9130011E15Rik
  gRNA
aagaguuccucccaaaaccg

SEQ ID NO: 1806 - RNA, 20 nt, Artificial Sequence
  MKO10001806_A_9130019O22Rik
  gRNA
cagugcaauccgcugcgcca

SEQ ID NO: 1807 - RNA, 20 nt, Artificial Sequence
  MKO10001807_A_9130019O22Rik
  gRNA
gcuccauucgguguauggcc

SEQ ID NO: 1808 - RNA, 20 nt, Artificial Sequence
  MKO10001808_A_9130019O22Rik
  gRNA
guauggcucggugcgagcuc

SEQ ID NO: 1809 - RNA, 20 nt, Artificial Sequence
  MKO10001809_A_9130023H24Rik
  gRNA
uuguuccggccgcgccagga

SEQ ID NO: 1810 - RNA, 20 nt, Artificial Sequence
  MKO10001810_A_9130023H24Rik
  gRNA
guagcgcggucucgcgaucc

SEQ ID NO: 1811 - RNA, 20 nt, Artificial Sequence
  MKO10001811_A_9130023H24Rik
  gRNA
aaacaccgucguucucacuc

SEQ ID NO: 1812 - RNA, 20 nt, Artificial Sequence
  MKO10001812_A_9130204L05Rik
  gRNA
aacuccuuuaaguauacuau

SEQ ID NO: 1813 - RNA, 20 nt, Artificial Sequence
  MKO10001813_A_9130204L05Rik
  gRNA
aacuucacaaauuaugcucu

SEQ ID NO: 1814 - RNA, 20 nt, Artificial Sequence
  MKO10001814_A_9130204L05Rik
  gRNA
agaccuaccuggagaaaauu

SEQ ID NO: 1815 - RNA, 20 nt, Artificial Sequence
  MKO10001815_A_9130401M01Rik
  gRNA
gccagcaggcgugucaccgc

SEQ ID NO: 1816 - RNA, 20 nt, Artificial Sequence
  MKO10001816_A_9130401M01Rik
  gRNA
ucagcaaacaucauucgcgu

SEQ ID NO: 1817 - RNA, 20 nt, Artificial Sequence
  MKO10001817_A_9130401M01Rik
  gRNA
agcacuaccacucgcuucca

SEQ ID NO: 1818 - RNA, 20 nt, Artificial Sequence
  MKO10001818_A_9130409I23Rik
  gRNA
ugaucgacgucgggagauau

SEQ ID NO: 1819 - RNA, 20 nt, Artificial Sequence
  MKO10001819_A_9130409I23Rik
  gRNA
auauuugcuaaccucccgau

SEQ ID NO: 1820 - RNA, 20 nt, Artificial Sequence
  MKO10001820_A_9130409I23Rik
  gRNA
caugaggaaacucgcaucac

SEQ ID NO: 1821 - RNA, 20 nt, Artificial Sequence
  MKO10001821_A_9230104L09Rik
  gRNA
acaauauuacuggcucucuc

SEQ ID NO: 1822 - RNA, 20 nt, Artificial Sequence
  MKO10001822_A_9230104L09Rik
  gRNA
gagagccaguaauauugucc

SEQ ID NO: 1823 - RNA, 20 nt, Artificial Sequence
  MKO10001823_A_9230104L09Rik
  gRNA
agcuucacgaagaaaguuug

SEQ ID NO: 1824 - RNA, 20 nt, Artificial Sequence
  MKO10001824_A_9230110C19Rik
  gRNA
gacguuccagcccuaccaaa

SEQ ID NO: 1825 - RNA, 20 nt, Artificial Sequence
  MKO10001825_A_9230110C19Rik
  gRNA
gacagcuaagcugaucuaua

SEQ ID NO: 1826 - RNA, 20 nt, Artificial Sequence
  MKO10001826_A_9230110C19Rik
  gRNA
cccucugcuagguccaugcu

SEQ ID NO: 1827 - RNA, 20 nt, Artificial Sequence
  MKO10001827_A_9230110F15Rik
  gRNA
ccuacacuuucuguugaugc

SEQ ID NO: 1828 - RNA, 20 nt, Artificial Sequence
  MKO10001828_A_9230110F15Rik
  gRNA
uacuuccuauucucacacac

SEQ ID NO: 1829 - RNA, 20 nt, Artificial Sequence
  MKO10001829_A_9230110F15Rik
  gRNA
ccugcaucaacagaaagugu

SEQ ID NO: 1830 - RNA, 20 nt, Artificial Sequence
  MKO10001830_A_9230112D13Rik
  gRNA
acuagaacgaaauccgcagc

SEQ ID NO: 1831 - RNA, 20 nt, Artificial Sequence
  MKO10001831_A_9230112D13Rik
  gRNA
gucuuuggagacgcggcaug

SEQ ID NO: 1832 - RNA, 20 nt, Artificial Sequence
  MKO10001832_A_9230112D13Rik
  gRNA
cgcccaggaaacgccagacg

SEQ ID NO: 1833 - RNA, 20 nt, Artificial Sequence
  MKO10001833_A_9330159F19Rik
  gRNA
cacaacaccguaauuugauc

SEQ ID NO: 1834 - RNA, 20 nt, Artificial Sequence
  MKO10001834_A_9330159F19Rik
  gRNA
cgacgauuugcuggucuagc

SEQ ID NO: 1835 - RNA, 20 nt, Artificial Sequence
  MKO10001835_A_9330159F19Rik
  gRNA
cugcuagaccagcaaaucgu

SEQ ID NO: 1836 - RNA, 20 nt, Artificial Sequence
  MKO10001836_A_9330182L06Rik
  gRNA
cuucuuugaguaccaguacg

SEQ ID NO: 1837 - RNA, 20 nt, Artificial Sequence
  MKO10001837_A_9330182L06Rik
  gRNA
cgccauuccgaauucugcag

SEQ ID NO: 1838 - RNA, 20 nt, Artificial Sequence
  MKO10001838_A_9330182L06Rik
  gRNA
gacucuauauaguucccacg

SEQ ID NO: 1839 - RNA, 20 nt, Artificial Sequence
  MKO10001839_A_9330182O14Rik
  gRNA
ggaguuacuuuccgguuguu

SEQ ID NO: 1840 - RNA, 20 nt, Artificial Sequence
  MKO10001840_A_9330182O14Rik
  gRNA
cucaaugcauuugcuucacg

SEQ ID NO: 1841 - RNA, 20 nt, Artificial Sequence
  MKO10001841_A_9330182O14Rik
  gRNA
uucuagaacuguuaagacga

SEQ ID NO: 1842 - RNA, 20 nt, Artificial Sequence
  MKO10001842_A_9430007A20Rik
  gRNA
aaggaggcacaucaaucgua

SEQ ID NO: 1843 - RNA, 20 nt, Artificial Sequence
  MKO10001843_A_9430007A20Rik
  gRNA
aaaaagaggaugccucgucg

SEQ ID NO: 1844 - RNA, 20 nt, Artificial Sequence
  MKO10001844_A_9430007A20Rik
  gRNA
uugggacgaaagagucuuac

SEQ ID NO: 1845 - RNA, 20 nt, Artificial Sequence
  MKO10001845_A_9430015G10Rik
  gRNA
gggacccucccgacauacaa

SEQ ID NO: 1846 - RNA, 20 nt, Artificial Sequence
  MKO10001846_A_9430015G10Rik
  gRNA
augggagcgcuagcuguguc

SEQ ID NO: 1847 - RNA, 20 nt, Artificial Sequence
  MKO10001847_A_9430015G10Rik
  gRNA
gcgugcagcuucccaugaac

SEQ ID NO: 1848 - RNA, 20 nt, Artificial Sequence
  MKO10001848_A_9430016H08Rik
  gRNA
auccgcgcaaucguccaauc

SEQ ID NO: 1849 - RNA, 20 nt, Artificial Sequence
  MKO10001849_A_9430016H08Rik
  gRNA
agccugauuggacgauugcg

SEQ ID NO: 1850 - RNA, 20 nt, Artificial Sequence
  MKO10001850_A_9430016H08Rik
  gRNA
ggcuccacuuaaagacucac

SEQ ID NO: 1851 - RNA, 20 nt, Artificial Sequence
  MKO10001851_A_9430020K01Rik
  gRNA
gugagcgagacuuuagccca

SEQ ID NO: 1852 - RNA, 20 nt, Artificial Sequence
  MKO10001852_A_9430020K01Rik
  gRNA
acgcugcagcauguauagug

SEQ ID NO: 1853 - RNA, 20 nt, Artificial Sequence
  MKO10001853_A_9430020K01Rik
  gRNA
cccuacagcaucgccgaauu

SEQ ID NO: 1854 - RNA, 20 nt, Artificial Sequence
  MKO10001854_A_9430023L20Rik
  gRNA
cuaugugcgcgucuccucag

SEQ ID NO: 1855 - RNA, 20 nt, Artificial Sequence
  MKO10001855_A_9430023L20Rik
  gRNA
guggacugucaaggugcacg

SEQ ID NO: 1856 - RNA, 20 nt, Artificial Sequence
  MKO10001856_A_9430023L20Rik
  gRNA
gcuggaccgugccuugcgca

SEQ ID NO: 1857 - RNA, 20 nt, Artificial Sequence
  MKO10001857_A_9430038I01Rik
  gRNA
cgucgggccgcuggagacgg

SEQ ID NO: 1858 - RNA, 20 nt, Artificial Sequence
  MKO10001858_A_9430038I01Rik
  gRNA
cuuaccgcguccccugccgc

SEQ ID NO: 1859 - RNA, 20 nt, Artificial Sequence
  MKO10001859_A_9430038I01Rik
  gRNA
acucccccgagauacaccuc

SEQ ID NO: 1860 - RNA, 20 nt, Artificial Sequence
  MKO10001860_A_9430069I07Rik
  gRNA
cacuugcagauguacgagcc

SEQ ID NO: 1861 - RNA, 20 nt, Artificial Sequence
  MKO10001861_A_9430069I07Rik
  gRNA
ccucgucuggaaagcuaucc

SEQ ID NO: 1862 - RNA, 20 nt, Artificial Sequence
  MKO10001862_A_9430069I07Rik
  gRNA
guuccaagacgcugcacaug

SEQ ID NO: 1863 - RNA, 20 nt, Artificial Sequence
  MKO10001863_A_9530002B09Rik
  gRNA
ugguguuaccucgaucccug

SEQ ID NO: 1864 - RNA, 20 nt, Artificial Sequence
  MKO10001864_A_9530002B09Rik
  gRNA
cccgcuacaaauugaaauuu

SEQ ID NO: 1865 - RNA, 20 nt, Artificial Sequence
  MKO10001865_A_9530002B09Rik
  gRNA
gccaaaauuucaauuuguag

SEQ ID NO: 1866 - RNA, 20 nt, Artificial Sequence
  MKO10001866_A_9530003J23Rik
  gRNA
ggucuacgaccgauguucuu

SEQ ID NO: 1867 - RNA, 20 nt, Artificial Sequence
  MKO10001867_A_9530003J23Rik
  gRNA
aucggucguagaccuugccc

SEQ ID NO: 1868 - RNA, 20 nt, Artificial Sequence
  MKO10001868_A_9530003J23Rik
  gRNA
cugccguaguuugugcaaag

SEQ ID NO: 1869 - RNA, 20 nt, Artificial Sequence
  MKO10001869_A_9530053A07Rik
  gRNA
uccgcguacacuucuugacc

SEQ ID NO: 1870 - RNA, 20 nt, Artificial Sequence
  MKO10001870_A_9530053A07Rik
  gRNA
uggcauacggcagcaaucau

SEQ ID NO: 1871 - RNA, 20 nt, Artificial Sequence
  MKO10001871_A_9530053A07Rik
  gRNA
uaugauugcugccguaugcc

SEQ ID NO: 1872 - RNA, 20 nt, Artificial Sequence
  MKO10001872_A_9530068E07Rik
  gRNA
acggagagccggacuacgac

SEQ ID NO: 1873 - RNA, 20 nt, Artificial Sequence
  MKO10001873_A_9530068E07Rik
  gRNA
cuccguagucgccauugucc

SEQ ID NO: 1874 - RNA, 20 nt, Artificial Sequence
  MKO10001874_A_9530068E07Rik
  gRNA
uuuggaccagaacgugaacg

SEQ ID NO: 1875 - RNA, 20 nt, Artificial Sequence
  MKO10001875_A_9530077C05Rik
  gRNA
ucaaacgacgcaaucugacc

SEQ ID NO: 1876 - RNA, 20 nt, Artificial Sequence
  MKO10001876_A_9530077C05Rik
  gRNA
gcauccguuuacuaccguca

SEQ ID NO: 1877 - RNA, 20 nt, Artificial Sequence
  MKO10001877_A_9530077C05Rik
  gRNA
uuaacaaccuucagcaaccg

SEQ ID NO: 1878 - RNA, 20 nt, Artificial Sequence
  MKO10001878_A_9630033F20Rik
  gRNA
aggcguagaugcgccccuuu

SEQ ID NO: 1879 - RNA, 20 nt, Artificial Sequence
  MKO10001879_A_9630033F20Rik
  gRNA
guugcagauguacggagucg

SEQ ID NO: 1880 - RNA, 20 nt, Artificial Sequence
  MKO10001880_A_9630033F20Rik
  gRNA
gccgaaacccagucuccgaa

SEQ ID NO: 1881 - RNA, 20 nt, Artificial Sequence
  MKO10001881_A_9830001H06Rik
  gRNA
ugucguccaucucggcucgc

SEQ ID NO: 1882 - RNA, 20 nt, Artificial Sequence
  MKO10001882_A_9830001H06Rik
  gRNA
auaccgcucggagcacgagc

SEQ ID NO: 1883 - RNA, 20 nt, Artificial Sequence
  MKO10001883_A_9830001H06Rik
  gRNA
agaacgaggggcuucgacag

SEQ ID NO: 1884 - RNA, 20 nt, Artificial Sequence
  MKO10001884_A_9830107B12Rik
  gRNA
agacaacuuguguuaccccu

SEQ ID NO: 1885 - RNA, 20 nt, Artificial Sequence
  MKO10001885_A_9830107B12Rik
  gRNA
cccagaguuacuucgaguac

SEQ ID NO: 1886 - RNA, 20 nt, Artificial Sequence
  MKO10001886_A_9830107B12Rik
  gRNA
cccagugcugcugcugcucc

SEQ ID NO: 1887 - RNA, 20 nt, Artificial Sequence
  MKO10001887_A_9830147E19Rik
  gRNA
gugcuaaagccuuuacucua

SEQ ID NO: 1888 - RNA, 20 nt, Artificial Sequence
  MKO10001888_A_9830147E19Rik
  gRNA
aagcugacuccuuagaguaa

SEQ ID NO: 1889 - RNA, 20 nt, Artificial Sequence
  MKO10001889_A_9830147E19Rik
  gRNA
acuuuaccaagaugucaugc

SEQ ID NO: 1890 - RNA, 20 nt, Artificial Sequence
  MKO10001890_A_9930012K11Rik
  gRNA
gucgcuccaccgcaaagacg

SEQ ID NO: 1891 - RNA, 20 nt, Artificial Sequence
  MKO10001891_A_9930012K11Rik
  gRNA
cccagcuugucugcgcagcg

SEQ ID NO: 1892 - RNA, 20 nt, Artificial Sequence
  MKO10001892_A_9930012K11Rik
  gRNA
gucuuugcgguggagcgacu

SEQ ID NO: 1893 - RNA, 20 nt, Artificial Sequence
  MKO10001893_A_9930013L23Rik
  gRNA
gccaaccuuaccggucagaa

SEQ ID NO: 1894 - RNA, 20 nt, Artificial Sequence
  MKO10001894_A_9930013L23Rik
  gRNA
agcacauugugcugcguacc

SEQ ID NO: 1895 - RNA, 20 nt, Artificial Sequence
  MKO10001895_A_9930013L23Rik
  gRNA
uauuugaaugcagugcccga

SEQ ID NO: 1896 - RNA, 20 nt, Artificial Sequence
  MKO10001896_A_9930021J03Rik
  gRNA
guugaccgacgccuuguuga

SEQ ID NO: 1897 - RNA, 20 nt, Artificial Sequence
  MKO10001897_A_9930021J03Rik
  gRNA
ucggucaacaccucgaaguu

SEQ ID NO: 1898 - RNA, 20 nt, Artificial Sequence
  MKO10001898_A_9930021J03Rik
  gRNA
caaaguaggucuucgaugua

SEQ ID NO: 1899 - RNA, 20 nt, Artificial Sequence
  MKO10001899_A_9930104L06Rik
  gRNA
cacagccgcaugcugcucgu

SEQ ID NO: 1900 - RNA, 20 nt, Artificial Sequence
  MKO10001900_A_9930104L06Rik
  gRNA
gcgguugaggcgcaagcagc

SEQ ID NO: 1901 - RNA, 20 nt, Artificial Sequence
  MKO10001901_A_9930104L06Rik
  gRNA
ucccaugugcucuacgaguc

SEQ ID NO: 1902 - RNA, 20 nt, Artificial Sequence
  MKO10001902_A_9930111J21Rik1
  gRNA
cauuguucuuugugaacaac

SEQ ID NO: 1903 - RNA, 20 nt, Artificial Sequence
  MKO10001903_A_9930111J21Rik1
  gRNA
caaaucccauauugucacau

SEQ ID NO: 1904 - RNA, 20 nt, Artificial Sequence
  MKO10001904_A_9930111J21Rik1
  gRNA
uucuacacccccuccaaaag

SEQ ID NO: 1905 - RNA, 20 nt, Artificial Sequence
  MKO10001905_A_9930111J21Rik2
  gRNA
uucuacacccccuccaaaag

SEQ ID NO: 1906 - RNA, 20 nt, Artificial Sequence
  MKO10001906_A_9930111J21Rik2
  gRNA
auguaacagucucacuagag

SEQ ID NO: 1907 - RNA, 20 nt, Artificial Sequence
  MKO10001907_A_9930111J21Rik2
  gRNA
ucugaagaaaaucgaguuug

SEQ ID NO: 1908 - RNA, 20 nt, Artificial Sequence
  MKO10001908_A_A130010J15Rik
  gRNA
uguuuacugcccggauuucg

SEQ ID NO: 1909 - RNA, 20 nt, Artificial Sequence
  MKO10001909_A_A130010J15Rik
  gRNA
uccgggcaguaaacacccgc

SEQ ID NO: 1910 - RNA, 20 nt, Artificial Sequence
  MKO10001910_A_A130010J15Rik
  gRNA
auuggcgcuccaaaguuauc

SEQ ID NO: 1911 - RNA, 20 nt, Artificial Sequence
  MKO10001911_A_A1bg
  gRNA
ucacaccccgcauugcaacc

SEQ ID NO: 1912 - RNA, 20 nt, Artificial Sequence
  MKO10001912_A_A1bg
  gRNA
ugcaguugauuugccgacua

SEQ ID NO: 1913 - RNA, 20 nt, Artificial Sequence
  MKO10001913_A_A1bg
  gRNA
guccuuucaccugccgcuac

SEQ ID NO: 1914 - RNA, 20 nt, Artificial Sequence
  MKO10001914_A_A1cf
  gRNA
gcauaagguuccuuacguac

SEQ ID NO: 1915 - RNA, 20 nt, Artificial Sequence
  MKO10001915_A_A1cf
  gRNA
guuuaggacuggccgucucu

SEQ ID NO: 1916 - RNA, 20 nt, Artificial Sequence
  MKO10001916_A_A1cf
  gRNA
ggacaauugccgauuguuug

SEQ ID NO: 1917 - RNA, 20 nt, Artificial Sequence
  MKO10001917_A_A230046K03Rik
  gRNA
caucgccaaucaaaucaucu

SEQ ID NO: 1918 - RNA, 20 nt, Artificial Sequence
  MKO10001918_A_A230046K03Rik
  gRNA
augauuugauuggcgauguu

SEQ ID NO: 1919 - RNA, 20 nt, Artificial Sequence
  MKO10001919_A_A230046K03Rik
  gRNA
caaagucaucacuguuuaug

SEQ ID NO: 1920 - RNA, 20 nt, Artificial Sequence
  MKO10001920_A_A230050P20Rik
  gRNA
guacacggcgccaccauaca

SEQ ID NO: 1921 - RNA, 20 nt, Artificial Sequence
  MKO10001921_A_A230050P20Rik
  gRNA
cgccuccgggagaaguuuca

SEQ ID NO: 1922 - RNA, 20 nt, Artificial Sequence
  MKO10001922_A_A230050P20Rik
  gRNA
cacgauagagcgcccaacuc

SEQ ID NO: 1923 - RNA, 20 nt, Artificial Sequence
  MKO10001923_A_A230065H16Rik
  gRNA
ucagcgacugcccucuauug

SEQ ID NO: 1924 - RNA, 20 nt, Artificial Sequence
  MKO10001924_A_A230065H16Rik
  gRNA
gccacacccgcaucuguuac

SEQ ID NO: 1925 - RNA, 20 nt, Artificial Sequence
  MKO10001925_A_A230065H16Rik
  gRNA
gagagguaccccucagaucc

SEQ ID NO: 1926 - RNA, 20 nt, Artificial Sequence
  MKO10001926_A_A2m
  gRNA
uuuccacccccuuaaugaau

SEQ ID NO: 1927 - RNA, 20 nt, Artificial Sequence
  MKO10001927_A_A2m
  gRNA
cccacagucuucauccaaug

SEQ ID NO: 1928 - RNA, 20 nt, Artificial Sequence
  MKO10001928_A_A2m
  gRNA
gagauuucguguugucucau

SEQ ID NO: 1929 - RNA, 20 nt, Artificial Sequence
  MKO10001929_A_A330021E22Rik
  gRNA
aucugugccaaaucucuuag

SEQ ID NO: 1930 - RNA, 20 nt, Artificial Sequence
  MKO10001930_A_A330021E22Rik
  gRNA
augauacgauuaagguccau

SEQ ID NO: 1931 - RNA, 20 nt, Artificial Sequence
  MKO10001931_A_A330021E22Rik
  gRNA
ugcuaauucauuugcacuuc

SEQ ID NO: 1932 - RNA, 20 nt, Artificial Sequence
  MKO10001932_A_A330050F15Rik
  gRNA
gaagucaugguguucgcucc

SEQ ID NO: 1933 - RNA, 20 nt, Artificial Sequence
  MKO10001933_A_A330050F15Rik
  gRNA
agacuugccgcauggcuugc

SEQ ID NO: 1934 - RNA, 20 nt, Artificial Sequence
  MKO10001934_A_A330050F15Rik
  gRNA
auucuggacaaucugcuugc

SEQ ID NO: 1935 - RNA, 20 nt, Artificial Sequence
  MKO10001935_A_A330070K13Rik
  gRNA
gcaucauugguccagccuau

SEQ ID NO: 1936 - RNA, 20 nt, Artificial Sequence
  MKO10001936_A_A330070K13Rik
  gRNA
aguagagugccaaccauuga

SEQ ID NO: 1937 - RNA, 20 nt, Artificial Sequence
  MKO10001937_A_A330070K13Rik
  gRNA
aaugaugcagcccuagucug

SEQ ID NO: 1938 - RNA, 20 nt, Artificial Sequence
  MKO10001938_A_A3galt2
  gRNA
cgaucgcuugucccucucgu

SEQ ID NO: 1939 - RNA, 20 nt, Artificial Sequence
  MKO10001939_A_A3galt2
  gRNA
ugccgccaaacaccgcagcg

SEQ ID NO: 1940 - RNA, 20 nt, Artificial Sequence
  MKO10001940_A_A3galt2
  gRNA
agacggcggaaccucaccau

SEQ ID NO: 1941 - RNA, 20 nt, Artificial Sequence
  MKO10001941_A_A430005L14Rik
  gRNA
uucccgaagaagcgacucac

SEQ ID NO: 1942 - RNA, 20 nt, Artificial Sequence
  MKO10001942_A_A430005L14Rik
  gRNA
augccugugagucgcuucuu

SEQ ID NO: 1943 - RNA, 20 nt, Artificial Sequence
  MKO10001943_A_A430005L14Rik
  gRNA
ccucagcacgccuucgggcc

SEQ ID NO: 1944 - RNA, 20 nt, Artificial Sequence
  MKO10001944_A_A430033K04Rik
  gRNA
ucaacuccccuagaugagcg

SEQ ID NO: 1945 - RNA, 20 nt, Artificial Sequence
  MKO10001945_A_A430033K04Rik
  gRNA
cgcggugacgcuguaagugc

SEQ ID NO: 1946 - RNA, 20 nt, Artificial Sequence
  MKO10001946_A_A430033K04Rik
  gRNA
ugauaagccgcgcucaucua

SEQ ID NO: 1947 - RNA, 20 nt, Artificial Sequence
  MKO10001947_A_A430078G23Rik
  gRNA
gggccccuaagccuagaucc

SEQ ID NO: 1948 - RNA, 20 nt, Artificial Sequence
  MKO10001948_A_A430078G23Rik
  gRNA
cccugccacaaagacgcagc

SEQ ID NO: 1949 - RNA, 20 nt, Artificial Sequence
  MKO10001949_A_A430078G23Rik
  gRNA
guucugcccaccuugcuuga

SEQ ID NO: 1950 - RNA, 20 nt, Artificial Sequence
  MKO10001950_A_A430089I19Rik
  gRNA
uccugacaggggaaaacuuc

SEQ ID NO: 1951 - RNA, 20 nt, Artificial Sequence
  MKO10001951_A_A430089I19Rik
  gRNA
uccguccacucuccagaauc

SEQ ID NO: 1952 - RNA, 20 nt, Artificial Sequence
  MKO10001952_A_A430089I19Rik
  gRNA
uccaucuagcacagccugca

SEQ ID NO: 1953 - RNA, 20 nt, Artificial Sequence
  MKO10001953_A_A430105I19Rik
  gRNA
aagccgaguccacaaugcgc

SEQ ID NO: 1954 - RNA, 20 nt, Artificial Sequence
  MKO10001954_A_A430105I19Rik
  gRNA
gcaagggugcacgccagcuc

SEQ ID NO: 1955 - RNA, 20 nt, Artificial Sequence
  MKO10001955_A_A430105I19Rik
  gRNA
ugagacuuacaccgggaacc

SEQ ID NO: 1956 - RNA, 20 nt, Artificial Sequence
  MKO10001956_A_A430107P09Rik
  gRNA
agauugccucucagugcaac

SEQ ID NO: 1957 - RNA, 20 nt, Artificial Sequence
  MKO10001957_A_A430107P09Rik
  gRNA
aaaaacugcccguguuugaa

SEQ ID NO: 1958 - RNA, 20 nt, Artificial Sequence
  MKO10001958_A_A430107P09Rik
  gRNA
aagaugccucagugcugugg

SEQ ID NO: 1959 - RNA, 20 nt, Artificial Sequence
  MKO10001959_A_A4galt
  gRNA
uaugugucguagggcaauag

SEQ ID NO: 1960 - RNA, 20 nt, Artificial Sequence
  MKO10001960_A_A4galt
  gRNA
gugccgugccuccgaguacc

SEQ ID NO: 1961 - RNA, 20 nt, Artificial Sequence
  MKO10001961_A_A4galt
  gRNA
gcucaaccugaccaacacgc

SEQ ID NO: 1962 - RNA, 20 nt, Artificial Sequence
  MKO10001962_A_A4gnt
  gRNA
gaacccaaauaccccguuac

SEQ ID NO: 1963 - RNA, 20 nt, Artificial Sequence
  MKO10001963_A_A4gnt
  gRNA
guuccacaaaugcagugcgu

SEQ ID NO: 1964 - RNA, 20 nt, Artificial Sequence
  MKO10001964_A_A4gnt
  gRNA
ugcuguaccagcucaccaug

SEQ ID NO: 1965 - RNA, 20 nt, Artificial Sequence
  MKO10001965_A_A530016L24Rik
  gRNA
ucgcccuaaucuugcgccug

SEQ ID NO: 1966 - RNA, 20 nt, Artificial Sequence
  MKO10001966_A_A530016L24Rik
  gRNA
uuggauggcauguccgcggg

SEQ ID NO: 1967 - RNA, 20 nt, Artificial Sequence
  MKO10001967_A_A530016L24Rik
  gRNA
cucgcucuaauucccacccg

SEQ ID NO: 1968 - RNA, 20 nt, Artificial Sequence
  MKO10001968_A_A530032D15Rik
  gRNA
guccccuaggacaaucccag

SEQ ID NO: 1969 - RNA, 20 nt, Artificial Sequence
  MKO10001969_A_A530032D15Rik
  gRNA
ucugcuccgagaugaagucu

SEQ ID NO: 1970 - RNA, 20 nt, Artificial Sequence
  MKO10001970_A_A530032D15Rik
  gRNA
ucaagaaacauguaagaacc

SEQ ID NO: 1971 - RNA, 20 nt, Artificial Sequence
  MKO10001971_A_A530054K11Rik
  gRNA
ucugagauggaguucggugc

SEQ ID NO: 1972 - RNA, 20 nt, Artificial Sequence
  MKO10001972_A_A530054K11Rik
  gRNA
ugacauaccccggagcauag

SEQ ID NO: 1973 - RNA, 20 nt, Artificial Sequence
  MKO10001973_A_A530054K11Rik
  gRNA
ucagaccugaaagaaggcgc

SEQ ID NO: 1974 - RNA, 20 nt, Artificial Sequence
  MKO10001974_A_A530064D06Rik
  gRNA
cuuacaccagaucuucucgc

SEQ ID NO: 1975 - RNA, 20 nt, Artificial Sequence
  MKO10001975_A_A530064D06Rik
  gRNA
accacuccagcgagaagauc

SEQ ID NO: 1976 - RNA, 20 nt, Artificial Sequence
  MKO10001976_A_A530064D06Rik
  gRNA
agcuuaguuagccuuguagc

SEQ ID NO: 1977 - RNA, 20 nt, Artificial Sequence
  MKO10001977_A_A530099J19Rik
  gRNA
aucacauccaugguugaucg

SEQ ID NO: 1978 - RNA, 20 nt, Artificial Sequence
  MKO10001978_A_A530099J19Rik
  gRNA
guuacaaaaguuccaugccg

SEQ ID NO: 1979 - RNA, 20 nt, Artificial Sequence
  MKO10001979_A_A530099J19Rik
  gRNA
cuucuaguugugaucgaucc

SEQ ID NO: 1980 - RNA, 20 nt, Artificial Sequence
  MKO10001980_A_A630001G21Rik
  gRNA
uuaugaaucucucuuaacgc

SEQ ID NO: 1981 - RNA, 20 nt, Artificial Sequence
  MKO10001981_A_A630001G21Rik
  gRNA
cugaggacucuucccccccg

SEQ ID NO: 1982 - RNA, 20 nt, Artificial Sequence
  MKO10001982_A_A630001G21Rik
  gRNA
ugucggacucaucguuucua

SEQ ID NO: 1983 - RNA, 20 nt, Artificial Sequence
  MKO10001983_A_A630007B06Rik
  gRNA
gcagcaacucuaugaaucga

SEQ ID NO: 1984 - RNA, 20 nt, Artificial Sequence
  MKO10001984_A_A630007B06Rik
  gRNA
cugugcgacuagcugaucuu

SEQ ID NO: 1985 - RNA, 20 nt, Artificial Sequence
  MKO10001985_A_A630007B06Rik
  gRNA
gaaauaccugguccauccgc

SEQ ID NO: 1986 - RNA, 20 nt, Artificial Sequence
  MKO10001986_A_A630023A22Rik
  gRNA
cagugcggagcuucagaccg

SEQ ID NO: 1987 - RNA, 20 nt, Artificial Sequence
  MKO10001987_A_A630023A22Rik
  gRNA
agccuccgauaccauggucc

SEQ ID NO: 1988 - RNA, 20 nt, Artificial Sequence
  MKO10001988_A_A630023A22Rik
  gRNA
ugguaauucaggucagcauc

SEQ ID NO: 1989 - RNA, 20 nt, Artificial Sequence
  MKO10001989_A_A630033H20Rik
  gRNA
guacuuuggaaauucgucag

SEQ ID NO: 1990 - RNA, 20 nt, Artificial Sequence
  MKO10001990_A_A630033H20Rik
  gRNA
gaaucgugcuuugcugauuu

SEQ ID NO: 1991 - RNA, 20 nt, Artificial Sequence
  MKO10001991_A_A630033H20Rik
  gRNA
ccagucauguuugcauugua

SEQ ID NO: 1992 - RNA, 20 nt, Artificial Sequence
  MKO10001992_A_A630073D07Rik
  gRNA
gaucaccaacagggaauagu

SEQ ID NO: 1993 - RNA, 20 nt, Artificial Sequence
  MKO10001993_A_A630073D07Rik
  gRNA
gaucacucaaaucuucuugc

SEQ ID NO: 1994 - RNA, 20 nt, Artificial Sequence
  MKO10001994_A_A630073D07Rik
  gRNA
ccuacucauugcagucuugc

SEQ ID NO: 1995 - RNA, 20 nt, Artificial Sequence
  MKO10001995_A_A630076J17Rik
  gRNA
gcgccaucucguggacaaug

SEQ ID NO: 1996 - RNA, 20 nt, Artificial Sequence
  MKO10001996_A_A630076J17Rik
  gRNA
cuuccacauuguccacgaga

SEQ ID NO: 1997 - RNA, 20 nt, Artificial Sequence
  MKO10001997_A_A630076J17Rik
  gRNA
gcugagugauacuccgugcu

SEQ ID NO: 1998 - RNA, 20 nt, Artificial Sequence
  MKO10001998_A_A630095E13Rik
  gRNA
gcuuuacggcuacucuauaa

SEQ ID NO: 1999 - RNA, 20 nt, Artificial Sequence
  MKO10001999_A_A630095E13Rik
  gRNA
ucagauggcaaauuccaaua

SEQ ID NO: 2000 - RNA, 20 nt, Artificial Sequence
  MKO10002000_A_A630095E13Rik
  gRNA
uugcgggugggcuuucugca

SEQ ID NO: 2001 - RNA, 20 nt, Artificial Sequence
  MKO10002001_A_A630095N17Rik
  gRNA
aaacggcugccucgguguca

SEQ ID NO: 2002 - RNA, 20 nt, Artificial Sequence
  MKO10002002_A_A630095N17Rik
  gRNA
auggccgagaaccccaccuu

SEQ ID NO: 2003 - RNA, 20 nt, Artificial Sequence
  MKO10002003_A_A630095N17Rik
  gRNA
caugugaagccaugacaccg

SEQ ID NO: 2004 - RNA, 20 nt, Artificial Sequence
  MKO10002004_A_A730008H23Rik
  gRNA
gaagucaccuucgcccgcug

SEQ ID NO: 2005 - RNA, 20 nt, Artificial Sequence
  MKO10002005_A_A730008H23Rik
  gRNA
uaaaccgugagcgagaaaau

SEQ ID NO: 2006 - RNA, 20 nt, Artificial Sequence
  MKO10002006_A_A730008H23Rik
  gRNA
cguacccuggggcgucucgu

SEQ ID NO: 2007 - RNA, 20 nt, Artificial Sequence
  MKO10002007_A_A730017C20Rik
  gRNA
uuccacccggaaaucucgcg

SEQ ID NO: 2008 - RNA, 20 nt, Artificial Sequence
  MKO10002008_A_A730017C20Rik
  gRNA
uugggggauacguacacucc

SEQ ID NO: 2009 - RNA, 20 nt, Artificial Sequence
  MKO10002009_A_A730017C20Rik
  gRNA
ggcuagccucgcgagauuuc

SEQ ID NO: 2010 - RNA, 20 nt, Artificial Sequence
  MKO10002010_A_A830010M20Rik
  gRNA
ccauacguuagugauucccc

SEQ ID NO: 2011 - RNA, 20 nt, Artificial Sequence
  MKO10002011_A_A830010M20Rik
  gRNA
uaccuuaggucuugccccug

SEQ ID NO: 2012 - RNA, 20 nt, Artificial Sequence
  MKO10002012_A_A830010M20Rik
  gRNA
uuuauagcugcacuugacaa

SEQ ID NO: 2013 - RNA, 20 nt, Artificial Sequence
  MKO10002013_A_A830018L16Rik
  gRNA
uccgccaguuccacuuaaga

SEQ ID NO: 2014 - RNA, 20 nt, Artificial Sequence
  MKO10002014_A_A830018L16Rik
  gRNA
ugggcagaaagugaaucauc

SEQ ID NO: 2015 - RNA, 20 nt, Artificial Sequence
  MKO10002015_A_A830018L16Rik
  gRNA
ggucaguagaccaucuuaag

SEQ ID NO: 2016 - RNA, 20 nt, Artificial Sequence
  MKO10002016_A_A830080D01Rik
  gRNA
cgaugauacgaauucacacg

SEQ ID NO: 2017 - RNA, 20 nt, Artificial Sequence
  MKO10002017_A_A830080D01Rik
  gRNA
cucgugugaauucguaucau

SEQ ID NO: 2018 - RNA, 20 nt, Artificial Sequence
  MKO10002018_A_A830080D01Rik
  gRNA
uggagccuugcaaugacaaa

SEQ ID NO: 2019 - RNA, 20 nt, Artificial Sequence
  MKO10002019_A_A930009A15Rik
  gRNA
ugauacauagggaccuugac

SEQ ID NO: 2020 - RNA, 20 nt, Artificial Sequence
  MKO10002020_A_A930009A15Rik
  gRNA
cugccaagcaagucgcacaa

SEQ ID NO: 2021 - RNA, 20 nt, Artificial Sequence
  MKO10002021_A_A930009A15Rik
  gRNA
ggaagaugugacgucacucu

SEQ ID NO: 2022 - RNA, 20 nt, Artificial Sequence
  MKO10002022_A_A930018P22Rik
  gRNA
cgagauggcaacuucggccc

SEQ ID NO: 2023 - RNA, 20 nt, Artificial Sequence
  MKO10002023_A_A930018P22Rik
  gRNA
augccccggucguagagcga

SEQ ID NO: 2024 - RNA, 20 nt, Artificial Sequence
  MKO10002024_A_A930018P22Rik
  gRNA
uuucaucuuucagcgccuuc

SEQ ID NO: 2025 - RNA, 20 nt, Artificial Sequence
  MKO10002025_A_AA414768
  gRNA
acccaucuucgccgccgaua

SEQ ID NO: 2026 - RNA, 20 nt, Artificial Sequence
  MKO10002026_A_AA414768
  gRNA
ucagaaggcgaccaucgaag

SEQ ID NO: 2027 - RNA, 20 nt, Artificial Sequence
  MKO10002027_A_AA414768
  gRNA
ccuagcguccaucuucgacc

SEQ ID NO: 2028 - RNA, 20 nt, Artificial Sequence
  MKO10002028_A_AA415398
  gRNA
accaccucugucaggacauu

SEQ ID NO: 2029 - RNA, 20 nt, Artificial Sequence
  MKO10002029_A_AA415398
  gRNA
ugauccuaauguccugacag

SEQ ID NO: 2030 - RNA, 20 nt, Artificial Sequence
  MKO10002030_A_AA415398
  gRNA
caacugcuggaccuccccac

SEQ ID NO: 2031 - RNA, 20 nt, Artificial Sequence
  MKO10002031_A_AA467197
  gRNA
ugcguugaaaaaaaccgacg

SEQ ID NO: 2032 - RNA, 20 nt, Artificial Sequence
  MKO10002032_A_AA467197
  gRNA
uuuauaagcguggccgccac

SEQ ID NO: 2033 - RNA, 20 nt, Artificial Sequence
  MKO10002033_A_AA467197
  gRNA
gcaaucaucugguugcccuc

SEQ ID NO: 2034 - RNA, 20 nt, Artificial Sequence
  MKO10002034_A_AA792892
  gRNA
uccaucuagcagagcuugca

SEQ ID NO: 2035 - RNA, 20 nt, Artificial Sequence
  MKO10002035_A_AA792892
  gRNA
agcuuugaucaaguccucuc

SEQ ID NO: 2036 - RNA, 20 nt, Artificial Sequence
  MKO10002036_A_AA792892
  gRNA
ugaaaacaagaacaaaguau

SEQ ID NO: 2037 - RNA, 20 nt, Artificial Sequence
  MKO10002037_A_AA986860
  gRNA
ccagcgccuuucguaauucc

SEQ ID NO: 2038 - RNA, 20 nt, Artificial Sequence
  MKO10002038_A_AA986860
  gRNA
gguagggcucggaaacuccg

SEQ ID NO: 2039 - RNA, 20 nt, Artificial Sequence
  MKO10002039_A_AA986860
  gRNA
ccggggccgggaauuacgaa

SEQ ID NO: 2040 - RNA, 20 nt, Artificial Sequence
  MKO10002040_A_AA987161
  gRNA
ucacuucuaagucaauuauc

SEQ ID NO: 2041 - RNA, 20 nt, Artificial Sequence
  MKO10002041_A_AA987161
  gRNA
cuaauaguaaugaugcaaug

SEQ ID NO: 2042 - RNA, 20 nt, Artificial Sequence
  MKO10002042_A_AA987161
  gRNA
uuaugacaaucuuguguucc

SEQ ID NO: 2043 - RNA, 20 nt, Artificial Sequence
  MKO10002043_A_AB124611
  gRNA
ccaccucucccccucggaac

SEQ ID NO: 2044 - RNA, 20 nt, Artificial Sequence
  MKO10002044_A_AB124611
  gRNA
uacaucucgugcacagcccc

SEQ ID NO: 2045 - RNA, 20 nt, Artificial Sequence
  MKO10002045_A_AB124611
  gRNA
cagaucaacuucaccaauac

SEQ ID NO: 2046 - RNA, 20 nt, Artificial Sequence
  MKO10002046_A_AF067061
  gRNA
uuguagcuuuccacaucucc

SEQ ID NO: 2047 - RNA, 20 nt, Artificial Sequence
  MKO10002047_A_AF067061
  gRNA
uccagccauccucagagcaa

SEQ ID NO: 2048 - RNA, 20 nt, Artificial Sequence
  MKO10002048_A_AF067061
  gRNA
acaugcagugcccagugcac

SEQ ID NO: 2049 - RNA, 20 nt, Artificial Sequence
  MKO10002049_A_AF067063
  gRNA
gucccagcuuucaaguacac

SEQ ID NO: 2050 - RNA, 20 nt, Artificial Sequence
  MKO10002050_A_AF067063
  gRNA
uucccuguguacuugaaagc

SEQ ID NO: 2051 - RNA, 20 nt, Artificial Sequence
  MKO10002051_A_AF067063
  gRNA
cccugagaccacgauauucc

SEQ ID NO: 2052 - RNA, 20 nt, Artificial Sequence
  MKO10002052_A_AF251705
  gRNA
aacagcgccugugauagugc

SEQ ID NO: 2053 - RNA, 20 nt, Artificial Sequence
  MKO10002053_A_AF251705
  gRNA
cagugugucaugucaauacg

SEQ ID NO: 2054 - RNA, 20 nt, Artificial Sequence
  MKO10002054_A_AF251705
  gRNA
acagguucgagccuugagag

SEQ ID NO: 2055 - RNA, 20 nt, Artificial Sequence
  MKO10002055_A_AF366264
  gRNA
augaucugagcccauguuuc

SEQ ID NO: 2056 - RNA, 20 nt, Artificial Sequence
  MKO10002056_A_AF366264
  gRNA
ggcccagaagaagacuucuc

SEQ ID NO: 2057 - RNA, 20 nt, Artificial Sequence
  MKO10002057_A_AF366264
  gRNA
aagcccgaagcuucagcaau

SEQ ID NO: 2058 - RNA, 20 nt, Artificial Sequence
  MKO10002058_A_AF529169
  gRNA
gucggaccggcaagacucaa

SEQ ID NO: 2059 - RNA, 20 nt, Artificial Sequence
  MKO10002059_A_AF529169
  gRNA
gucaggccaaguacggugac

SEQ ID NO: 2060 - RNA, 20 nt, Artificial Sequence
  MKO10002060_A_AF529169
  gRNA
gcucggaacuccggugacaa

SEQ ID NO: 2061 - RNA, 20 nt, Artificial Sequence
  MKO10002061_A_AI118078
  gRNA
acucuucguccaaauucgac

SEQ ID NO: 2062 - RNA, 20 nt, Artificial Sequence
  MKO10002062_A_AI118078
  gRNA
agccaggggcaggucccgau

SEQ ID NO: 2063 - RNA, 20 nt, Artificial Sequence
  MKO10002063_A_AI118078
  gRNA
uccccaguaccacgauccgu

SEQ ID NO: 2064 - RNA, 20 nt, Artificial Sequence
  MKO10002064_A_AI182371
  gRNA
gcuccaacucggaagacaau

SEQ ID NO: 2065 - RNA, 20 nt, Artificial Sequence
  MKO10002065_A_AI182371
  gRNA
accccaauugucuuccgagu

SEQ ID NO: 2066 - RNA, 20 nt, Artificial Sequence
  MKO10002066_A_AI182371
  gRNA
caggccaaacaguuaucuga

SEQ ID NO: 2067 - RNA, 20 nt, Artificial Sequence
  MKO10002067_A_AI314180
  gRNA
auauuauagaucagcucgaa

SEQ ID NO: 2068 - RNA, 20 nt, Artificial Sequence
  MKO10002068_A_AI314180
  gRNA
cccuacgcuucuuacugcca

SEQ ID NO: 2069 - RNA, 20 nt, Artificial Sequence
  MKO10002069_A_AI314180
  gRNA
ugaaccaauaguguuucuac

SEQ ID NO: 2070 - RNA, 20 nt, Artificial Sequence
  MKO10002070_A_AI317395
  gRNA
aaagagaaccccgccaauca

SEQ ID NO: 2071 - RNA, 20 nt, Artificial Sequence
  MKO10002071_A_AI317395
  gRNA
cgcugcaguugccaccauug

SEQ ID NO: 2072 - RNA, 20 nt, Artificial Sequence
  MKO10002072_A_AI317395
  gRNA
cgugccacuggguucuuguc

SEQ ID NO: 2073 - RNA, 20 nt, Artificial Sequence
  MKO10002073_A_AI413582
  gRNA
gacagugcccaaugcccccc

SEQ ID NO: 2074 - RNA, 20 nt, Artificial Sequence
  MKO10002074_A_AI413582
  gRNA
gcccaccauagagucgcugu

SEQ ID NO: 2075 - RNA, 20 nt, Artificial Sequence
  MKO10002075_A_AI413582
  gRNA
ccugacaggugguucauggc

SEQ ID NO: 2076 - RNA, 20 nt, Artificial Sequence
  MKO10002076_A_AI429214
  gRNA
gaguagcacagacguccguc

SEQ ID NO: 2077 - RNA, 20 nt, Artificial Sequence
  MKO10002077_A_AI429214
  gRNA
guacgaucccugaugaacug

SEQ ID NO: 2078 - RNA, 20 nt, Artificial Sequence
  MKO10002078_A_AI429214
  gRNA
ggaaaacacgagagcgacuc

SEQ ID NO: 2079 - RNA, 20 nt, Artificial Sequence
  MKO10002079_A_AI462493
  gRNA
gcccgcaggagaugccggaa

SEQ ID NO: 2080 - RNA, 20 nt, Artificial Sequence
  MKO10002080_A_AI462493
  gRNA
gguagccaucaccaguuccg

SEQ ID NO: 2081 - RNA, 20 nt, Artificial Sequence
  MKO10002081_A_AI462493
  gRNA
gguggcucguaaagcacuug

SEQ ID NO: 2082 - RNA, 20 nt, Artificial Sequence
  MKO10002082_A_AI464131
  gRNA
cgcguugccaccuaucauau

SEQ ID NO: 2083 - RNA, 20 nt, Artificial Sequence
  MKO10002083_A_AI464131
  gRNA
uauucaucugacgccgcauu

SEQ ID NO: 2084 - RNA, 20 nt, Artificial Sequence
  MKO10002084_A_AI464131
  gRNA
gccuacccccgacaucgacc

SEQ ID NO: 2085 - RNA, 20 nt, Artificial Sequence
  MKO10002085_A_AI467606
  gRNA
agcgugcccccacccuaguc

SEQ ID NO: 2086 - RNA, 20 nt, Artificial Sequence
  MKO10002086_A_AI467606
  gRNA
gagcgcucugaggauuggua

SEQ ID NO: 2087 - RNA, 20 nt, Artificial Sequence
  MKO10002087_A_AI467606
  gRNA
gagggaaggccggaccagcg

SEQ ID NO: 2088 - RNA, 20 nt, Artificial Sequence
  MKO10002088_A_AI593442
  gRNA
cuuuccacauccacaagcgu

SEQ ID NO: 2089 - RNA, 20 nt, Artificial Sequence
  MKO10002089_A_AI593442
  gRNA
uaugagcgagaucauugcag

SEQ ID NO: 2090 - RNA, 20 nt, Artificial Sequence
  MKO10002090_A_AI593442
  gRNA
ugguggcacuugcaucacgc

SEQ ID NO: 2091 - RNA, 20 nt, Artificial Sequence
  MKO10002091_A_AI597468
  gRNA
gucacacgagacaacauucc

SEQ ID NO: 2092 - RNA, 20 nt, Artificial Sequence
  MKO10002092_A_AI597468
  gRNA
guaaacaaagugcccuuauc

SEQ ID NO: 2093 - RNA, 20 nt, Artificial Sequence
  MKO10002093_A_AI597468
  gRNA
cuucuggggguucaucacua

SEQ ID NO: 2094 - RNA, 20 nt, Artificial Sequence
  MKO10002094_A_AI597479
  gRNA
gcuggacguaaaggucggua

SEQ ID NO: 2095 - RNA, 20 nt, Artificial Sequence
  MKO10002095_A_AI597479
  gRNA
aggccccucauuguguucga

SEQ ID NO: 2096 - RNA, 20 nt, Artificial Sequence
  MKO10002096_A_AI597479
  gRNA
cggucgcagcuguacggacg

SEQ ID NO: 2097 - RNA, 20 nt, Artificial Sequence
  MKO10002097_A_AI607873
  gRNA
aacaccauccaauagucucc

SEQ ID NO: 2098 - RNA, 20 nt, Artificial Sequence
  MKO10002098_A_AI607873
  gRNA
ggaaaaggccuucccaguac

SEQ ID NO: 2099 - RNA, 20 nt, Artificial Sequence
  MKO10002099_A_AI607873
  gRNA
gguguugguggugccauaag

SEQ ID NO: 2100 - RNA, 20 nt, Artificial Sequence
  MKO10002100_A_AI661453
  gRNA
ucguggccgggcuuucagcg

SEQ ID NO: 2101 - RNA, 20 nt, Artificial Sequence
  MKO10002101_A_AI661453
  gRNA
uggggccccaauccgacucc

SEQ ID NO: 2102 - RNA, 20 nt, Artificial Sequence
  MKO10002102_A_AI661453
  gRNA
gaguugacccgucgcaucuc

SEQ ID NO: 2103 - RNA, 20 nt, Artificial Sequence
  MKO10002103_A_AI747448
  gRNA
ggaauuaguucugcaccuuc

SEQ ID NO: 2104 - RNA, 20 nt, Artificial Sequence
  MKO10002104_A_AI747448
  gRNA
auucauacccgugauaccug

SEQ ID NO: 2105 - RNA, 20 nt, Artificial Sequence
  MKO10002105_A_AI747448
  gRNA
gggcucaucucugcccucga

SEQ ID NO: 2106 - RNA, 20 nt, Artificial Sequence
  MKO10002106_A_AI836003
  gRNA
acacgucguccgacagaacc

SEQ ID NO: 2107 - RNA, 20 nt, Artificial Sequence
  MKO10002107_A_AI836003
  gRNA
acgacgugugcgccaaccag

SEQ ID NO: 2108 - RNA, 20 nt, Artificial Sequence
  MKO10002108_A_AI836003
  gRNA
uggcaugucgccgccguccu

SEQ ID NO: 2109 - RNA, 20 nt, Artificial Sequence
  MKO10002109_A_AI837181
  gRNA
guuccgcgccaacccaacuu

SEQ ID NO: 2110 - RNA, 20 nt, Artificial Sequence
  MKO10002110_A_AI837181
  gRNA
aacggagccgggcccgaagu

SEQ ID NO: 2111 - RNA, 20 nt, Artificial Sequence
  MKO10002111_A_AI837181
  gRNA
gcaucuaccgagccaaccgc

SEQ ID NO: 2112 - RNA, 20 nt, Artificial Sequence
  MKO10002112_A_AI846148
  gRNA
caguggacgggcgcugugca

SEQ ID NO: 2113 - RNA, 20 nt, Artificial Sequence
  MKO10002113_A_AI846148
  gRNA
agcgcccguccacugccucc

SEQ ID NO: 2114 - RNA, 20 nt, Artificial Sequence
  MKO10002114_A_AI846148
  gRNA
guuaccccugucauagagca

SEQ ID NO: 2115 - RNA, 20 nt, Artificial Sequence
  MKO10002115_A_AI848285
  gRNA
ugucgccgcucuacucgugc

SEQ ID NO: 2116 - RNA, 20 nt, Artificial Sequence
  MKO10002116_A_AI848285
  gRNA
uacguaacccggaggggccc

SEQ ID NO: 2117 - RNA, 20 nt, Artificial Sequence
  MKO10002117_A_AI848285
  gRNA
ccgcgggcccgucuccguag

SEQ ID NO: 2118 - RNA, 20 nt, Artificial Sequence
  MKO10002118_A_AI987944
  gRNA
uugaagagaagcccgaugaa

SEQ ID NO: 2119 - RNA, 20 nt, Artificial Sequence
  MKO10002119_A_AI987944
  gRNA
agccaugaagguauucaaca

SEQ ID NO: 2120 - RNA, 20 nt, Artificial Sequence
  MKO10002120_A_AI987944
  gRNA
guugaaaauguucacuauua

SEQ ID NO: 2121 - RNA, 20 nt, Artificial Sequence
  MKO10002121_A_AK010878
  gRNA
gcgaguacgucgguugugac

SEQ ID NO: 2122 - RNA, 20 nt, Artificial Sequence
  MKO10002122_A_AK010878
  gRNA
gcggcuacgaguguccugug

SEQ ID NO: 2123 - RNA, 20 nt, Artificial Sequence
  MKO10002123_A_AK010878
  gRNA
uaacacuauuguuaagaugc

SEQ ID NO: 2124 - RNA, 20 nt, Artificial Sequence
  MKO10002124_A_AK129341
  gRNA
ucgagcacguaaauauuuca

SEQ ID NO: 2125 - RNA, 20 nt, Artificial Sequence
  MKO10002125_A_AK129341
  gRNA
acucaccgccaauuuguugc

SEQ ID NO: 2126 - RNA, 20 nt, Artificial Sequence
  MKO10002126_A_AK129341
  gRNA
gugucuccuccaguuuaagc

SEQ ID NO: 2127 - RNA, 20 nt, Artificial Sequence
  MKO10002127_A_AU015228
  gRNA
uguuaugcaucgcaccucgc

SEQ ID NO: 2128 - RNA, 20 nt, Artificial Sequence
  MKO10002128_A_AU015228
  gRNA
ccgaaaaacgcgcugacuua

SEQ ID NO: 2129 - RNA, 20 nt, Artificial Sequence
  MKO10002129_A_AU015228
  gRNA
aaaagaugcccgcgugcuuu

SEQ ID NO: 2130 - RNA, 20 nt, Artificial Sequence
  MKO10002130_A_AU018091
  gRNA
gccgccggcgaaccaacuuc

SEQ ID NO: 2131 - RNA, 20 nt, Artificial Sequence
  MKO10002131_A_AU018091
  gRNA
uucgacuguauugcgaguac

SEQ ID NO: 2132 - RNA, 20 nt, Artificial Sequence
  MKO10002132_A_AU018091
  gRNA
agaccaagcgcaaaaaaguc

SEQ ID NO: 2133 - RNA, 20 nt, Artificial Sequence
  MKO10002133_A_AU018829
  gRNA
accaucuagcagagcuugca

SEQ ID NO: 2134 - RNA, 20 nt, Artificial Sequence
  MKO10002134_A_AU018829
  gRNA
ccacacuccagaagcgagca

SEQ ID NO: 2135 - RNA, 20 nt, Artificial Sequence
  MKO10002135_A_AU018829
  gRNA
cuuacccuaggaucugaugc

SEQ ID NO: 2136 - RNA, 20 nt, Artificial Sequence
  MKO10002136_A_AU019823
  gRNA
augaauccaauauaccagac

SEQ ID NO: 2137 - RNA, 20 nt, Artificial Sequence
  MKO10002137_A_AU019823
  gRNA
ggaagguggcuaccgacgcc

SEQ ID NO: 2138 - RNA, 20 nt, Artificial Sequence
  MKO10002138_A_AU019823
  gRNA
cacaaaccugucugguauau

SEQ ID NO: 2139 - RNA, 20 nt, Artificial Sequence
  MKO10002139_A_AU021092
  gRNA
cuguuccuaguaguugcacc

SEQ ID NO: 2140 - RNA, 20 nt, Artificial Sequence
  MKO10002140_A_AU021092
  gRNA
gcccuuaccucuuagguacg

SEQ ID NO: 2141 - RNA, 20 nt, Artificial Sequence
  MKO10002141_A_AU021092
  gRNA
agugaccccacguaccuaag

SEQ ID NO: 2142 - RNA, 20 nt, Artificial Sequence
  MKO10002142_A_AU022252
  gRNA
cgagcgccacgaggucuaag

SEQ ID NO: 2143 - RNA, 20 nt, Artificial Sequence
  MKO10002143_A_AU022252
  gRNA
cggggaccccuuagaccucg

SEQ ID NO: 2144 - RNA, 20 nt, Artificial Sequence
  MKO10002144_A_AU022252
  gRNA
agcugcaacaugacaugucg

SEQ ID NO: 2145 - RNA, 20 nt, Artificial Sequence
  MKO10002145_A_AU022751
  gRNA
gcacugcuccuacgaccgaa

SEQ ID NO: 2146 - RNA, 20 nt, Artificial Sequence
  MKO10002146_A_AU022751
  gRNA
gcuucggggcgaaccucuuc

SEQ ID NO: 2147 - RNA, 20 nt, Artificial Sequence
  MKO10002147_A_AU022751
  gRNA
gacgcaggccgccgccauuu

SEQ ID NO: 2148 - RNA, 20 nt, Artificial Sequence
  MKO10002148_A_AU040320
  gRNA
cgcaaaaccauuacaguugc

SEQ ID NO: 2149 - RNA, 20 nt, Artificial Sequence
  MKO10002149_A_AU040320
  gRNA
gccgaucccugaguaagcuc

SEQ ID NO: 2150 - RNA, 20 nt, Artificial Sequence
  MKO10002150_A_AU040320
  gRNA
cuuccagccaccauagagcg

SEQ ID NO: 2151 - RNA, 20 nt, Artificial Sequence
  MKO10002151_A_AU041133
  gRNA
aagacuaaagcgacguguaa

SEQ ID NO: 2152 - RNA, 20 nt, Artificial Sequence
  MKO10002152_A_AU041133
  gRNA
cgcucaccauggcgcggauu

SEQ ID NO: 2153 - RNA, 20 nt, Artificial Sequence
  MKO10002153_A_AU041133
  gRNA
uacacgucgcuuuagucuuc

SEQ ID NO: 2154 - RNA, 20 nt, Artificial Sequence
  MKO10002154_A_AV320801
  gRNA
uugcccugaacucagcuacu

SEQ ID NO: 2155 - RNA, 20 nt, Artificial Sequence
  MKO10002155_A_AV320801
  gRNA
cuuaccuaguagcugaguuc

SEQ ID NO: 2156 - RNA, 20 nt, Artificial Sequence
  MKO10002156_A_AV320801
  gRNA
ccuacaggagcccuaaacug

SEQ ID NO: 2157 - RNA, 20 nt, Artificial Sequence
  MKO10002157_A_AW146154
  gRNA
ugaaugcgaugaugucuuug

SEQ ID NO: 2158 - RNA, 20 nt, Artificial Sequence
  MKO10002158_A_AW146154
  gRNA
uagugaacuaccuugugaaa

SEQ ID NO: 2159 - RNA, 20 nt, Artificial Sequence
  MKO10002159_A_AW146154
  gRNA
uuucaacguucuagaagaua

SEQ ID NO: 2160 - RNA, 20 nt, Artificial Sequence
  MKO10002160_A_AW209491
  gRNA
cgcuucagccuuucgaccga

SEQ ID NO: 2161 - RNA, 20 nt, Artificial Sequence
  MKO10002161_A_AW209491
  gRNA
gcauuagugcgcacuaucau

SEQ ID NO: 2162 - RNA, 20 nt, Artificial Sequence
  MKO10002162_A_AW209491
  gRNA
ggagcggguucuaccucaac

SEQ ID NO: 2163 - RNA, 20 nt, Artificial Sequence
  MKO10002163_A_AW549877
  gRNA
aaugacaauacauguacagc

SEQ ID NO: 2164 - RNA, 20 nt, Artificial Sequence
  MKO10002164_A_AW549877
  gRNA
uuucagcugugcgguuugcu

SEQ ID NO: 2165 - RNA, 20 nt, Artificial Sequence
  MKO10002165_A_AW549877
  gRNA
ccucaaaauaugucaugucc

SEQ ID NO: 2166 - RNA, 20 nt, Artificial Sequence
  MKO10002166_A_AW551984
  gRNA
gcacaguccgagcguagcug

SEQ ID NO: 2167 - RNA, 20 nt, Artificial Sequence
  MKO10002167_A_AW551984
  gRNA
uggcugggagcacauaacgc

SEQ ID NO: 2168 - RNA, 20 nt, Artificial Sequence
  MKO10002168_A_AW551984
  gRNA
gcaccuuccuauagaaaauc

SEQ ID NO: 2169 - RNA, 20 nt, Artificial Sequence
  MKO10002169_A_AW554918
  gRNA
cuggaacguaagccaccgac

SEQ ID NO: 2170 - RNA, 20 nt, Artificial Sequence
  MKO10002170_A_AW554918
  gRNA
uggagauucaguagccgaac

SEQ ID NO: 2171 - RNA, 20 nt, Artificial Sequence
  MKO10002171_A_AW554918
  gRNA
ggccaguucuuuaauuaagu

SEQ ID NO: 2172 - RNA, 20 nt, Artificial Sequence
  MKO10002172_A_AY074887
  gRNA
ggagggaagcgucuauaccg

SEQ ID NO: 2173 - RNA, 20 nt, Artificial Sequence
  MKO10002173_A_AY074887
  gRNA
cucgcaguccugcgcacgcg

SEQ ID NO: 2174 - RNA, 20 nt, Artificial Sequence
  MKO10002174_A_AY074887
  gRNA
uuggcugcggucuguauuag

SEQ ID NO: 2175 - RNA, 20 nt, Artificial Sequence
  MKO10002175_A_AY358078
  gRNA
gauauucauucagugccuuu

SEQ ID NO: 2176 - RNA, 20 nt, Artificial Sequence
  MKO10002176_A_AY358078
  gRNA
aguuguuguaaccaaaacac

SEQ ID NO: 2177 - RNA, 20 nt, Artificial Sequence
  MKO10002177_A_AY358078
  gRNA
ggaagaacuuugucgaaucu

SEQ ID NO: 2178 - RNA, 20 nt, Artificial Sequence
  MKO10002178_A_AY761184
  gRNA
acagaugaagagacuaaaac

SEQ ID NO: 2179 - RNA, 20 nt, Artificial Sequence
  MKO10002179_A_AY761184
  gRNA
agcugccauugugcaaagaa

SEQ ID NO: 2180 - RNA, 20 nt, Artificial Sequence
  MKO10002180_A_AY761184
  gRNA
uucgggcacugggggcaugu

SEQ ID NO: 2181 - RNA, 20 nt, Artificial Sequence
  MKO10002181_A_AY761185
  gRNA
uuugucaugcaauugcaccu

SEQ ID NO: 2182 - RNA, 20 nt, Artificial Sequence
  MKO10002182_A_AY761185
  gRNA
acuugaagaacauagcguuc

SEQ ID NO: 2183 - RNA, 20 nt, Artificial Sequence
  MKO10002183_A_AY761185
  gRNA
cgcuauguucuucaaguuuc

SEQ ID NO: 2184 - RNA, 20 nt, Artificial Sequence
  MKO10002184_A_Aaas
  gRNA
cugaauucgcaauuucauuc

SEQ ID NO: 2185 - RNA, 20 nt, Artificial Sequence
  MKO10002185_A_Aaas
  gRNA
gaaugaaauugcgaauucag

SEQ ID NO: 2186 - RNA, 20 nt, Artificial Sequence
  MKO10002186_A_Aaas
  gRNA
gcacucaccaguuaguuacu

SEQ ID NO: 2187 - RNA, 20 nt, Artificial Sequence
  MKO10002187_A_Aacs
  gRNA
cgacagagucgcccuuuacg

SEQ ID NO: 2188 - RNA, 20 nt, Artificial Sequence
  MKO10002188_A_Aacs
  gRNA
uccggucguauauggacuuu

SEQ ID NO: 2189 - RNA, 20 nt, Artificial Sequence
  MKO10002189_A_Aacs
  gRNA
gggacucacgggccacguaa

SEQ ID NO: 2190 - RNA, 20 nt, Artificial Sequence
  MKO10002190_A_Aadacl2
  gRNA
ucgccacuucacuuagaucu

SEQ ID NO: 2191 - RNA, 20 nt, Artificial Sequence
  MKO10002191_A_Aadacl2
  gRNA
ucauauaugauaaggcuccg

SEQ ID NO: 2192 - RNA, 20 nt, Artificial Sequence
  MKO10002192_A_Aadacl2
  gRNA
ccuacccgaauugcuguguc

SEQ ID NO: 2193 - RNA, 20 nt, Artificial Sequence
  MKO10002193_A_Aadacl3
  gRNA
uccauaauucucgaggcgca

SEQ ID NO: 2194 - RNA, 20 nt, Artificial Sequence
  MKO10002194_A_Aadacl3
  gRNA
cccuugcgccucgagaauua

SEQ ID NO: 2195 - RNA, 20 nt, Artificial Sequence
  MKO10002195_A_Aadacl3
  gRNA
ggguggucggcaaacacuuc

SEQ ID NO: 2196 - RNA, 20 nt, Artificial Sequence
  MKO10002196_A_Aadac
  gRNA
auguguaucguaguuuacga

SEQ ID NO: 2197 - RNA, 20 nt, Artificial Sequence
  MKO10002197_A_Aadac
  gRNA
ccaucucgauagagugucau

SEQ ID NO: 2198 - RNA, 20 nt, Artificial Sequence
  MKO10002198_A_Aadac
  gRNA
gaauacuuuacuacagaccg

SEQ ID NO: 2199 - RNA, 20 nt, Artificial Sequence
  MKO10002199_A_Aadau
  gRNA
acccauagcuuggagaguau

SEQ ID NO: 2200 - RNA, 20 nt, Artificial Sequence
  MKO10002200_A_Aadau
  gRNA
uuaauaauguugcagccuag

SEQ ID NO: 2201 - RNA, 20 nt, Artificial Sequence
  MKO10002201_A_Aadau
  gRNA
gucaacuacccacccaauca

SEQ ID NO: 2202 - RNA, 20 nt, Artificial Sequence
  MKO10002202_A_Aaed1
  gRNA
acuuacucggaggacgcucu

SEQ ID NO: 2203 - RNA, 20 nt, Artificial Sequence
  MKO10002203_A_Aaed1
  gRNA
ggccagugacugcccgccac

SEQ ID NO: 2204 - RNA, 20 nt, Artificial Sequence
  MKO10002204_A_Aaed1
  gRNA
augauuguccaaucacuaug

SEQ ID NO: 2205 - RNA, 20 nt, Artificial Sequence
  MKO10002205_A_Aagab
  gRNA
gucuugacagcgucuccucg

SEQ ID NO: 2206 - RNA, 20 nt, Artificial Sequence
  MKO10002206_A_Aagab
  gRNA
ggaauaguacuuguuaucga

SEQ ID NO: 2207 - RNA, 20 nt, Artificial Sequence
  MKO10002207_A_Aagab
  gRNA
acuugcuuggcaccacgcac

SEQ ID NO: 2208 - RNA, 20 nt, Artificial Sequence
  MKO10002208_A_Aak1
  gRNA
aucggaagggucuucggcau

SEQ ID NO: 2209 - RNA, 20 nt, Artificial Sequence
  MKO10002209_A_Aak1
  gRNA
gguucaucagguuuaccacc

SEQ ID NO: 2210 - RNA, 20 nt, Artificial Sequence
  MKO10002210_A_Aak1
  gRNA
uuccgccaacaccucgucca

SEQ ID NO: 2211 - RNA, 20 nt, Artificial Sequence
  MKO10002211_A_Aamdc
  gRNA
ucaggugccuccgucgacug

SEQ ID NO: 2212 - RNA, 20 nt, Artificial Sequence
  MKO10002212_A_Aamdc
  gRNA
aggcucuaccuuaaccuaua

SEQ ID NO: 2213 - RNA, 20 nt, Artificial Sequence
  MKO10002213_A_Aamdc
  gRNA
gcaacuuccuuuacaucugc

SEQ ID NO: 2214 - RNA, 20 nt, Artificial Sequence
  MKO10002214_A_Aamp
  gRNA
ucgccgcauggaguccgaau

SEQ ID NO: 2215 - RNA, 20 nt, Artificial Sequence
  MKO10002215_A_Aamp
  gRNA
ggccgcuccgcucuccgauu

SEQ ID NO: 2216 - RNA, 20 nt, Artificial Sequence
  MKO10002216_A_Aamp
  gRNA
ccuaccugagugcaaugcaa

SEQ ID NO: 2217 - RNA, 20 nt, Artificial Sequence
  MKO10002217_A_Aanau
  gRNA
gaugccacgccuuccugcgc

SEQ ID NO: 2218 - RNA, 20 nt, Artificial Sequence
  MKO10002218_A_Aanau
  gRNA
ccgcucaaucucaaacgcac

SEQ ID NO: 2219 - RNA, 20 nt, Artificial Sequence
  MKO10002219_A_Aanau
  gRNA
ugugcaccgccaguacgugc

SEQ ID NO: 2220 - RNA, 20 nt, Artificial Sequence
  MKO10002220_A_Aar2
  gRNA
uuaggccgucucgaugcccu

SEQ ID NO: 2221 - RNA, 20 nt, Artificial Sequence
  MKO10002221_A_Aar2
  gRNA
cauguucagaaugaccaccg

SEQ ID NO: 2222 - RNA, 20 nt, Artificial Sequence
  MKO10002222_A_Aar2
  gRNA
uggcagauucagaccgacac

SEQ ID NO: 2223 - RNA, 20 nt, Artificial Sequence
  MKO10002223_A_Aard
  gRNA
gacgcgcauggagugcgccc

SEQ ID NO: 2224 - RNA, 20 nt, Artificial Sequence
  MKO10002224_A_Aard
  gRNA
gggcgcacuccaugcgcguc

SEQ ID NO: 2225 - RNA, 20 nt, Artificial Sequence
  MKO10002225_A_Aard
  gRNA
aaggagaugaauuccgagug

SEQ ID NO: 2226 - RNA, 20 nt, Artificial Sequence
  MKO10002226_A_Aars2
  gRNA
ugguguauggcgucgagcag

SEQ ID NO: 2227 - RNA, 20 nt, Artificial Sequence
  MKO10002227_A_Aars2
  gRNA
uggaggacgccauaacgacc

SEQ ID NO: 2228 - RNA, 20 nt, Artificial Sequence
  MKO10002228_A_Aars2
  gRNA
agagaagaggucggugucgu

SEQ ID NO: 2229 - RNA, 20 nt, Artificial Sequence
  MKO10002229_A_Aarsd1
  gRNA
uagucccgccgagcugcaga

SEQ ID NO: 2230 - RNA, 20 nt, Artificial Sequence
  MKO10002230_A_Aarsd1
  gRNA
acuccgugaagugaucggcc

SEQ ID NO: 2231 - RNA, 20 nt, Artificial Sequence
  MKO10002231_A_Aarsd1
  gRNA
ucgggcugaagacaacguca

SEQ ID NO: 2232 - RNA, 20 nt, Artificial Sequence
  MKO10002232_A_Aars
  gRNA
gagauccacuaugaccgcau

SEQ ID NO: 2233 - RNA, 20 nt, Artificial Sequence
  MKO10002233_A_Aars
  gRNA
ugccaccaaugcggucauag

SEQ ID NO: 2234 - RNA, 20 nt, Artificial Sequence
  MKO10002234_A_Aars
  gRNA
ggccggccuagagccagauc

SEQ ID NO: 2235 - RNA, 20 nt, Artificial Sequence
  MKO10002235_A_Aasdhppt
  gRNA
aacgagucuuucgcaagaac

SEQ ID NO: 2236 - RNA, 20 nt, Artificial Sequence
  MKO10002236_A_Aasdhppt
  gRNA
aggcuggucguuugaugaua

SEQ ID NO: 2237 - RNA, 20 nt, Artificial Sequence
  MKO10002237_A_Aasdhppt
  gRNA
gaaagcuucauaaaagccau

SEQ ID NO: 2238 - RNA, 20 nt, Artificial Sequence
  MKO10002238_A_Aasdh
  gRNA
ucagagacguaugcgcugac

SEQ ID NO: 2239 - RNA, 20 nt, Artificial Sequence
  MKO10002239_A_Aasdh
  gRNA
gacaaucuucgguguccccg

SEQ ID NO: 2240 - RNA, 20 nt, Artificial Sequence
  MKO10002240_A_Aasdh
  gRNA
gaccuucgauccaucuguug

SEQ ID NO: 2241 - RNA, 20 nt, Artificial Sequence
  MKO10002241_A_Aass
  gRNA
uuucggacagugggcgggug

SEQ ID NO: 2242 - RNA, 20 nt, Artificial Sequence
  MKO10002242_A_Aass
  gRNA
aaagaaggcguacgucuucu

SEQ ID NO: 2243 - RNA, 20 nt, Artificial Sequence
  MKO10002243_A_Aass
  gRNA
ucacagagggucucggauag

SEQ ID NO: 2244 - RNA, 20 nt, Artificial Sequence
  MKO10002244_A_Aauf
  gRNA
cccucuuggacaccgacaaa

SEQ ID NO: 2245 - RNA, 20 nt, Artificial Sequence
  MKO10002245_A_Aauf
  gRNA
agauaacgaagcaucugaug

SEQ ID NO: 2246 - RNA, 20 nt, Artificial Sequence
  MKO10002246_A_Aauf
  gRNA
cuagagccagagugauugac

SEQ ID NO: 2247 - RNA, 20 nt, Artificial Sequence
  MKO10002247_A_Aauk
  gRNA
cgaguauguggccgacuucu

SEQ ID NO: 2248 - RNA, 20 nt, Artificial Sequence
  MKO10002248_A_Aauk
  gRNA
caccacucaccggagcgacc

SEQ ID NO: 2249 - RNA, 20 nt, Artificial Sequence
  MKO10002249_A_Aauk
  gRNA
gcacagccuccuguacuuaa

SEQ ID NO: 2250 - RNA, 20 nt, Artificial Sequence
  MKO10002250_A_Abau
  gRNA
ccgucggguaaucaacaaga

SEQ ID NO: 2251 - RNA, 20 nt, Artificial Sequence
  MKO10002251_A_Abau
  gRNA
ccuucuuguugauuacccga

SEQ ID NO: 2252 - RNA, 20 nt, Artificial Sequence
  MKO10002252_A_Abau
  gRNA
aacuaccuaguggacgugga

SEQ ID NO: 2253 - RNA, 20 nt, Artificial Sequence
  MKO10002253_A_Abca12
  gRNA
uuccugcggagcagaucucg

SEQ ID NO: 2254 - RNA, 20 nt, Artificial Sequence
  MKO10002254_A_Abca12
  gRNA
aaauguaaagacacgcccua

SEQ ID NO: 2255 - RNA, 20 nt, Artificial Sequence
  MKO10002255_A_Abca12
  gRNA
aaaagccguccaacccgaag

SEQ ID NO: 2256 - RNA, 20 nt, Artificial Sequence
  MKO10002256_A_Abca13
  gRNA
auccugaaucucguuuaaaa

SEQ ID NO: 2257 - RNA, 20 nt, Artificial Sequence
  MKO10002257_A_Abca13
  gRNA
gaccagguuacuugcaagcc

SEQ ID NO: 2258 - RNA, 20 nt, Artificial Sequence
  MKO10002258_A_Abca13
  gRNA
auaccgaaaaugaugaucca

SEQ ID NO: 2259 - RNA, 20 nt, Artificial Sequence
  MKO10002259_A_Abca14
  gRNA
aaguggcaagcguucauugc

SEQ ID NO: 2260 - RNA, 20 nt, Artificial Sequence
  MKO10002260_A_Abca14
  gRNA
gaaucucuccgcauaaauug

SEQ ID NO: 2261 - RNA, 20 nt, Artificial Sequence
  MKO10002261_A_Abca14
  gRNA
uuuguugcagagccggaaug

SEQ ID NO: 2262 - RNA, 20 nt, Artificial Sequence
  MKO10002262_A_Abca15
  gRNA
cauauuaucaaggggacacc

SEQ ID NO: 2263 - RNA, 20 nt, Artificial Sequence
  MKO10002263_A_Abca15
  gRNA
ugugcaacaugcccuagaca

SEQ ID NO: 2264 - RNA, 20 nt, Artificial Sequence
  MKO10002264_A_Abca15
  gRNA
cuagggcauguugcacagcc

SEQ ID NO: 2265 - RNA, 20 nt, Artificial Sequence
  MKO10002265_A_Abca16
  gRNA
aucauccuucuauacgaccc

SEQ ID NO: 2266 - RNA, 20 nt, Artificial Sequence
  MKO10002266_A_Abca16
  gRNA
ggucguauagaaggaugauu

SEQ ID NO: 2267 - RNA, 20 nt, Artificial Sequence
  MKO10002267_A_Abca16
  gRNA
uucuaagccccauuaugagc

SEQ ID NO: 2268 - RNA, 20 nt, Artificial Sequence
  MKO10002268_A_Abca17
  gRNA
ccguagacaaagcgauuaug

SEQ ID NO: 2269 - RNA, 20 nt, Artificial Sequence
  MKO10002269_A_Abca17
  gRNA
cuaaucuaagccaagcgccc

SEQ ID NO: 2270 - RNA, 20 nt, Artificial Sequence
  MKO10002270_A_Abca17
  gRNA
cauccgcauaugaaaauucc

SEQ ID NO: 2271 - RNA, 20 nt, Artificial Sequence
  MKO10002271_A_Abca1
  gRNA
ccucgccgggaguuggauaa

SEQ ID NO: 2272 - RNA, 20 nt, Artificial Sequence
  MKO10002272_A_Abca1
  gRNA
cucacacucauguuguucgu

SEQ ID NO: 2273 - RNA, 20 nt, Artificial Sequence
  MKO10002273_A_Abca1
  gRNA
ugaucugccguaacauucuc

SEQ ID NO: 2274 - RNA, 20 nt, Artificial Sequence
  MKO10002274_A_Abca2
  gRNA
aaagcgacugcaugacgggc

SEQ ID NO: 2275 - RNA, 20 nt, Artificial Sequence
  MKO10002275_A_Abca2
  gRNA
acgccuccaccguguagugg

SEQ ID NO: 2276 - RNA, 20 nt, Artificial Sequence
  MKO10002276_A_Abca2
  gRNA
cgaggcucugcgccaacguc

SEQ ID NO: 2277 - RNA, 20 nt, Artificial Sequence
  MKO10002277_A_Abca3
  gRNA
ugaugaagguucccgcgguc

SEQ ID NO: 2278 - RNA, 20 nt, Artificial Sequence
  MKO10002278_A_Abca3
  gRNA
uucguguguaacugaagcgc

SEQ ID NO: 2279 - RNA, 20 nt, Artificial Sequence
  MKO10002279_A_Abca3
  gRNA
cauugggcacauucuccgac

SEQ ID NO: 2280 - RNA, 20 nt, Artificial Sequence
  MKO10002280_A_Abca4
  gRNA
ccgcaccuugucgcaguuca

SEQ ID NO: 2281 - RNA, 20 nt, Artificial Sequence
  MKO10002281_A_Abca4
  gRNA
cuucagcaggacuguuaccg

SEQ ID NO: 2282 - RNA, 20 nt, Artificial Sequence
  MKO10002282_A_Abca4
  gRNA
cuaccugcuccacacgaacu

SEQ ID NO: 2283 - RNA, 20 nt, Artificial Sequence
  MKO10002283_A_Abca5
  gRNA
aguguauccaagaauaacgu

SEQ ID NO: 2284 - RNA, 20 nt, Artificial Sequence
  MKO10002284_A_Abca5
  gRNA
gucgaccaaagcugugauca

SEQ ID NO: 2285 - RNA, 20 nt, Artificial Sequence
  MKO10002285_A_Abca5
  gRNA
aaccacaccuacgaaguugc

SEQ ID NO: 2286 - RNA, 20 nt, Artificial Sequence
  MKO10002286_A_Abca6
  gRNA
uuacaaaccgccauuaacgc

SEQ ID NO: 2287 - RNA, 20 nt, Artificial Sequence
  MKO10002287_A_Abca6
  gRNA
ucguaauccgaaagaucucu

SEQ ID NO: 2288 - RNA, 20 nt, Artificial Sequence
  MKO10002288_A_Abca6
  gRNA
aagaugacuccuaaagcguc

SEQ ID NO: 2289 - RNA, 20 nt, Artificial Sequence
  MKO10002289_A_Abca7
  gRNA
gcugauacccgcacagugcu

SEQ ID NO: 2290 - RNA, 20 nt, Artificial Sequence
  MKO10002290_A_Abca7
  gRNA
cagggcaccgugcccgccga

SEQ ID NO: 2291 - RNA, 20 nt, Artificial Sequence
  MKO10002291_A_Abca7
  gRNA
ggaaacugauccccgugcuc

SEQ ID NO: 2292 - RNA, 20 nt, Artificial Sequence
  MKO10002292_A_Abca8a
  gRNA
aucaagauagauucuuucgu

SEQ ID NO: 2293 - RNA, 20 nt, Artificial Sequence
  MKO10002293_A_Abca8a
  gRNA
uucuaugauggcagcguuaa

SEQ ID NO: 2294 - RNA, 20 nt, Artificial Sequence
  MKO10002294_A_Abca8a
  gRNA
uaaaugaaucaaugcguccc

SEQ ID NO: 2295 - RNA, 20 nt, Artificial Sequence
  MKO10002295_A_Abca8b
  gRNA
aucagagaaucccaacgucg

SEQ ID NO: 2296 - RNA, 20 nt, Artificial Sequence
  MKO10002296_A_Abca8b
  gRNA
ucucugaguucccucgacgu

SEQ ID NO: 2297 - RNA, 20 nt, Artificial Sequence
  MKO10002297_A_Abca8b
  gRNA
aucgacucgucccagauccu

SEQ ID NO: 2298 - RNA, 20 nt, Artificial Sequence
  MKO10002298_A_Abca9
  gRNA
gaucacaaaccacuccguga

SEQ ID NO: 2299 - RNA, 20 nt, Artificial Sequence
  MKO10002299_A_Abca9
  gRNA
gaugauggggcuucgagagu

SEQ ID NO: 2300 - RNA, 20 nt, Artificial Sequence
  MKO10002300_A_Abca9
  gRNA
uaacgauucuaauuauauga

SEQ ID NO: 2301 - RNA, 20 nt, Artificial Sequence
  MKO10002301_A_Abcb10
  gRNA
gguuaauuaauucgccugug

SEQ ID NO: 2302 - RNA, 20 nt, Artificial Sequence
  MKO10002302_A_Abcb10
  gRNA
cuaucgccauagcccucgcu

SEQ ID NO: 2303 - RNA, 20 nt, Artificial Sequence
  MKO10002303_A_Abcb10
  gRNA
ccccaggagugcgguauccg

SEQ ID NO: 2304 - RNA, 20 nt, Artificial Sequence
  MKO10002304_A_Abcb11
  gRNA
ucgaguuggcuucuuugaac

SEQ ID NO: 2305 - RNA, 20 nt, Artificial Sequence
  MKO10002305_A_Abcb11
  gRNA
uuguuccguuugucauguuc

SEQ ID NO: 2306 - RNA, 20 nt, Artificial Sequence
  MKO10002306_A_Abcb11
  gRNA
caucuacgcaggaguuggug

SEQ ID NO: 2307 - RNA, 20 nt, Artificial Sequence
  MKO10002307_A_Abcb1a
  gRNA
gcuggacagguuguacaugc

SEQ ID NO: 2308 - RNA, 20 nt, Artificial Sequence
  MKO10002308_A_Abcb1a
  gRNA
ucuuugcaguuucguuaugc

SEQ ID NO: 2309 - RNA, 20 nt, Artificial Sequence
  MKO10002309_A_Abcb1a
  gRNA
ugguuugaugugcaugacgu

SEQ ID NO: 2310 - RNA, 20 nt, Artificial Sequence
  MKO10002310_A_Abcb1b
  gRNA
aucccaaauacgccaacagc

SEQ ID NO: 2311 - RNA, 20 nt, Artificial Sequence
  MKO10002311_A_Abcb1b
  gRNA
ucuaguuucgcuaugcagau

SEQ ID NO: 2312 - RNA, 20 nt, Artificial Sequence
  MKO10002312_A_Abcb1b
  gRNA
ucuccugauucauuauagca

SEQ ID NO: 2313 - RNA, 20 nt, Artificial Sequence
  MKO10002313_A_Abcb4
  gRNA
ugccauccuccgacaagaaa

SEQ ID NO: 2314 - RNA, 20 nt, Artificial Sequence
  MKO10002314_A_Abcb4
  gRNA
uucaguuccgauacucugac

SEQ ID NO: 2315 - RNA, 20 nt, Artificial Sequence
  MKO10002315_A_Abcb4
  gRNA
cagauaugcauacuacuauu

SEQ ID NO: 2316 - RNA, 20 nt, Artificial Sequence
  MKO10002316_A_Abcb5
  gRNA
gaacuuaacacccgcaugac

SEQ ID NO: 2317 - RNA, 20 nt, Artificial Sequence
  MKO10002317_A_Abcb5
  gRNA
guuccgcuuugcugauaauc

SEQ ID NO: 2318 - RNA, 20 nt, Artificial Sequence
  MKO10002318_A_Abcb5
  gRNA
caccguuccuuuaauguccc

SEQ ID NO: 2319 - RNA, 20 nt, Artificial Sequence
  MKO10002319_A_Abcb6
  gRNA
gugcagcaguuuacgucccg

SEQ ID NO: 2320 - RNA, 20 nt, Artificial Sequence
  MKO10002320_A_Abcb6
  gRNA
ccugggccggcguaccgggg

SEQ ID NO: 2321 - RNA, 20 nt, Artificial Sequence
  MKO10002321_A_Abcb6
  gRNA
caacagaccgacgauccacc

SEQ ID NO: 2322 - RNA, 20 nt, Artificial Sequence
  MKO10002322_A_Abcb7
  gRNA
ucagcauguuucccgacauc

SEQ ID NO: 2323 - RNA, 20 nt, Artificial Sequence
  MKO10002323_A_Abcb7
  gRNA
gcaacucuggcucguagauc

SEQ ID NO: 2324 - RNA, 20 nt, Artificial Sequence
  MKO10002324_A_Abcb7
  gRNA
uugcaccacccaaaaauccc

SEQ ID NO: 2325 - RNA, 20 nt, Artificial Sequence
  MKO10002325_A_Abcb8
  gRNA
auaccugaacaccguacagu

SEQ ID NO: 2326 - RNA, 20 nt, Artificial Sequence
  MKO10002326_A_Abcb8
  gRNA
auucacuagugccgcaccua

SEQ ID NO: 2327 - RNA, 20 nt, Artificial Sequence
  MKO10002327_A_Abcb8
  gRNA
ugagcugagccggucaucug

SEQ ID NO: 2328 - RNA, 20 nt, Artificial Sequence
  MKO10002328_A_Abcb9
  gRNA
guaguacuugccguagaugu

SEQ ID NO: 2329 - RNA, 20 nt, Artificial Sequence
  MKO10002329_A_Abcb9
  gRNA
ccggaggcgaauguucaguc

SEQ ID NO: 2330 - RNA, 20 nt, Artificial Sequence
  MKO10002330_A_Abcb9
  gRNA
cacggucaaagucacgggcg

SEQ ID NO: 2331 - RNA, 20 nt, Artificial Sequence
  MKO10002331_A_Abcc10
  gRNA
ggcuguagcuuggaagaucg

SEQ ID NO: 2332 - RNA, 20 nt, Artificial Sequence
  MKO10002332_A_Abcc10
  gRNA
uacuaggcaccgacuccgag

SEQ ID NO: 2333 - RNA, 20 nt, Artificial Sequence
  MKO10002333_A_Abcc10
  gRNA
agugauugccacccgaauca

SEQ ID NO: 2334 - RNA, 20 nt, Artificial Sequence
  MKO10002334_A_Abcc12
  gRNA
ccgcacagcgauccgacuga

SEQ ID NO: 2335 - RNA, 20 nt, Artificial Sequence
  MKO10002335_A_Abcc12
  gRNA
gaugccgaucccgauguguc

SEQ ID NO: 2336 - RNA, 20 nt, Artificial Sequence
  MKO10002336_A_Abcc12
  gRNA
uagguuggcacccaauccug

SEQ ID NO: 2337 - RNA, 20 nt, Artificial Sequence
  MKO10002337_A_Abcc1
  gRNA
ccguucaagcuguaucaaaa

SEQ ID NO: 2338 - RNA, 20 nt, Artificial Sequence
  MKO10002338_A_Abcc1
  gRNA
gaaaguaagcauaauucccg

SEQ ID NO: 2339 - RNA, 20 nt, Artificial Sequence
  MKO10002339_A_Abcc1
  gRNA
gcuccgagccccaguguuac

SEQ ID NO: 2340 - RNA, 20 nt, Artificial Sequence
  MKO10002340_A_Abcc2
  gRNA
ucugauacgagcacuccugc

SEQ ID NO: 2341 - RNA, 20 nt, Artificial Sequence
  MKO10002341_A_Abcc2
  gRNA
uaaauucuaccuugccaagc

SEQ ID NO: 2342 - RNA, 20 nt, Artificial Sequence
  MKO10002342_A_Abcc2
  gRNA
cucguaucagagucugaaac

SEQ ID NO: 2343 - RNA, 20 nt, Artificial Sequence
  MKO10002343_A_Abcc3
  gRNA
ccccccgaagccgcucguac

SEQ ID NO: 2344 - RNA, 20 nt, Artificial Sequence
  MKO10002344_A_Abcc3
  gRNA
gucgcugaccgucuugagcc

SEQ ID NO: 2345 - RNA, 20 nt, Artificial Sequence
  MKO10002345_A_Abcc3
  gRNA
ggacuauguagccgagcuga

SEQ ID NO: 2346 - RNA, 20 nt, Artificial Sequence
  MKO10002346_A_Abcc4
  gRNA
gucgaauuuguucacgucgu

SEQ ID NO: 2347 - RNA, 20 nt, Artificial Sequence
  MKO10002347_A_Abcc4
  gRNA
accguugaagcuccucuccg

SEQ ID NO: 2348 - RNA, 20 nt, Artificial Sequence
  MKO10002348_A_Abcc4
  gRNA
uuggcguccugcagcggguu

SEQ ID NO: 2349 - RNA, 20 nt, Artificial Sequence
  MKO10002349_A_Abcc5
  gRNA
gugccugaugaucacgcagu

SEQ ID NO: 2350 - RNA, 20 nt, Artificial Sequence
  MKO10002350_A_Abcc5
  gRNA
ggcccgagugguucacaaga

SEQ ID NO: 2351 - RNA, 20 nt, Artificial Sequence
  MKO10002351_A_Abcc5
  gRNA
cgaaacagcagcccgaguug

SEQ ID NO: 2352 - RNA, 20 nt, Artificial Sequence
  MKO10002352_A_Abcc6
  gRNA
ucccccacagaacuuccguc

SEQ ID NO: 2353 - RNA, 20 nt, Artificial Sequence
  MKO10002353_A_Abcc6
  gRNA
gccucuguggaggauccacc

SEQ ID NO: 2354 - RNA, 20 nt, Artificial Sequence
  MKO10002354_A_Abcc6
  gRNA
gggacauccggagguagcac

SEQ ID NO: 2355 - RNA, 20 nt, Artificial Sequence
  MKO10002355_A_Abcc8
  gRNA
cgcgcagagucgcugauagu

SEQ ID NO: 2356 - RNA, 20 nt, Artificial Sequence
  MKO10002356_A_Abcc8
  gRNA
caacuaucagcgacucugcg

SEQ ID NO: 2357 - RNA, 20 nt, Artificial Sequence
  MKO10002357_A_Abcc8
  gRNA
guccuuaccgaucagcagcu

SEQ ID NO: 2358 - RNA, 20 nt, Artificial Sequence
  MKO10002358_A_Abcc9
  gRNA
ucucuaggcaucgggcgucc

SEQ ID NO: 2359 - RNA, 20 nt, Artificial Sequence
  MKO10002359_A_Abcc9
  gRNA
gacucaccaaugaacaguau

SEQ ID NO: 2360 - RNA, 20 nt, Artificial Sequence
  MKO10002360_A_Abcc9
  gRNA
uccuccuacaacaucuauua

SEQ ID NO: 2361 - RNA, 20 nt, Artificial Sequence
  MKO10002361_A_Abcd1
  gRNA
ucauccugcuugagcgccua

SEQ ID NO: 2362 - RNA, 20 nt, Artificial Sequence
  MKO10002362_A_Abcd1
  gRNA
guuccagcaugacauaccau

SEQ ID NO: 2363 - RNA, 20 nt, Artificial Sequence
  MKO10002363_A_Abcd1
  gRNA
caggguguacgagauguucc

SEQ ID NO: 2364 - RNA, 20 nt, Artificial Sequence
  MKO10002364_A_Abcd2
  gRNA
ucgcuaaccauagccugcuu

SEQ ID NO: 2365 - RNA, 20 nt, Artificial Sequence
  MKO10002365_A_Abcd2
  gRNA
agcaggcuaugguuagcgau

SEQ ID NO: 2366 - RNA, 20 nt, Artificial Sequence
  MKO10002366_A_Abcd2
  gRNA
ugucgcugagggguaguucc

SEQ ID NO: 2367 - RNA, 20 nt, Artificial Sequence
  MKO10002367_A_Abcd3
  gRNA
agaaugggacgcucauugag

SEQ ID NO: 2368 - RNA, 20 nt, Artificial Sequence
  MKO10002368_A_Abcd3
  gRNA
cucgaacauacugugauguu

SEQ ID NO: 2369 - RNA, 20 nt, Artificial Sequence
  MKO10002369_A_Abcd3
  gRNA
gugguuugcaguggcaucau

SEQ ID NO: 2370 - RNA, 20 nt, Artificial Sequence
  MKO10002370_A_Abcd4
  gRNA
gcaaccugcuguacgugagc

SEQ ID NO: 2371 - RNA, 20 nt, Artificial Sequence
  MKO10002371_A_Abcd4
  gRNA
acacgcgggcccggaaguac

SEQ ID NO: 2372 - RNA, 20 nt, Artificial Sequence
  MKO10002372_A_Abcd4
  gRNA
ucagugccuuaaauccaucc

SEQ ID NO: 2373 - RNA, 20 nt, Artificial Sequence
  MKO10002373_A_Abce1
  gRNA
uugggauuaguuggaacuaa

SEQ ID NO: 2374 - RNA, 20 nt, Artificial Sequence
  MKO10002374_A_Abce1
  gRNA
agguugccuaucccucgucc

SEQ ID NO: 2375 - RNA, 20 nt, Artificial Sequence
  MKO10002375_A_Abce1
  gRNA
uaggucaucuucgagaaucu

SEQ ID NO: 2376 - RNA, 20 nt, Artificial Sequence
  MKO10002376_A_Abcf1
  gRNA
aggccgucggaaaaaggaug

SEQ ID NO: 2377 - RNA, 20 nt, Artificial Sequence
  MKO10002377_A_Abcf1
  gRNA
ccuuggccuucuuccguccu

SEQ ID NO: 2378 - RNA, 20 nt, Artificial Sequence
  MKO10002378_A_Abcf1
  gRNA
acccucaucuuccucaucac

SEQ ID NO: 2379 - RNA, 20 nt, Artificial Sequence
  MKO10002379_A_Abcf2
  gRNA
cccaauagccgagagcagca

SEQ ID NO: 2380 - RNA, 20 nt, Artificial Sequence
  MKO10002380_A_Abcf2
  gRNA
uuaaacucaggccggcgcua

SEQ ID NO: 2381 - RNA, 20 nt, Artificial Sequence
  MKO10002381_A_Abcf2
  gRNA
ccaucagagcccucuuuauu

SEQ ID NO: 2382 - RNA, 20 nt, Artificial Sequence
  MKO10002382_A_Abcf3
  gRNA
cagcgcggauuucgagucug

SEQ ID NO: 2383 - RNA, 20 nt, Artificial Sequence
  MKO10002383_A_Abcf3
  gRNA
gcaaggaugacgcuggcauu

SEQ ID NO: 2384 - RNA, 20 nt, Artificial Sequence
  MKO10002384_A_Abcf3
  gRNA
uuuccauuaucuucgacaac

SEQ ID NO: 2385 - RNA, 20 nt, Artificial Sequence
  MKO10002385_A_Abcg1
  gRNA
auguucacggccgcccuccg

SEQ ID NO: 2386 - RNA, 20 nt, Artificial Sequence
  MKO10002386_A_Abcg1
  gRNA
cccggggcauuccauugaua

SEQ ID NO: 2387 - RNA, 20 nt, Artificial Sequence
  MKO10002387_A_Abcg1
  gRNA
cgaggucguguccagcaacg

SEQ ID NO: 2388 - RNA, 20 nt, Artificial Sequence
  MKO10002388_A_Abcg2
  gRNA
gucggaacucaguuuauccg

SEQ ID NO: 2389 - RNA, 20 nt, Artificial Sequence
  MKO10002389_A_Abcg2
  gRNA
cgaagacuugccuccgccug

SEQ ID NO: 2390 - RNA, 20 nt, Artificial Sequence
  MKO10002390_A_Abcg2
  gRNA
gcuugaguccaaaccagucg

SEQ ID NO: 2391 - RNA, 20 nt, Artificial Sequence
  MKO10002391_A_Abcg3
  gRNA
auaucuccugauaauccacg

SEQ ID NO: 2392 - RNA, 20 nt, Artificial Sequence
  MKO10002392_A_Abcg3
  gRNA
gcuaauuucaaguguacuuc

SEQ ID NO: 2393 - RNA, 20 nt, Artificial Sequence
  MKO10002393_A_Abcg3
  gRNA
caaugccauuaugggaccuc

SEQ ID NO: 2394 - RNA, 20 nt, Artificial Sequence
  MKO10002394_A_Abcg4
  gRNA
cggaagguccucagcucgcg

SEQ ID NO: 2395 - RNA, 20 nt, Artificial Sequence
  MKO10002395_A_Abcg4
  gRNA
ugauguccugcucucacacg

SEQ ID NO: 2396 - RNA, 20 nt, Artificial Sequence
  MKO10002396_A_Abcg4
  gRNA
agcuguccucgugugagagc

SEQ ID NO: 2397 - RNA, 20 nt, Artificial Sequence
  MKO10002397_A_Abcg5
  gRNA
gcaacgucucgcgcacagug

SEQ ID NO: 2398 - RNA, 20 nt, Artificial Sequence
  MKO10002398_A_Abcg5
  gRNA
ugaauggcugcgagcugcgc

SEQ ID NO: 2399 - RNA, 20 nt, Artificial Sequence
  MKO10002399_A_Abcg5
  gRNA
gucuccuuguacaucgagag

SEQ ID NO: 2400 - RNA, 20 nt, Artificial Sequence
  MKO10002400_A_Abcg8
  gRNA
aagacguaaucgccgagcug

SEQ ID NO: 2401 - RNA, 20 nt, Artificial Sequence
  MKO10002401_A_Abcg8
  gRNA
ugugaucacgucgaguagug

SEQ ID NO: 2402 - RNA, 20 nt, Artificial Sequence
  MKO10002402_A_Abcg8
  gRNA
ucacuacucgacgugaucac

SEQ ID NO: 2403 - RNA, 20 nt, Artificial Sequence
  MKO10002403_A_Abhd10
  gRNA
cucuaggucacgccuuuaua

SEQ ID NO: 2404 - RNA, 20 nt, Artificial Sequence
  MKO10002404_A_Abhd10
  gRNA
uuggaaguucugaucgguua

SEQ ID NO: 2405 - RNA, 20 nt, Artificial Sequence
  MKO10002405_A_Abhd10
  gRNA
aagcguacagggcaggucac

SEQ ID NO: 2406 - RNA, 20 nt, Artificial Sequence
  MKO10002406_A_Abhd11
  gRNA
ucagcaacgugaacccuacu

SEQ ID NO: 2407 - RNA, 20 nt, Artificial Sequence
  MKO10002407_A_Abhd11
  gRNA
aagagaguuggccccgagua

SEQ ID NO: 2408 - RNA, 20 nt, Artificial Sequence
  MKO10002408_A_Abhd11
  gRNA
gcacucccaagcccgaaaac

SEQ ID NO: 2409 - RNA, 20 nt, Artificial Sequence
  MKO10002409_A_Abhd12b
  gRNA
ccaaggggaagugucgaugc

SEQ ID NO: 2410 - RNA, 20 nt, Artificial Sequence
  MKO10002410_A_Abhd12b
  gRNA
aguuacggcucccauucucg

SEQ ID NO: 2411 - RNA, 20 nt, Artificial Sequence
  MKO10002411_A_Abhd12b
  gRNA
acucgugaaguuucuguacu

SEQ ID NO: 2412 - RNA, 20 nt, Artificial Sequence
  MKO10002412_A_Abhd12
  gRNA
gccaucauacuauaccugca

SEQ ID NO: 2413 - RNA, 20 nt, Artificial Sequence
  MKO10002413_A_Abhd12
  gRNA
cagaggaggugaccaccgug

SEQ ID NO: 2414 - RNA, 20 nt, Artificial Sequence
  MKO10002414_A_Abhd12
  gRNA
uggugccugcauucccaugc

SEQ ID NO: 2415 - RNA, 20 nt, Artificial Sequence
  MKO10002415_A_Abhd13
  gRNA
acccgaccucgauaagacca

SEQ ID NO: 2416 - RNA, 20 nt, Artificial Sequence
  MKO10002416_A_Abhd13
  gRNA
gugucguugugcgucccauc

SEQ ID NO: 2417 - RNA, 20 nt, Artificial Sequence
  MKO10002417_A_Abhd13
  gRNA
augccggcaacauaggccac

SEQ ID NO: 2418 - RNA, 20 nt, Artificial Sequence
  MKO10002418_A_Abhd14a
  gRNA
ccgagcagacuucgcgacuc

SEQ ID NO: 2419 - RNA, 20 nt, Artificial Sequence
  MKO10002419_A_Abhd14a
  gRNA
guacucgccuggaaggucga

SEQ ID NO: 2420 - RNA, 20 nt, Artificial Sequence
  MKO10002420_A_Abhd14a
  gRNA
ccagagucgcgaagucugcu

SEQ ID NO: 2421 - RNA, 20 nt, Artificial Sequence
  MKO10002421_A_Abhd14b
  gRNA
gacccgggggccacgaggaa

SEQ ID NO: 2422 - RNA, 20 nt, Artificial Sequence
  MKO10002422_A_Abhd14b
  gRNA
ugcaggucuugggcgaucca

SEQ ID NO: 2423 - RNA, 20 nt, Artificial Sequence
  MKO10002423_A_Abhd14b
  gRNA
agccccuuaugccacucauc

SEQ ID NO: 2424 - RNA, 20 nt, Artificial Sequence
  MKO10002424_A_Abhd15
  gRNA
ccgcggcgauggaagaugac

SEQ ID NO: 2425 - RNA, 20 nt, Artificial Sequence
  MKO10002425_A_Abhd15
  gRNA
acgccucacucgcaauguac

SEQ ID NO: 2426 - RNA, 20 nt, Artificial Sequence
  MKO10002426_A_Abhd15
  gRNA
ccugacugaauucuuccgaa

SEQ ID NO: 2427 - RNA, 20 nt, Artificial Sequence
  MKO10002427_A_Abhd16a
  gRNA
aggauacguauuaucagccu

SEQ ID NO: 2428 - RNA, 20 nt, Artificial Sequence
  MKO10002428_A_Abhd16a
  gRNA
ugaugaacugucgguacugg

SEQ ID NO: 2429 - RNA, 20 nt, Artificial Sequence
  MKO10002429_A_Abhd16a
  gRNA
ucucuaccuaccucggaggc

SEQ ID NO: 2430 - RNA, 20 nt, Artificial Sequence
  MKO10002430_A_Abhd16b
  gRNA
cgacuaguggaccgcuaccg

SEQ ID NO: 2431 - RNA, 20 nt, Artificial Sequence
  MKO10002431_A_Abhd16b
  gRNA
agcgguccacuagucgcucc

SEQ ID NO: 2432 - RNA, 20 nt, Artificial Sequence
  MKO10002432_A_Abhd16b
  gRNA
gccgcaccgugguaacccgc

SEQ ID NO: 2433 - RNA, 20 nt, Artificial Sequence
  MKO10002433_A_Abhd17a
  gRNA
gcgguuggcgcgcgcgcucu

SEQ ID NO: 2434 - RNA, 20 nt, Artificial Sequence
  MKO10002434_A_Abhd17a
  gRNA
ugcagcuuggcuaggcgcgu

SEQ ID NO: 2435 - RNA, 20 nt, Artificial Sequence
  MKO10002435_A_Abhd17a
  gRNA
gcgugacgccagauccacug

SEQ ID NO: 2436 - RNA, 20 nt, Artificial Sequence
  MKO10002436_A_Abhd17b
  gRNA
ggcagcgcucaaacaaugcg

SEQ ID NO: 2437 - RNA, 20 nt, Artificial Sequence
  MKO10002437_A_Abhd17b
  gRNA
guuaaaacaguucgugucac

SEQ ID NO: 2438 - RNA, 20 nt, Artificial Sequence
  MKO10002438_A_Abhd17b
  gRNA
cacucucauagcgagcagcc

SEQ ID NO: 2439 - RNA, 20 nt, Artificial Sequence
  MKO10002439_A_Abhd17c
  gRNA
ugcaguugaugcgcgagccc

SEQ ID NO: 2440 - RNA, 20 nt, Artificial Sequence
  MKO10002440_A_Abhd17c
  gRNA
cauucacgguaccgaggaug

SEQ ID NO: 2441 - RNA, 20 nt, Artificial Sequence
  MKO10002441_A_Abhd17c
  gRNA
cgcgcacggcccgcgacaac

SEQ ID NO: 2442 - RNA, 20 nt, Artificial Sequence
  MKO10002442_A_Abhd1
  gRNA
uccggguagugagugcuguu

SEQ ID NO: 2443 - RNA, 20 nt, Artificial Sequence
  MKO10002443_A_Abhd1
  gRNA
gacccuucuuaccuccggua

SEQ ID NO: 2444 - RNA, 20 nt, Artificial Sequence
  MKO10002444_A_Abhd1
  gRNA
gcuguuguauuuaauaaccg

SEQ ID NO: 2445 - RNA, 20 nt, Artificial Sequence
  MKO10002445_A_Abhd2
  gRNA
ggugguuuagcacugcgcac

SEQ ID NO: 2446 - RNA, 20 nt, Artificial Sequence
  MKO10002446_A_Abhd2
  gRNA
uuucugggcauagucaacga

SEQ ID NO: 2447 - RNA, 20 nt, Artificial Sequence
  MKO10002447_A_Abhd2
  gRNA
ccagacccagcuggucgucg

SEQ ID NO: 2448 - RNA, 20 nt, Artificial Sequence
  MKO10002448_A_Abhd3
  gRNA
gacagaaaccuauuacccga

SEQ ID NO: 2449 - RNA, 20 nt, Artificial Sequence
  MKO10002449_A_Abhd3
  gRNA
uucgcacagcaguaaguccg

SEQ ID NO: 2450 - RNA, 20 nt, Artificial Sequence
  MKO10002450_A_Abhd3
  gRNA
ucuggcagcaggcguaucaa

SEQ ID NO: 2451 - RNA, 20 nt, Artificial Sequence
  MKO10002451_A_Abhd4
  gRNA
ggagggauacauaacgggcc

SEQ ID NO: 2452 - RNA, 20 nt, Artificial Sequence
  MKO10002452_A_Abhd4
  gRNA
cucccgccaugucucuauug

SEQ ID NO: 2453 - RNA, 20 nt, Artificial Sequence
  MKO10002453_A_Abhd4
  gRNA
cggaaucucugcaccagccc

SEQ ID NO: 2454 - RNA, 20 nt, Artificial Sequence
  MKO10002454_A_Abhd5
  gRNA
cccauggcucuacuaaaaug

SEQ ID NO: 2455 - RNA, 20 nt, Artificial Sequence
  MKO10002455_A_Abhd5
  gRNA
uaagucuagugcagcguuug

SEQ ID NO: 2456 - RNA, 20 nt, Artificial Sequence
  MKO10002456_A_Abhd5
  gRNA
uacuucuuccgaagcccaau

SEQ ID NO: 2457 - RNA, 20 nt, Artificial Sequence
  MKO10002457_A_Abhd6
  gRNA
uugacccuagguacuggcgg

SEQ ID NO: 2458 - RNA, 20 nt, Artificial Sequence
  MKO10002458_A_Abhd6
  gRNA
aguucgcuacgcacaccaug

SEQ ID NO: 2459 - RNA, 20 nt, Artificial Sequence
  MKO10002459_A_Abhd6
  gRNA
caccuccauggguggccacg

SEQ ID NO: 2460 - RNA, 20 nt, Artificial Sequence
  MKO10002460_A_Abhd8
  gRNA
gccgcccacggcguccgaag

SEQ ID NO: 2461 - RNA, 20 nt, Artificial Sequence
  MKO10002461_A_Abhd8
  gRNA
cacgaauguguagccgucac

SEQ ID NO: 2462 - RNA, 20 nt, Artificial Sequence
  MKO10002462_A_Abhd8
  gRNA
aacagcguguugaccguuuc

SEQ ID NO: 2463 - RNA, 20 nt, Artificial Sequence
  MKO10002463_A_Abi1
  gRNA
uccagaacuguauagucgau

SEQ ID NO: 2464 - RNA, 20 nt, Artificial Sequence
  MKO10002464_A_Abi1
  gRNA
uuucacaguaguccgccacc

SEQ ID NO: 2465 - RNA, 20 nt, Artificial Sequence
  MKO10002465_A_Abi1
  gRNA
accuaucgacuauacaguuc

SEQ ID NO: 2466 - RNA, 20 nt, Artificial Sequence
  MKO10002466_A_Abi2
  gRNA
accuagcccaacccguaaua

SEQ ID NO: 2467 - RNA, 20 nt, Artificial Sequence
  MKO10002467_A_Abi2
  gRNA
gcacucccccuaucgaacac

SEQ ID NO: 2468 - RNA, 20 nt, Artificial Sequence
  MKO10002468_A_Abi2
  gRNA
ugcguaucugauaaacaccu

SEQ ID NO: 2469 - RNA, 20 nt, Artificial Sequence
  MKO10002469_A_Abi3bp
  gRNA
cguacgacuaucagauacuu

SEQ ID NO: 2470 - RNA, 20 nt, Artificial Sequence
  MKO10002470_A_Abi3bp
  gRNA
uccaaaugcaaacguaaagc

SEQ ID NO: 2471 - RNA, 20 nt, Artificial Sequence
  MKO10002471_A_Abi3bp
  gRNA
cccucgcaaaccccuccagc

SEQ ID NO: 2472 - RNA, 20 nt, Artificial Sequence
  MKO10002472_A_Abi3
  gRNA
cagcgccuuccgcuugucug

SEQ ID NO: 2473 - RNA, 20 nt, Artificial Sequence
  MKO10002473_A_Abi3
  gRNA
uacaccuguuuccgccacgc

SEQ ID NO: 2474 - RNA, 20 nt, Artificial Sequence
  MKO10002474_A_Abi3
  gRNA
cgggcauacucuucgaaugc

SEQ ID NO: 2475 - RNA, 20 nt, Artificial Sequence
  MKO10002475_A_Abl1
  gRNA
cccuucauaccgcagcgaga

SEQ ID NO: 2476 - RNA, 20 nt, Artificial Sequence
  MKO10002476_A_Abl1
  gRNA
aagggaggguguaccacuac

SEQ ID NO: 2477 - RNA, 20 nt, Artificial Sequence
  MKO10002477_A_Abl1
  gRNA
cgagagccgcuucaacacuc

SEQ ID NO: 2478 - RNA, 20 nt, Artificial Sequence
  MKO10002478_A_Abl2
  gRNA
ucugcugcgcugcgggauac

SEQ ID NO: 2479 - RNA, 20 nt, Artificial Sequence
  MKO10002479_A_Abl2
  gRNA
gccccggagccuccccgacg

SEQ ID NO: 2480 - RNA, 20 nt, Artificial Sequence
  MKO10002480_A_Abl2
  gRNA
cgucugcgguacgccccgcc

SEQ ID NO: 2481 - RNA, 20 nt, Artificial Sequence
  MKO10002481_A_Ablim1
  gRNA
gucauagaucgccuugaccu

SEQ ID NO: 2482 - RNA, 20 nt, Artificial Sequence
  MKO10002482_A_Ablim1
  gRNA
gaaaguaucuauucuagacc

SEQ ID NO: 2483 - RNA, 20 nt, Artificial Sequence
  MKO10002483_A_Ablim1
  gRNA
cuuacagucgggaugccaca

SEQ ID NO: 2484 - RNA, 20 nt, Artificial Sequence
  MKO10002484_A_Ablim2
  gRNA
ccgugugaccuucaacggga

SEQ ID NO: 2485 - RNA, 20 nt, Artificial Sequence
  MKO10002485_A_Ablim2
  gRNA
cauacacuccuucccguuga

SEQ ID NO: 2486 - RNA, 20 nt, Artificial Sequence
  MKO10002486_A_Ablim2
  gRNA
auuacacaggaucgcagugc

SEQ ID NO: 2487 - RNA, 20 nt, Artificial Sequence
  MKO10002487_A_Ablim3
  gRNA
agcaagccgaucaagauccg

SEQ ID NO: 2488 - RNA, 20 nt, Artificial Sequence
  MKO10002488_A_Ablim3
  gRNA
aagcugcauacgaagcauuu

SEQ ID NO: 2489 - RNA, 20 nt, Artificial Sequence
  MKO10002489_A_Ablim3
  gRNA
gucauccagugcuaccgcug

SEQ ID NO: 2490 - RNA, 20 nt, Artificial Sequence
  MKO10002490_A_Abo
  gRNA
auucaauaugucgauguuga

SEQ ID NO: 2491 - RNA, 20 nt, Artificial Sequence
  MKO10002491_A_Abo
  gRNA
cuggcgcccaucaucuggga

SEQ ID NO: 2492 - RNA, 20 nt, Artificial Sequence
  MKO10002492_A_Abo
  gRNA
gacuaagacaaacacugcga

SEQ ID NO: 2493 - RNA, 20 nt, Artificial Sequence
  MKO10002493_A_Abracl
  gRNA
ugccaaucucuuugaagcgu

SEQ ID NO: 2494 - RNA, 20 nt, Artificial Sequence
  MKO10002494_A_Abracl
  gRNA
aguacuuacuucuggaaccc

SEQ ID NO: 2495 - RNA, 20 nt, Artificial Sequence
  MKO10002495_A_Abracl
  gRNA
uaccaacgcuucaaagagau

SEQ ID NO: 2496 - RNA, 20 nt, Artificial Sequence
  MKO10002496_A_Abra
  gRNA
gaugugcucuuccgcucgcu

SEQ ID NO: 2497 - RNA, 20 nt, Artificial Sequence
  MKO10002497_A_Abra
  gRNA
uuagucacgacucgccaaca

SEQ ID NO: 2498 - RNA, 20 nt, Artificial Sequence
  MKO10002498_A_Abra
  gRNA
ugucccucuccgucucgauc

SEQ ID NO: 2499 - RNA, 20 nt, Artificial Sequence
  MKO10002499_A_Abr
  gRNA
ggauaacuauaaagucgcuc

SEQ ID NO: 2500 - RNA, 20 nt, Artificial Sequence
  MKO10002500_A_Abr
  gRNA
ugacucgucgauguacggca

SEQ ID NO: 2501 - RNA, 20 nt, Artificial Sequence
  MKO10002501_A_Abr
  gRNA
cagcucagcgcccgcagcca

SEQ ID NO: 2502 - RNA, 20 nt, Artificial Sequence
  MKO10002502_A_Abt1
  gRNA
aacgcgucccaccucgccgu

SEQ ID NO: 2503 - RNA, 20 nt, Artificial Sequence
  MKO10002503_A_Abt1
  gRNA
ccuuugagcgccaaguacga

SEQ ID NO: 2504 - RNA, 20 nt, Artificial Sequence
  MKO10002504_A_Abt1
  gRNA
cgcaaccugcucagcgccua

SEQ ID NO: 2505 - RNA, 20 nt, Artificial Sequence
  MKO10002505_A_Abtb1
  gRNA
ccugcuggagcagcgagacg

SEQ ID NO: 2506 - RNA, 20 nt, Artificial Sequence
  MKO10002506_A_Abtb1
  gRNA
auaguaaucccgccuccugc

SEQ ID NO: 2507 - RNA, 20 nt, Artificial Sequence
  MKO10002507_A_Abtb1
  gRNA
ccacgucucgcugcuccagc

SEQ ID NO: 2508 - RNA, 20 nt, Artificial Sequence
  MKO10002508_A_Abtb2
  gRNA
ugcuacugaacgcuucaacc

SEQ ID NO: 2509 - RNA, 20 nt, Artificial Sequence
  MKO10002509_A_Abtb2
  gRNA
gcgauauccggcaggcagcc

SEQ ID NO: 2510 - RNA, 20 nt, Artificial Sequence
  MKO10002510_A_Abtb2
  gRNA
acaccgucgcagccccacug

SEQ ID NO: 2511 - RNA, 20 nt, Artificial Sequence
  MKO10002511_A_Acaa1a
  gRNA
cacgcaucgcccaauuucug

SEQ ID NO: 2512 - RNA, 20 nt, Artificial Sequence
  MKO10002512_A_Acaa1a
  gRNA
acaggcaauguucuugagcc

SEQ ID NO: 2513 - RNA, 20 nt, Artificial Sequence
  MKO10002513_A_Acaa1a
  gRNA
ccucacguccuggagaaccg

SEQ ID NO: 2514 - RNA, 20 nt, Artificial Sequence
  MKO10002514_A_Acaa1b
  gRNA
cacgcaucgcccaguuccug

SEQ ID NO: 2515 - RNA, 20 nt, Artificial Sequence
  MKO10002515_A_Acaa1b
  gRNA
ugccauaauggcuccagccc

SEQ ID NO: 2516 - RNA, 20 nt, Artificial Sequence
  MKO10002516_A_Acaa1b
  gRNA
cuucacguccuggagaaccg

SEQ ID NO: 2517 - RNA, 20 nt, Artificial Sequence
  MKO10002517_A_Acaa2
  gRNA
gcccacgaugacacuaucga

SEQ ID NO: 2518 - RNA, 20 nt, Artificial Sequence
  MKO10002518_A_Acaa2
  gRNA
uaccugacauccgcucacga

SEQ ID NO: 2519 - RNA, 20 nt, Artificial Sequence
  MKO10002519_A_Acaa2
  gRNA
gcaaacccacaugccucgcc

SEQ ID NO: 2520 - RNA, 20 nt, Artificial Sequence
  MKO10002520_A_Acaca
  gRNA
gcagaauuuguuacucguuu

SEQ ID NO: 2521 - RNA, 20 nt, Artificial Sequence
  MKO10002521_A_Acaca
  gRNA
aaugcaugcgaucuauccgu

SEQ ID NO: 2522 - RNA, 20 nt, Artificial Sequence
  MKO10002522_A_Acaca
  gRNA
acauuucauaagaccaccga

SEQ ID NO: 2523 - RNA, 20 nt, Artificial Sequence
  MKO10002523_A_Acacb
  gRNA
cguggucauggugacgcccg

SEQ ID NO: 2524 - RNA, 20 nt, Artificial Sequence
  MKO10002524_A_Acacb
  gRNA
guaugcgcuccauccgccgc

SEQ ID NO: 2525 - RNA, 20 nt, Artificial Sequence
  MKO10002525_A_Acacb
  gRNA
cgacggugaaaucucugugc

SEQ ID NO: 2526 - RNA, 20 nt, Artificial Sequence
  MKO10002526_A_Acad10
  gRNA
gauaacgaccgagcacuucu

SEQ ID NO: 2527 - RNA, 20 nt, Artificial Sequence
  MKO10002527_A_Acad10
  gRNA
accuucccuaccgguggagu

SEQ ID NO: 2528 - RNA, 20 nt, Artificial Sequence
  MKO10002528_A_Acad10
  gRNA
gcaguucccggugaugacuc

SEQ ID NO: 2529 - RNA, 20 nt, Artificial Sequence
  MKO10002529_A_Acad11
  gRNA
cuugcgguaccucuuugggg

SEQ ID NO: 2530 - RNA, 20 nt, Artificial Sequence
  MKO10002530_A_Acad11
  gRNA
ucgcugaagcuggacaaaua

SEQ ID NO: 2531 - RNA, 20 nt, Artificial Sequence
  MKO10002531_A_Acad11
  gRNA
gguccacggagacuucaagc

SEQ ID NO: 2532 - RNA, 20 nt, Artificial Sequence
  MKO10002532_A_Acad12
  gRNA
cuucgccaugacugaucgaa

SEQ ID NO: 2533 - RNA, 20 nt, Artificial Sequence
  MKO10002533_A_Acad12
  gRNA
ugguaccuuucgaucaguca

SEQ ID NO: 2534 - RNA, 20 nt, Artificial Sequence
  MKO10002534_A_Acad12
  gRNA
agggcuccaccuguuggccg

SEQ ID NO: 2535 - RNA, 20 nt, Artificial Sequence
  MKO10002535_A_Acad8
  gRNA
cugaucccacuccgccauau

SEQ ID NO: 2536 - RNA, 20 nt, Artificial Sequence
  MKO10002536_A_Acad8
  gRNA
uggcucccaauauggcggag

SEQ ID NO: 2537 - RNA, 20 nt, Artificial Sequence
  MKO10002537_A_Acad8
  gRNA
gccuuccgcaucacauccac

SEQ ID NO: 2538 - RNA, 20 nt, Artificial Sequence
  MKO10002538_A_Acad9
  gRNA
gagccgagcauacaucgugu

SEQ ID NO: 2539 - RNA, 20 nt, Artificial Sequence
  MKO10002539_A_Acad9
  gRNA
ggacucucgaaaaauugacc

SEQ ID NO: 2540 - RNA, 20 nt, Artificial Sequence
  MKO10002540_A_Acad9
  gRNA
uaucugcccaaacugucguc

SEQ ID NO: 2541 - RNA, 20 nt, Artificial Sequence
  MKO10002541_A_Acadl
  gRNA
ugugccguaauucgcaauau

SEQ ID NO: 2542 - RNA, 20 nt, Artificial Sequence
  MKO10002542_A_Acadl
  gRNA
agagcguacuccaauugcac

SEQ ID NO: 2543 - RNA, 20 nt, Artificial Sequence
  MKO10002543_A_Acadl
  gRNA
agaacgaacgccaaaagauc

SEQ ID NO: 2544 - RNA, 20 nt, Artificial Sequence
  MKO10002544_A_Acadm
  gRNA
cuugaucaacgcgcacauuc

SEQ ID NO: 2545 - RNA, 20 nt, Artificial Sequence
  MKO10002545_A_Acadm
  gRNA
ugcccgcaaguuugccagag

SEQ ID NO: 2546 - RNA, 20 nt, Artificial Sequence
  MKO10002546_A_Acadm
  gRNA
guugaucaagccgaguuccc

SEQ ID NO: 2547 - RNA, 20 nt, Artificial Sequence
  MKO10002547_A_Acadsb
  gRNA
cauagcgaaagagucgcuac

SEQ ID NO: 2548 - RNA, 20 nt, Artificial Sequence
  MKO10002548_A_Acadsb
  gRNA
uccucaaugggucgaagaug

SEQ ID NO: 2549 - RNA, 20 nt, Artificial Sequence
  MKO10002549_A_Acadsb
  gRNA
cugcucuguccuagugauag

SEQ ID NO: 2550 - RNA, 20 nt, Artificial Sequence
  MKO10002550_A_Acads
  gRNA
gguccccauugcggcccagc

SEQ ID NO: 2551 - RNA, 20 nt, Artificial Sequence
  MKO10002551_A_Acads
  gRNA
gacgcucaugauaacucccg

SEQ ID NO: 2552 - RNA, 20 nt, Artificial Sequence
  MKO10002552_A_Acads
  gRNA
augccgugacuuugccgaga

SEQ ID NO: 2553 - RNA, 20 nt, Artificial Sequence
  MKO10002553_A_Acadvl
  gRNA
cugcccagcgacuuuaugcc

SEQ ID NO: 2554 - RNA, 20 nt, Artificial Sequence
  MKO10002554_A_Acadvl
  gRNA
aggccagcuuaccauugauc

SEQ ID NO: 2555 - RNA, 20 nt, Artificial Sequence
  MKO10002555_A_Acadvl
  gRNA
accaguggcccgguucuuug

SEQ ID NO: 2556 - RNA, 20 nt, Artificial Sequence
  MKO10002556_A_Acan
  gRNA
ggcuuccaccagugcgaugc

SEQ ID NO: 2557 - RNA, 20 nt, Artificial Sequence
  MKO10002557_A_Acan
  gRNA
agaugggguagcgcacgcug

SEQ ID NO: 2558 - RNA, 20 nt, Artificial Sequence
  MKO10002558_A_Acan
  gRNA
uauuuccacacgcuacaccc

SEQ ID NO: 2559 - RNA, 20 nt, Artificial Sequence
  MKO10002559_A_Acap1
  gRNA
gccaacaacgaaggcacgac

SEQ ID NO: 2560 - RNA, 20 nt, Artificial Sequence
  MKO10002560_A_Acap1
  gRNA
aguuuccaccaguucaaucg

SEQ ID NO: 2561 - RNA, 20 nt, Artificial Sequence
  MKO10002561_A_Acap1
  gRNA
ucccagagccucgauugaac

SEQ ID NO: 2562 - RNA, 20 nt, Artificial Sequence
  MKO10002562_A_Acap2
  gRNA
uguaucgcgaugauugacac

SEQ ID NO: 2563 - RNA, 20 nt, Artificial Sequence
  MKO10002563_A_Acap2
  gRNA
cagcaucauugcuagaauac

SEQ ID NO: 2564 - RNA, 20 nt, Artificial Sequence
  MKO10002564_A_Acap2
  gRNA
ccaaacccagagaucaauua

SEQ ID NO: 2565 - RNA, 20 nt, Artificial Sequence
  MKO10002565_A_Acap3
  gRNA
gcugcugccgcaccgaucuc

SEQ ID NO: 2566 - RNA, 20 nt, Artificial Sequence
  MKO10002566_A_Acap3
  gRNA
ccgagaugacggugucgccc

SEQ ID NO: 2567 - RNA, 20 nt, Artificial Sequence
  MKO10002567_A_Acap3
  gRNA
uugcagggcaacuauugaug

SEQ ID NO: 2568 - RNA, 20 nt, Artificial Sequence
  MKO10002568_A_Acau1
  gRNA
agugcuauaagaacucccau

SEQ ID NO: 2569 - RNA, 20 nt, Artificial Sequence
  MKO10002569_A_Acau1
  gRNA
uggaugcauaacuucguucc

SEQ ID NO: 2570 - RNA, 20 nt, Artificial Sequence
  MKO10002570_A_Acau1
  gRNA
ugcgcccaguguugcuugcc

SEQ ID NO: 2571 - RNA, 20 nt, Artificial Sequence
  MKO10002571_A_Acau2
  gRNA
caggaugggugaggugccac

SEQ ID NO: 2572 - RNA, 20 nt, Artificial Sequence
  MKO10002572_A_Acau2
  gRNA
ccauccugacuccuguucuc

SEQ ID NO: 2573 - RNA, 20 nt, Artificial Sequence
  MKO10002573_A_Acau2
  gRNA
uccauuguaggcuccuucaa

SEQ ID NO: 2574 - RNA, 20 nt, Artificial Sequence
  MKO10002574_A_Acau3
  gRNA
cagggugggugaggugccac

SEQ ID NO: 2575 - RNA, 20 nt, Artificial Sequence
  MKO10002575_A_Acau3
  gRNA
ccacccugacuccuguucuc

SEQ ID NO: 2576 - RNA, 20 nt, Artificial Sequence
  MKO10002576_A_Acau3
  gRNA
uccauuguaggcuccuucaa

SEQ ID NO: 2577 - RNA, 20 nt, Artificial Sequence
  MKO10002577_A_Acbd3
  gRNA
uaacccagacacguccccug

SEQ ID NO: 2578 - RNA, 20 nt, Artificial Sequence
  MKO10002578_A_Acbd3
  gRNA
gauucucauccgccagcugc

SEQ ID NO: 2579 - RNA, 20 nt, Artificial Sequence
  MKO10002579_A_Acbd3
  gRNA
accguguagaaaggcggagg

SEQ ID NO: 2580 - RNA, 20 nt, Artificial Sequence
  MKO10002580_A_Acbd4
  gRNA
gagcccggcguuccgcagaa

SEQ ID NO: 2581 - RNA, 20 nt, Artificial Sequence
  MKO10002581_A_Acbd4
  gRNA
ccgcaccgcgcgacagcccg

SEQ ID NO: 2582 - RNA, 20 nt, Artificial Sequence
  MKO10002582_A_Acbd4
  gRNA
ucaccacuuguaacguccaa

SEQ ID NO: 2583 - RNA, 20 nt, Artificial Sequence
  MKO10002583_A_Acbd5
  gRNA
ucuucuacaaucucguaaaa

SEQ ID NO: 2584 - RNA, 20 nt, Artificial Sequence
  MKO10002584_A_Acbd5
  gRNA
cuucacggccgccucaaauc

SEQ ID NO: 2585 - RNA, 20 nt, Artificial Sequence
  MKO10002585_A_Acbd5
  gRNA
uccaggccgugaaaguuuac

SEQ ID NO: 2586 - RNA, 20 nt, Artificial Sequence
  MKO10002586_A_Acbd6
  gRNA
ccccgaggguaggaacggug

SEQ ID NO: 2587 - RNA, 20 nt, Artificial Sequence
  MKO10002587_A_Acbd6
  gRNA
gccaccacaggcgacagcgg

SEQ ID NO: 2588 - RNA, 20 nt, Artificial Sequence
  MKO10002588_A_Acbd6
  gRNA
cgauauauuccugcauugcu

SEQ ID NO: 2589 - RNA, 20 nt, Artificial Sequence
  MKO10002589_A_Acbd7
  gRNA
ugucucucuaggguugucga

SEQ ID NO: 2590 - RNA, 20 nt, Artificial Sequence
  MKO10002590_A_Acbd7
  gRNA
cccuuuagaucuaacauugc

SEQ ID NO: 2591 - RNA, 20 nt, Artificial Sequence
  MKO10002591_A_Acbd7
  gRNA
cccagcaauguuagaucuaa

SEQ ID NO: 2592 - RNA, 20 nt, Artificial Sequence
  MKO10002592_A_Accsl
  gRNA
ugcuuacccucgcuguuauc

SEQ ID NO: 2593 - RNA, 20 nt, Artificial Sequence
  MKO10002593_A_Accsl
  gRNA
gccuugaccugauaacagcg

SEQ ID NO: 2594 - RNA, 20 nt, Artificial Sequence
  MKO10002594_A_Accsl
  gRNA
gcagaugcagugcgucccgc

SEQ ID NO: 2595 - RNA, 20 nt, Artificial Sequence
  MKO10002595_A_Accs
  gRNA
uacucacccgccaggacaga

SEQ ID NO: 2596 - RNA, 20 nt, Artificial Sequence
  MKO10002596_A_Accs
  gRNA
acagggugacaugcuucaug

SEQ ID NO: 2597 - RNA, 20 nt, Artificial Sequence
  MKO10002597_A_Accs
  gRNA
acguaggugguuguucugaa

SEQ ID NO: 2598 - RNA, 20 nt, Artificial Sequence
  MKO10002598_A_Acd
  gRNA
acgccaucgacaccuccgac

SEQ ID NO: 2599 - RNA, 20 nt, Artificial Sequence
  MKO10002599_A_Acd
  gRNA
uuaccagucggaggugucga

SEQ ID NO: 2600 - RNA, 20 nt, Artificial Sequence
  MKO10002600_A_Acd
  gRNA
gcagguuaaagcgauccacc

SEQ ID NO: 2601 - RNA, 20 nt, Artificial Sequence
  MKO10002601_A_Ace2
  gRNA
uguagaacguaccuucgcag

SEQ ID NO: 2602 - RNA, 20 nt, Artificial Sequence
  MKO10002602_A_Ace2
  gRNA
uguaguugacgcuugaugau

SEQ ID NO: 2603 - RNA, 20 nt, Artificial Sequence
  MKO10002603_A_Ace2
  gRNA
gaucaucaagcgucaacuac

SEQ ID NO: 2604 - RNA, 20 nt, Artificial Sequence
  MKO10002604_A_Ace3
  gRNA
caccucuaggagauccuccg

SEQ ID NO: 2605 - RNA, 20 nt, Artificial Sequence
  MKO10002605_A_Ace3
  gRNA
cguacguaguccucaaagac

SEQ ID NO: 2606 - RNA, 20 nt, Artificial Sequence
  MKO10002606_A_Ace3
  gRNA
uaaacucauucaacacgacc

SEQ ID NO: 2607 - RNA, 20 nt, Artificial Sequence
  MKO10002607_A_Acer1
  gRNA
cguaugcccagaagcguacc

SEQ ID NO: 2608 - RNA, 20 nt, Artificial Sequence
  MKO10002608_A_Acer1
  gRNA
ccuguuccccuugacgaacu

SEQ ID NO: 2609 - RNA, 20 nt, Artificial Sequence
  MKO10002609_A_Acer1
  gRNA
acucugugcgcacaauguag

SEQ ID NO: 2610 - RNA, 20 nt, Artificial Sequence
  MKO10002610_A_Acer2
  gRNA
uguugaagcacguugcguac

SEQ ID NO: 2611 - RNA, 20 nt, Artificial Sequence
  MKO10002611_A_Acer2
  gRNA
auggacgcuccuaguuguag

SEQ ID NO: 2612 - RNA, 20 nt, Artificial Sequence
  MKO10002612_A_Acer2
  gRNA
gucugcaauuacaacgugcu

SEQ ID NO: 2613 - RNA, 20 nt, Artificial Sequence
  MKO10002613_A_Acer3
  gRNA
uaugcagcagcuguaaauca

SEQ ID NO: 2614 - RNA, 20 nt, Artificial Sequence
  MKO10002614_A_Acer3
  gRNA
ccuugaauugcaccaaaaau

SEQ ID NO: 2615 - RNA, 20 nt, Artificial Sequence
  MKO10002615_A_Acer3
  gRNA
gcugcuuacuuagcacucac

SEQ ID NO: 2616 - RNA, 20 nt, Artificial Sequence
  MKO10002616_A_Ace
  gRNA
cguacucguucaacaacacu

SEQ ID NO: 2617 - RNA, 20 nt, Artificial Sequence
  MKO10002617_A_Ace
  gRNA
guuguugaacgaguacgcag

SEQ ID NO: 2618 - RNA, 20 nt, Artificial Sequence
  MKO10002618_A_Ace
  gRNA
cuucuuuaugauccgcuuga

SEQ ID NO: 2619 - RNA, 20 nt, Artificial Sequence
  MKO10002619_A_Ache
  gRNA
gcgcccagaccugcgccuuc

SEQ ID NO: 2620 - RNA, 20 nt, Artificial Sequence
  MKO10002620_A_Ache
  gRNA
aaaugucugcuaccaguacg

SEQ ID NO: 2621 - RNA, 20 nt, Artificial Sequence
  MKO10002621_A_Ache
  gRNA
ggacgagggcuccuacuuuc

SEQ ID NO: 2622 - RNA, 20 nt, Artificial Sequence
  MKO10002622_A_Acin1
  gRNA
agccuggccgaaaacgccgu

SEQ ID NO: 2623 - RNA, 20 nt, Artificial Sequence
  MKO10002623_A_Acin1
  gRNA
acagagcguaauggcgacga

SEQ ID NO: 2624 - RNA, 20 nt, Artificial Sequence
  MKO10002624_A_Acin1
  gRNA
guuuccagcuugcacccccu

SEQ ID NO: 2625 - RNA, 20 nt, Artificial Sequence
  MKO10002625_A_Ackr2
  gRNA
agcuccaucguccgucuucg

SEQ ID NO: 2626 - RNA, 20 nt, Artificial Sequence
  MKO10002626_A_Ackr2
  gRNA
uaaguagucguagucguaga

SEQ ID NO: 2627 - RNA, 20 nt, Artificial Sequence
  MKO10002627_A_Ackr2
  gRNA
ugaccagaacgcaaccgaug

SEQ ID NO: 2628 - RNA, 20 nt, Artificial Sequence
  MKO10002628_A_Ackr3
  gRNA
gucucgugcagcauaaccag

SEQ ID NO: 2629 - RNA, 20 nt, Artificial Sequence
  MKO10002629_A_Ackr3
  gRNA
acgccguguuguaugcaucu

SEQ ID NO: 2630 - RNA, 20 nt, Artificial Sequence
  MKO10002630_A_Ackr3
  gRNA
gcuucaucaaccgcaacuac

SEQ ID NO: 2631 - RNA, 20 nt, Artificial Sequence
  MKO10002631_A_Ackr4
  gRNA
uuaaaaagucucgcccccuc

SEQ ID NO: 2632 - RNA, 20 nt, Artificial Sequence
  MKO10002632_A_Ackr4
  gRNA
gcguuugcucauaucgcagc

SEQ ID NO: 2633 - RNA, 20 nt, Artificial Sequence
  MKO10002633_A_Ackr4
  gRNA
cauaauaguauuccgcugac

SEQ ID NO: 2634 - RNA, 20 nt, Artificial Sequence
  MKO10002634_A_Acly
  gRNA
agaaccgguucaaguacgcc

SEQ ID NO: 2635 - RNA, 20 nt, Artificial Sequence
  MKO10002635_A_Acly
  gRNA
uuccucgacguuugauuaac

SEQ ID NO: 2636 - RNA, 20 nt, Artificial Sequence
  MKO10002636_A_Acly
  gRNA
gagagagauugaccccgacg

SEQ ID NO: 2637 - RNA, 20 nt, Artificial Sequence
  MKO10002637_A_Acmsd
  gRNA
ccguugccagauacccucga

SEQ ID NO: 2638 - RNA, 20 nt, Artificial Sequence
  MKO10002638_A_Acmsd
  gRNA
ggagauggagcguuguguua

SEQ ID NO: 2639 - RNA, 20 nt, Artificial Sequence
  MKO10002639_A_Acmsd
  gRNA
acccaguagcuaaacaugac

SEQ ID NO: 2640 - RNA, 20 nt, Artificial Sequence
  MKO10002640_A_Acn9
  gRNA
uaaauucguccuucacguac

SEQ ID NO: 2641 - RNA, 20 nt, Artificial Sequence
  MKO10002641_A_Acn9
  gRNA
aguacgugaaggacgaauuu

SEQ ID NO: 2642 - RNA, 20 nt, Artificial Sequence
  MKO10002642_A_Acn9
  gRNA
agacguacgcagcagugcug

SEQ ID NO: 2643 - RNA, 20 nt, Artificial Sequence
  MKO10002643_A_Acnau1
  gRNA
gguugugacacccauccaac

SEQ ID NO: 2644 - RNA, 20 nt, Artificial Sequence
  MKO10002644_A_Acnau1
  gRNA
agccgucccacuaagauacc

SEQ ID NO: 2645 - RNA, 20 nt, Artificial Sequence
  MKO10002645_A_Acnau1
  gRNA
ugaauuucgugccagucuuu

SEQ ID NO: 2646 - RNA, 20 nt, Artificial Sequence
  MKO10002646_A_Acnau2
  gRNA
cggauccaaguccaugauuc

SEQ ID NO: 2647 - RNA, 20 nt, Artificial Sequence
  MKO10002647_A_Acnau2
  gRNA
acuuggauccguuccagagc

SEQ ID NO: 2648 - RNA, 20 nt, Artificial Sequence
  MKO10002648_A_Acnau2
  gRNA
aucccacggcuuugcugugc

SEQ ID NO: 2649 - RNA, 20 nt, Artificial Sequence
  MKO10002649_A_Aco1
  gRNA
aacaugcggauaaucccucc

SEQ ID NO: 2650 - RNA, 20 nt, Artificial Sequence
  MKO10002650_A_Aco1
  gRNA
gauuauccgcauguugcaaa

SEQ ID NO: 2651 - RNA, 20 nt, Artificial Sequence
  MKO10002651_A_Aco1
  gRNA
gcgcgaugcugugaagaagu

SEQ ID NO: 2652 - RNA, 20 nt, Artificial Sequence
  MKO10002652_A_Aco2
  gRNA
ucuuuccccgcucgaucucc

SEQ ID NO: 2653 - RNA, 20 nt, Artificial Sequence
  MKO10002653_A_Aco2
  gRNA
ggcucaccuuggcccugcgc

SEQ ID NO: 2654 - RNA, 20 nt, Artificial Sequence
  MKO10002654_A_Aco2
  gRNA
acauuaacauuguccguaaa

SEQ ID NO: 2655 - RNA, 20 nt, Artificial Sequence
  MKO10002655_A_Acot10
  gRNA
uugaauacauuucguuccug

SEQ ID NO: 2656 - RNA, 20 nt, Artificial Sequence
  MKO10002656_A_Acot10
  gRNA
augucucaucaucgugcagc

SEQ ID NO: 2657 - RNA, 20 nt, Artificial Sequence
  MKO10002657_A_Acot10
  gRNA
ugcacgaugaugagacauau

SEQ ID NO: 2658 - RNA, 20 nt, Artificial Sequence
  MKO10002658_A_Acot11
  gRNA
ucuacuucgaccauaccauu

SEQ ID NO: 2659 - RNA, 20 nt, Artificial Sequence
  MKO10002659_A_Acot11
  gRNA
uguucucuaaucgcacaucc

SEQ ID NO: 2660 - RNA, 20 nt, Artificial Sequence
  MKO10002660_A_Acot11
  gRNA
ucaaucucccauccggaguc

SEQ ID NO: 2661 - RNA, 20 nt, Artificial Sequence
  MKO10002661_A_Acot12
  gRNA
acguuuguagcuaaaccagu

SEQ ID NO: 2662 - RNA, 20 nt, Artificial Sequence
  MKO10002662_A_Acot12
  gRNA
cauccagaagcuccucugcg

SEQ ID NO: 2663 - RNA, 20 nt, Artificial Sequence
  MKO10002663_A_Acot12
  gRNA
uugaaagccgaaaagcaugc

SEQ ID NO: 2664 - RNA, 20 nt, Artificial Sequence
  MKO10002664_A_Acot13
  gRNA
uaaccuucauuacuucucgu

SEQ ID NO: 2665 - RNA, 20 nt, Artificial Sequence
  MKO10002665_A_Acot13
  gRNA
cuuguuggucagauccacug

SEQ ID NO: 2666 - RNA, 20 nt, Artificial Sequence
  MKO10002666_A_Acot13
  gRNA
gaaccuacgagaaguaauga

SEQ ID NO: 2667 - RNA, 20 nt, Artificial Sequence
  MKO10002667_A_Acot1
  gRNA
cgagcgucacuucuuggcuc

SEQ ID NO: 2668 - RNA, 20 nt, Artificial Sequence
  MKO10002668_A_Acot1
  gRNA
cgcuugaccaaucgccaaaa

SEQ ID NO: 2669 - RNA, 20 nt, Artificial Sequence
  MKO10002669_A_Acot1
  gRNA
ugugacuauccugagaaauc

SEQ ID NO: 2670 - RNA, 20 nt, Artificial Sequence
  MKO10002670_A_Acot2
  gRNA
gcgcgcuaccgcgccgacgc

SEQ ID NO: 2671 - RNA, 20 nt, Artificial Sequence
  MKO10002671_A_Acot2
  gRNA
cgcauuuguccgcgcccaag

SEQ ID NO: 2672 - RNA, 20 nt, Artificial Sequence
  MKO10002672_A_Acot2
  gRNA
ucuugcuacccaacuguuug

SEQ ID NO: 2673 - RNA, 20 nt, Artificial Sequence
  MKO10002673_A_Acot3
  gRNA
cuguaaguuuccgccgaugu

SEQ ID NO: 2674 - RNA, 20 nt, Artificial Sequence
  MKO10002674_A_Acot3
  gRNA
cggcggaaacuuacaguaca

SEQ ID NO: 2675 - RNA, 20 nt, Artificial Sequence
  MKO10002675_A_Acot3
  gRNA
ucuggcuuauaacaacuacg

SEQ ID NO: 2676 - RNA, 20 nt, Artificial Sequence
  MKO10002676_A_Acot4
  gRNA
auggcccaacggcggaauca

SEQ ID NO: 2677 - RNA, 20 nt, Artificial Sequence
  MKO10002677_A_Acot4
  gRNA
gcagaccaugauuccgccgu

SEQ ID NO: 2678 - RNA, 20 nt, Artificial Sequence
  MKO10002678_A_Acot4
  gRNA
ggccuguuggaauaccgagc

SEQ ID NO: 2679 - RNA, 20 nt, Artificial Sequence
  MKO10002679_A_Acot5
  gRNA
uguugaaauaacguugaccg

SEQ ID NO: 2680 - RNA, 20 nt, Artificial Sequence
  MKO10002680_A_Acot5
  gRNA
aaaagucuggagccgcugcc

SEQ ID NO: 2681 - RNA, 20 nt, Artificial Sequence
  MKO10002681_A_Acot5
  gRNA
ccuucaucuggaguacuuug

SEQ ID NO: 2682 - RNA, 20 nt, Artificial Sequence
  MKO10002682_A_Acot6
  gRNA
aaaucugagugacguucgcc

SEQ ID NO: 2683 - RNA, 20 nt, Artificial Sequence
  MKO10002683_A_Acot6
  gRNA
gaaaguuugaaugcguugcc

SEQ ID NO: 2684 - RNA, 20 nt, Artificial Sequence
  MKO10002684_A_Acot6
  gRNA
agccacuguacacuucgugu

SEQ ID NO: 2685 - RNA, 20 nt, Artificial Sequence
  MKO10002685_A_Acot7
  gRNA
cuucccacaguauuuacggc

SEQ ID NO: 2686 - RNA, 20 nt, Artificial Sequence
  MKO10002686_A_Acot7
  gRNA
ggauguucuccgacaucacg

SEQ ID NO: 2687 - RNA, 20 nt, Artificial Sequence
  MKO10002687_A_Acot7
  gRNA
agccaccucgccgaugcaca

SEQ ID NO: 2688 - RNA, 20 nt, Artificial Sequence
  MKO10002688_A_Acot8
  gRNA
ccccauuccgagccgaccac

SEQ ID NO: 2689 - RNA, 20 nt, Artificial Sequence
  MKO10002689_A_Acot8
  gRNA
ccacucgauacuucuuguga

SEQ ID NO: 2690 - RNA, 20 nt, Artificial Sequence
  MKO10002690_A_Acot8
  gRNA
cagugcuguaccacguagag

SEQ ID NO: 2691 - RNA, 20 nt, Artificial Sequence
  MKO10002691_A_Acot9
  gRNA
uaguaggcguauccacaguc

SEQ ID NO: 2692 - RNA, 20 nt, Artificial Sequence
  MKO10002692_A_Acot9
  gRNA
uaguaccuccuaggcuguca

SEQ ID NO: 2693 - RNA, 20 nt, Artificial Sequence
  MKO10002693_A_Acot9
  gRNA
uuucaguucgagacaagcug

SEQ ID NO: 2694 - RNA, 20 nt, Artificial Sequence
  MKO10002694_A_Acox1
  gRNA
cacucgaagccagcguuacg

SEQ ID NO: 2695 - RNA, 20 nt, Artificial Sequence
  MKO10002695_A_Acox1
  gRNA
uaacagccaccucguaacgc

SEQ ID NO: 2696 - RNA, 20 nt, Artificial Sequence
  MKO10002696_A_Acox1
  gRNA
aucacucgaggggagugcua

SEQ ID NO: 2697 - RNA, 20 nt, Artificial Sequence
  MKO10002697_A_Acox2
  gRNA
cugaacgcauuuaugcugac

SEQ ID NO: 2698 - RNA, 20 nt, Artificial Sequence
  MKO10002698_A_Acox2
  gRNA
gacccgagaugagcuauaug

SEQ ID NO: 2699 - RNA, 20 nt, Artificial Sequence
  MKO10002699_A_Acox2
  gRNA
aaccuaugaugcaaccaccc

SEQ ID NO: 2700 - RNA, 20 nt, Artificial Sequence
  MKO10002700_A_Acox3
  gRNA
gggcaagacggcaacucaug

SEQ ID NO: 2701 - RNA, 20 nt, Artificial Sequence
  MKO10002701_A_Acox3
  gRNA
caugaguugccgucuugccc

SEQ ID NO: 2702 - RNA, 20 nt, Artificial Sequence
  MKO10002702_A_Acox3
  gRNA
ccucucuuugcccgcucgua

SEQ ID NO: 2703 - RNA, 20 nt, Artificial Sequence
  MKO10002703_A_Acoxl
  gRNA
gauuccucaccugauugucg

SEQ ID NO: 2704 - RNA, 20 nt, Artificial Sequence
  MKO10002704_A_Acoxl
  gRNA
agcagcguaguucccaugca

SEQ ID NO: 2705 - RNA, 20 nt, Artificial Sequence
  MKO10002705_A_Acoxl
  gRNA
gccaugggagcaacgugaga

SEQ ID NO: 2706 - RNA, 20 nt, Artificial Sequence
  MKO10002706_A_Acp1
  gRNA
caccgaaacauggcagaggu

SEQ ID NO: 2707 - RNA, 20 nt, Artificial Sequence
  MKO10002707_A_Acp1
  gRNA
acacacgaacagcacugacu

SEQ ID NO: 2708 - RNA, 20 nt, Artificial Sequence
  MKO10002708_A_Acp1
  gRNA
ccugaauacugcuucugcaa

SEQ ID NO: 2709 - RNA, 20 nt, Artificial Sequence
  MKO10002709_A_Acp2
  gRNA
gcccugcggcaacgcuacca

SEQ ID NO: 2710 - RNA, 20 nt, Artificial Sequence
  MKO10002710_A_Acp2
  gRNA
uuugcucagcuguaucgaca

SEQ ID NO: 2711 - RNA, 20 nt, Artificial Sequence
  MKO10002711_A_Acp2
  gRNA
gggauuuggucagcuaacca

SEQ ID NO: 2712 - RNA, 20 nt, Artificial Sequence
  MKO10002712_A_Acp5
  gRNA
gugaaaccgcaaguagccgu

SEQ ID NO: 2713 - RNA, 20 nt, Artificial Sequence
  MKO10002713_A_Acp5
  gRNA
cgccagaaccgugcagacga

SEQ ID NO: 2714 - RNA, 20 nt, Artificial Sequence
  MKO10002714_A_Acp5
  gRNA
ggcuacuugcgguuucacua

SEQ ID NO: 2715 - RNA, 20 nt, Artificial Sequence
  MKO10002715_A_Acp6
  gRNA
guguaaucaaaccgaguuug

SEQ ID NO: 2716 - RNA, 20 nt, Artificial Sequence
  MKO10002716_A_Acp6
  gRNA
uuucgggcccccagcuagau

SEQ ID NO: 2717 - RNA, 20 nt, Artificial Sequence
  MKO10002717_A_Acp6
  gRNA
accagucuacaacccccaag

SEQ ID NO: 2718 - RNA, 20 nt, Artificial Sequence
  MKO10002718_A_Acpl2
  gRNA
ugccccgcaucauuauaagc

SEQ ID NO: 2719 - RNA, 20 nt, Artificial Sequence
  MKO10002719_A_Acpl2
  gRNA
acuagagugcagucgauuuc

SEQ ID NO: 2720 - RNA, 20 nt, Artificial Sequence
  MKO10002720_A_Acpl2
  gRNA
cugcaacauuccaagcguag

SEQ ID NO: 2721 - RNA, 20 nt, Artificial Sequence
  MKO10002721_A_Acpp
  gRNA
gucgguaggaaaggucucga

SEQ ID NO: 2722 - RNA, 20 nt, Artificial Sequence
  MKO10002722_A_Acpp
  gRNA
accccauuacagaauccucg

SEQ ID NO: 2723 - RNA, 20 nt, Artificial Sequence
  MKO10002723_A_Acpp
  gRNA
cgacaccuauaagcaugauc

SEQ ID NO: 2724 - RNA, 20 nt, Artificial Sequence
  MKO10002724_A_Acpt
  gRNA
cccugaguacaagcgagaag

SEQ ID NO: 2725 - RNA, 20 nt, Artificial Sequence
  MKO10002725_A_Acpt
  gRNA
uguaacgccuccucagaaau

SEQ ID NO: 2726 - RNA, 20 nt, Artificial Sequence
  MKO10002726_A_Acpt
  gRNA
cguaacagcucaugguaucg

SEQ ID NO: 2727 - RNA, 20 nt, Artificial Sequence
  MKO10002727_A_Acrbp
  gRNA
uugauccaacugaacgagag

SEQ ID NO: 2728 - RNA, 20 nt, Artificial Sequence
  MKO10002728_A_Acrbp
  gRNA
gaaccccacucucguucagu

SEQ ID NO: 2729 - RNA, 20 nt, Artificial Sequence
  MKO10002729_A_Acrbp
  gRNA
agcaacgauacugagcaaac

SEQ ID NO: 2730 - RNA, 20 nt, Artificial Sequence
  MKO10002730_A_Acrv1
  gRNA
gaaguuucgggugacgaagc

SEQ ID NO: 2731 - RNA, 20 nt, Artificial Sequence
  MKO10002731_A_Acrv1
  gRNA
cgcaaacccuucagaugccg

SEQ ID NO: 2732 - RNA, 20 nt, Artificial Sequence
  MKO10002732_A_Acrv1
  gRNA
aucuagaccuuguugcagag

SEQ ID NO: 2733 - RNA, 20 nt, Artificial Sequence
  MKO10002733_A_Acr
  gRNA
uuugggucgaagacggccga

SEQ ID NO: 2734 - RNA, 20 nt, Artificial Sequence
  MKO10002734_A_Acr
  gRNA
gccgacuacccgccauccga

SEQ ID NO: 2735 - RNA, 20 nt, Artificial Sequence
  MKO10002735_A_Acr
  gRNA
ucacgucccauaacagccgc

SEQ ID NO: 2736 - RNA, 20 nt, Artificial Sequence
  MKO10002736_A_Acsbg1
  gRNA
ugcgugcaaucagguaguac

SEQ ID NO: 2737 - RNA, 20 nt, Artificial Sequence
  MKO10002737_A_Acsbg1
  gRNA
cuagggccucguagaacauc

SEQ ID NO: 2738 - RNA, 20 nt, Artificial Sequence
  MKO10002738_A_Acsbg1
  gRNA
cugccgagccaaugucaucg

SEQ ID NO: 2739 - RNA, 20 nt, Artificial Sequence
  MKO10002739_A_Acsbg2
  gRNA
caacgugaguaucuugauag

SEQ ID NO: 2740 - RNA, 20 nt, Artificial Sequence
  MKO10002740_A_Acsbg2
  gRNA
uuaugccaccaacucggcug

SEQ ID NO: 2741 - RNA, 20 nt, Artificial Sequence
  MKO10002741_A_Acsbg2
  gRNA
ugggcuuuaacucggucgag

SEQ ID NO: 2742 - RNA, 20 nt, Artificial Sequence
  MKO10002742_A_Acsf2
  gRNA
gccuugacgccacggcgcag

SEQ ID NO: 2743 - RNA, 20 nt, Artificial Sequence
  MKO10002743_A_Acsf2
  gRNA
accucugcgccguggcguca

SEQ ID NO: 2744 - RNA, 20 nt, Artificial Sequence
  MKO10002744_A_Acsf2
  gRNA
cucccacagguaggcugcaa

SEQ ID NO: 2745 - RNA, 20 nt, Artificial Sequence
  MKO10002745_A_Acsf3
  gRNA
gcagcuuguugaccacgccg

SEQ ID NO: 2746 - RNA, 20 nt, Artificial Sequence
  MKO10002746_A_Acsf3
  gRNA
cgccacgggccacacgcugc

SEQ ID NO: 2747 - RNA, 20 nt, Artificial Sequence
  MKO10002747_A_Acsf3
  gRNA
cccacagauuaccguauuca

SEQ ID NO: 2748 - RNA, 20 nt, Artificial Sequence
  MKO10002748_A_Acsl1
  gRNA
cagugggugaucgucgagca

SEQ ID NO: 2749 - RNA, 20 nt, Artificial Sequence
  MKO10002749_A_Acsl1
  gRNA
ccgaugaacugcucggagca

SEQ ID NO: 2750 - RNA, 20 nt, Artificial Sequence
  MKO10002750_A_Acsl1
  gRNA
gucccgcucuaugacacccu

SEQ ID NO: 2751 - RNA, 20 nt, Artificial Sequence
  MKO10002751_A_Acsl3
  gRNA
guaaugauaugccgcagacg

SEQ ID NO: 2752 - RNA, 20 nt, Artificial Sequence
  MKO10002752_A_Acsl3
  gRNA
ugaguggaugaucgcugcac

SEQ ID NO: 2753 - RNA, 20 nt, Artificial Sequence
  MKO10002753_A_Acsl3
  gRNA
cggcauaucauuacuguuga

SEQ ID NO: 2754 - RNA, 20 nt, Artificial Sequence
  MKO10002754_A_Acsl4
  gRNA
ucacagcaugcaaucaguag

SEQ ID NO: 2755 - RNA, 20 nt, Artificial Sequence
  MKO10002755_A_Acsl4
  gRNA
caauagagcagaguacccug

SEQ ID NO: 2756 - RNA, 20 nt, Artificial Sequence
  MKO10002756_A_Acsl4
  gRNA
cucaacacuaguaaucagau

SEQ ID NO: 2757 - RNA, 20 nt, Artificial Sequence
  MKO10002757_A_Acsl5
  gRNA
ugucccccuguaugacacgc

SEQ ID NO: 2758 - RNA, 20 nt, Artificial Sequence
  MKO10002758_A_Acsl5
  gRNA
gucugaucgagcagaguacc

SEQ ID NO: 2759 - RNA, 20 nt, Artificial Sequence
  MKO10002759_A_Acsl5
  gRNA
uggcgucugagaaguaauaa

SEQ ID NO: 2760 - RNA, 20 nt, Artificial Sequence
  MKO10002760_A_Acsl6
  gRNA
ugcccacuuuacagucgugc

SEQ ID NO: 2761 - RNA, 20 nt, Artificial Sequence
  MKO10002761_A_Acsl6
  gRNA
auguaccagguguuccgccg

SEQ ID NO: 2762 - RNA, 20 nt, Artificial Sequence
  MKO10002762_A_Acsl6
  gRNA
ccgauagcucgggcagccgc

SEQ ID NO: 2763 - RNA, 20 nt, Artificial Sequence
  MKO10002763_A_Acsm1
  gRNA
uggggugccugaucgagcca

SEQ ID NO: 2764 - RNA, 20 nt, Artificial Sequence
  MKO10002764_A_Acsm1
  gRNA
acgguagccagaauccaucc

SEQ ID NO: 2765 - RNA, 20 nt, Artificial Sequence
  MKO10002765_A_Acsm1
  gRNA
acagugggcugcaugcgaac

SEQ ID NO: 2766 - RNA, 20 nt, Artificial Sequence
  MKO10002766_A_Acsm2
  gRNA
aucacuagcgaaguugaacu

SEQ ID NO: 2767 - RNA, 20 nt, Artificial Sequence
  MKO10002767_A_Acsm2
  gRNA
ccacacgguccccacgaugu

SEQ ID NO: 2768 - RNA, 20 nt, Artificial Sequence
  MKO10002768_A_Acsm2
  gRNA
aaccuguccgcaugcagccc

SEQ ID NO: 2769 - RNA, 20 nt, Artificial Sequence
  MKO10002769_A_Acsm3
  gRNA
auacuuaccuguucgcagac

SEQ ID NO: 2770 - RNA, 20 nt, Artificial Sequence
  MKO10002770_A_Acsm3
  gRNA
aauguggccugucugcgaac

SEQ ID NO: 2771 - RNA, 20 nt, Artificial Sequence
  MKO10002771_A_Acsm3
  gRNA
ugauagccuccgaugugaug

SEQ ID NO: 2772 - RNA, 20 nt, Artificial Sequence
  MKO10002772_A_Acsm4
  gRNA
ggcauuggguauacccuuug

SEQ ID NO: 2773 - RNA, 20 nt, Artificial Sequence
  MKO10002773_A_Acsm4
  gRNA
acuggguuccuugucccgaa

SEQ ID NO: 2774 - RNA, 20 nt, Artificial Sequence
  MKO10002774_A_Acsm4
  gRNA
ggaagauaucagugucgaac

SEQ ID NO: 2775 - RNA, 20 nt, Artificial Sequence
  MKO10002775_A_Acsm5
  gRNA
agcguggcuuguaugcgaac

SEQ ID NO: 2776 - RNA, 20 nt, Artificial Sequence
  MKO10002776_A_Acsm5
  gRNA
agucucccagcugacagcga

SEQ ID NO: 2777 - RNA, 20 nt, Artificial Sequence
  MKO10002777_A_Acsm5
  gRNA
ugaugcccuagcuccgcaag

SEQ ID NO: 2778 - RNA, 20 nt, Artificial Sequence
  MKO10002778_A_Acss1
  gRNA
ucuggagaccacaugccgcc

SEQ ID NO: 2779 - RNA, 20 nt, Artificial Sequence
  MKO10002779_A_Acss1
  gRNA
guaugccgccaugacgcaca

SEQ ID NO: 2780 - RNA, 20 nt, Artificial Sequence
  MKO10002780_A_Acss1
  gRNA
ucuggauaucccccuugaac

SEQ ID NO: 2781 - RNA, 20 nt, Artificial Sequence
  MKO10002781_A_Acss2
  gRNA
ggucaccuguagugaugagc

SEQ ID NO: 2782 - RNA, 20 nt, Artificial Sequence
  MKO10002782_A_Acss2
  gRNA
gaucacauaccgugaacucc

SEQ ID NO: 2783 - RNA, 20 nt, Artificial Sequence
  MKO10002783_A_Acss2
  gRNA
cagcaauguucuccguaaac

SEQ ID NO: 2784 - RNA, 20 nt, Artificial Sequence
  MKO10002784_A_Acss3
  gRNA
uacgcgcauugaucaugcga

SEQ ID NO: 2785 - RNA, 20 nt, Artificial Sequence
  MKO10002785_A_Acss3
  gRNA
aaugcgcguacuuaauucuu

SEQ ID NO: 2786 - RNA, 20 nt, Artificial Sequence
  MKO10002786_A_Acss3
  gRNA
gaugccguaacaaccaccuu

SEQ ID NO: 2787 - RNA, 20 nt, Artificial Sequence
  MKO10002787_A_Acua1
  gRNA
gcgcuuaccggugguacggc

SEQ ID NO: 2788 - RNA, 20 nt, Artificial Sequence
  MKO10002788_A_Acua1
  gRNA
ugaagugcgacaucgacauc

SEQ ID NO: 2789 - RNA, 20 nt, Artificial Sequence
  MKO10002789_A_Acua1
  gRNA
ggcggcucaccgauaaagga

SEQ ID NO: 2790 - RNA, 20 nt, Artificial Sequence
  MKO10002790_A_Acua2
  gRNA
cuaucggauacuucagcguc

SEQ ID NO: 2791 - RNA, 20 nt, Artificial Sequence
  MKO10002791_A_Acua2
  gRNA
ccuaccaguuguacguccag

SEQ ID NO: 2792 - RNA, 20 nt, Artificial Sequence
  MKO10002792_A_Acua2
  gRNA
agccucaccaguagucacga

SEQ ID NO: 2793 - RNA, 20 nt, Artificial Sequence
  MKO10002793_A_Acubl2
  gRNA
ucguggacgaccaaccaugg

SEQ ID NO: 2794 - RNA, 20 nt, Artificial Sequence
  MKO10002794_A_Acubl2
  gRNA
gaugacucagauaauguucg

SEQ ID NO: 2795 - RNA, 20 nt, Artificial Sequence
  MKO10002795_A_Acubl2
  gRNA
ugccagaucuagucguagaa

SEQ ID NO: 2796 - RNA, 20 nt, Artificial Sequence
  MKO10002796_A_Acub
  gRNA
ccuuccacagggugugaugg

SEQ ID NO: 2797 - RNA, 20 nt, Artificial Sequence
  MKO10002797_A_Acub
  gRNA
caaccgugaaaagaugaccc

SEQ ID NO: 2798 - RNA, 20 nt, Artificial Sequence
  MKO10002798_A_Acub
  gRNA
uacaacuuacccaagaagga

SEQ ID NO: 2799 - RNA, 20 nt, Artificial Sequence
  MKO10002799_A_Acuc1
  gRNA
aaaacuguguuacgucgccc

SEQ ID NO: 2800 - RNA, 20 nt, Artificial Sequence
  MKO10002800_A_Acuc1
  gRNA
uauugccgaucguaugcaaa

SEQ ID NO: 2801 - RNA, 20 nt, Artificial Sequence
  MKO10002801_A_Acuc1
  gRNA
ugccauguaugucgccaucc

SEQ ID NO: 2802 - RNA, 20 nt, Artificial Sequence
  MKO10002802_A_Acug1
  gRNA
ucucucgcagggcgucaugg

SEQ ID NO: 2803 - RNA, 20 nt, Artificial Sequence
  MKO10002803_A_Acug1
  gRNA
uaacagagagaagaugacgc

SEQ ID NO: 2804 - RNA, 20 nt, Artificial Sequence
  MKO10002804_A_Acug1
  gRNA
accuagcacgaugaagauua

SEQ ID NO: 2805 - RNA, 20 nt, Artificial Sequence
  MKO10002805_A_Acug2
  gRNA
cuacugaccugugguacggc

SEQ ID NO: 2806 - RNA, 20 nt, Artificial Sequence
  MKO10002806_A_Acug2
  gRNA
gugcucucacucuaugcauc

SEQ ID NO: 2807 - RNA, 20 nt, Artificial Sequence
  MKO10002807_A_Acug2
  gRNA
ucuguccacaggcaucguuc

SEQ ID NO: 2808 - RNA, 20 nt, Artificial Sequence
  MKO10002808_A_Acul10
  gRNA
aaucucgaaaguagcgcgac

SEQ ID NO: 2809 - RNA, 20 nt, Artificial Sequence
  MKO10002809_A_Acul10
  gRNA
cuacuuucgagauuugcuag

SEQ ID NO: 2810 - RNA, 20 nt, Artificial Sequence
  MKO10002810_A_Acul10
  gRNA
ccaugagugacccgcguaga

SEQ ID NO: 2811 - RNA, 20 nt, Artificial Sequence
  MKO10002811_A_Acul11
  gRNA
cgagcgcuucuguugccccg

SEQ ID NO: 2812 - RNA, 20 nt, Artificial Sequence
  MKO10002812_A_Acul11
  gRNA
uccaauugacaccuaccggc

SEQ ID NO: 2813 - RNA, 20 nt, Artificial Sequence
  MKO10002813_A_Acul11
  gRNA
ccugcuaagcaucaaucggu

SEQ ID NO: 2814 - RNA, 20 nt, Artificial Sequence
  MKO10002814_A_Acul6a
  gRNA
ccaaugcccuccgcgugccc

SEQ ID NO: 2815 - RNA, 20 nt, Artificial Sequence
  MKO10002815_A_Acul6a
  gRNA
cccuucucuaguggaacacc

SEQ ID NO: 2816 - RNA, 20 nt, Artificial Sequence
  MKO10002816_A_Acul6a
  gRNA
cuuguauguaugauccaaaa

SEQ ID NO: 2817 - RNA, 20 nt, Artificial Sequence
  MKO10002817_A_Acul6b
  gRNA
gucaugucgccccucaagaa

SEQ ID NO: 2818 - RNA, 20 nt, Artificial Sequence
  MKO10002818_A_Acul6b
  gRNA
ccaaugcccugcacgugccu

SEQ ID NO: 2819 - RNA, 20 nt, Artificial Sequence
  MKO10002819_A_Acul6b
  gRNA
uguaggauacgcugugagca

SEQ ID NO: 2820 - RNA, 20 nt, Artificial Sequence
  MKO10002820_A_Acul7a
  gRNA
uuugcgauuaucccccgucu

SEQ ID NO: 2821 - RNA, 20 nt, Artificial Sequence
  MKO10002821_A_Acul7a
  gRNA
gcccauguuccucguacucc

SEQ ID NO: 2822 - RNA, 20 nt, Artificial Sequence
  MKO10002822_A_Acul7a
  gRNA
gugccccaacgacacccccc

SEQ ID NO: 2823 - RNA, 20 nt, Artificial Sequence
  MKO10002823_A_Acul7b
  gRNA
cggacacggcgugucgcaug

SEQ ID NO: 2824 - RNA, 20 nt, Artificial Sequence
  MKO10002824_A_Acul7b
  gRNA
guuuccccgagcguuuccag

SEQ ID NO: 2825 - RNA, 20 nt, Artificial Sequence
  MKO10002825_A_Acul7b
  gRNA
agcguacuucucccgguugc

SEQ ID NO: 2826 - RNA, 20 nt, Artificial Sequence
  MKO10002826_A_Acul9
  gRNA
aggccgaugggcgacaaucc

SEQ ID NO: 2827 - RNA, 20 nt, Artificial Sequence
  MKO10002827_A_Acul9
  gRNA
cggaaugugauacuaugcgg

SEQ ID NO: 2828 - RNA, 20 nt, Artificial Sequence
  MKO10002828_A_Acul9
  gRNA
gcgugucaauggacuuguug

SEQ ID NO: 2829 - RNA, 20 nt, Artificial Sequence
  MKO10002829_A_Acun1
  gRNA
cucuucaucaggugaacgcu

SEQ ID NO: 2830 - RNA, 20 nt, Artificial Sequence
  MKO10002830_A_Acun1
  gRNA
caacucccaccugcgcaaag

SEQ ID NO: 2831 - RNA, 20 nt, Artificial Sequence
  MKO10002831_A_Acun1
  gRNA
auccaaggccuuguugacgu

SEQ ID NO: 2832 - RNA, 20 nt, Artificial Sequence
  MKO10002832_A_Acun2
  gRNA
ucgcccacagaaauagucga

SEQ ID NO: 2833 - RNA, 20 nt, Artificial Sequence
  MKO10002833_A_Acun2
  gRNA
ccuccucgauguucucgauc

SEQ ID NO: 2834 - RNA, 20 nt, Artificial Sequence
  MKO10002834_A_Acun2
  gRNA
cacccagaucgagaacaucg

SEQ ID NO: 2835 - RNA, 20 nt, Artificial Sequence
  MKO10002835_A_Acun3
  gRNA
aacucacaucugcgcaaggc

SEQ ID NO: 2836 - RNA, 20 nt, Artificial Sequence
  MKO10002836_A_Acun3
  gRNA
gucuagggcuuuauugacau

SEQ ID NO: 2837 - RNA, 20 nt, Artificial Sequence
  MKO10002837_A_Acun3
  gRNA
aguucuguacguugacauug

SEQ ID NO: 2838 - RNA, 20 nt, Artificial Sequence
  MKO10002838_A_Acun4
  gRNA
acucgcaucuucccccgcuc

SEQ ID NO: 2839 - RNA, 20 nt, Artificial Sequence
  MKO10002839_A_Acun4
  gRNA
ucagaucgagaauaucgaug

SEQ ID NO: 2840 - RNA, 20 nt, Artificial Sequence
  MKO10002840_A_Acun4
  gRNA
agcguuugccuaagccagag

SEQ ID NO: 2841 - RNA, 20 nt, Artificial Sequence
  MKO10002841_A_Acur10
  gRNA
ucccagagaccgccgcguug

SEQ ID NO: 2842 - RNA, 20 nt, Artificial Sequence
  MKO10002842_A_Acur10
  gRNA
ccgacucgauaaccacaacg

SEQ ID NO: 2843 - RNA, 20 nt, Artificial Sequence
  MKO10002843_A_Acur10
  gRNA
cuuugcagguguggauucgc

SEQ ID NO: 2844 - RNA, 20 nt, Artificial Sequence
  MKO10002844_A_Acur1a
  gRNA
cggggaauuaccuccgcuuu

SEQ ID NO: 2845 - RNA, 20 nt, Artificial Sequence
  MKO10002845_A_Acur1a
  gRNA
ucuacuugcaggagcaccgg

SEQ ID NO: 2846 - RNA, 20 nt, Artificial Sequence
  MKO10002846_A_Acur1a
  gRNA
gcugucaauccguuacccca

SEQ ID NO: 2847 - RNA, 20 nt, Artificial Sequence
  MKO10002847_A_Acur1b
  gRNA
ccguaccacaccguguucca

SEQ ID NO: 2848 - RNA, 20 nt, Artificial Sequence
  MKO10002848_A_Acur1b
  gRNA
ucggacggccaaagcacaug

SEQ ID NO: 2849 - RNA, 20 nt, Artificial Sequence
  MKO10002849_A_Acur1b
  gRNA
gccauaacccgcaugugcuu

SEQ ID NO: 2850 - RNA, 20 nt, Artificial Sequence
  MKO10002850_A_Acur2
  gRNA
aucuuguaggaccuuauggu

SEQ ID NO: 2851 - RNA, 20 nt, Artificial Sequence
  MKO10002851_A_Acur2
  gRNA
ccgcacgaugccauucucca

SEQ ID NO: 2852 - RNA, 20 nt, Artificial Sequence
  MKO10002852_A_Acur2
  gRNA
ucuugugcagguuuacugac

SEQ ID NO: 2853 - RNA, 20 nt, Artificial Sequence
  MKO10002853_A_Acur3b
  gRNA
ucaacgaugccaugucguau

SEQ ID NO: 2854 - RNA, 20 nt, Artificial Sequence
  MKO10002854_A_Acur3b
  gRNA
cgccauccgagaaucugcaa

SEQ ID NO: 2855 - RNA, 20 nt, Artificial Sequence
  MKO10002855_A_Acur3b
  gRNA
cuccaguggccuauacgaca

SEQ ID NO: 2856 - RNA, 20 nt, Artificial Sequence
  MKO10002856_A_Acur3
  gRNA
uaauaguggccaauucgcca

SEQ ID NO: 2857 - RNA, 20 nt, Artificial Sequence
  MKO10002857_A_Acur3
  gRNA
acauaccuuuguugcauaug

SEQ ID NO: 2858 - RNA, 20 nt, Artificial Sequence
  MKO10002858_A_Acur3
  gRNA
uuugaauccuucaauguucc

SEQ ID NO: 2859 - RNA, 20 nt, Artificial Sequence
  MKO10002859_A_Acur5
  gRNA
ugcaagagcucaacgcccgg

SEQ ID NO: 2860 - RNA, 20 nt, Artificial Sequence
  MKO10002860_A_Acur5
  gRNA
acauuguucucguaguaauc

SEQ ID NO: 2861 - RNA, 20 nt, Artificial Sequence
  MKO10002861_A_Acur5
  gRNA
gucaccugccccguaguccu

SEQ ID NO: 2862 - RNA, 20 nt, Artificial Sequence
  MKO10002862_A_Acur6
  gRNA
gauaaucccaaacuugucgc

SEQ ID NO: 2863 - RNA, 20 nt, Artificial Sequence
  MKO10002863_A_Acur6
  gRNA
ugcugcaucauugucgacag

SEQ ID NO: 2864 - RNA, 20 nt, Artificial Sequence
  MKO10002864_A_Acur6
  gRNA
uuuagggauacuuggugaau

SEQ ID NO: 2865 - RNA, 20 nt, Artificial Sequence
  MKO10002865_A_Acur8
  gRNA
aggucgcaucugcuuguugu

SEQ ID NO: 2866 - RNA, 20 nt, Artificial Sequence
  MKO10002866_A_Acur8
  gRNA
ggccuuguauguuaaccccc

SEQ ID NO: 2867 - RNA, 20 nt, Artificial Sequence
  MKO10002867_A_Acur8
  gRNA
ugucuucgugcaaugacgug

SEQ ID NO: 2868 - RNA, 20 nt, Artificial Sequence
  MKO10002868_A_Acurt1
  gRNA
guuaccaguccacgcucaau

SEQ ID NO: 2869 - RNA, 20 nt, Artificial Sequence
  MKO10002869_A_Acurt1
  gRNA
uaucuuugcaaccacgcagu

SEQ ID NO: 2870 - RNA, 20 nt, Artificial Sequence
  MKO10002870_A_Acurt1
  gRNA
cuacacuauccuauugagcg

SEQ ID NO: 2871 - RNA, 20 nt, Artificial Sequence
  MKO10002871_A_Acurt2
  gRNA
ucacagcgccgcccgaccgc

SEQ ID NO: 2872 - RNA, 20 nt, Artificial Sequence
  MKO10002872_A_Acurt2
  gRNA
ggaggguuccgucacgagca

SEQ ID NO: 2873 - RNA, 20 nt, Artificial Sequence
  MKO10002873_A_Acurt2
  gRNA
cgaacgacccgugcucguga

SEQ ID NO: 2874 - RNA, 20 nt, Artificial Sequence
  MKO10002874_A_Acurt3
  gRNA
gagccguugucgaucaccac

SEQ ID NO: 2875 - RNA, 20 nt, Artificial Sequence
  MKO10002875_A_Acurt3
  gRNA
aagacguugauccucccgaa

SEQ ID NO: 2876 - RNA, 20 nt, Artificial Sequence
  MKO10002876_A_Acurt3
  gRNA
uauaaccuguacggcaguau

SEQ ID NO: 2877 - RNA, 20 nt, Artificial Sequence
  MKO10002877_A_Acvr1b
  gRNA
gugucuaccauaaccgccag

SEQ ID NO: 2878 - RNA, 20 nt, Artificial Sequence
  MKO10002878_A_Acvr1b
  gRNA
gucuacgaccucuccacguc

SEQ ID NO: 2879 - RNA, 20 nt, Artificial Sequence
  MKO10002879_A_Acvr1b
  gRNA
agggccgguucggggaagua

SEQ ID NO: 2880 - RNA, 20 nt, Artificial Sequence
  MKO10002880_A_Acvr1c
  gRNA
ugugucagaguaucacgagc

SEQ ID NO: 2881 - RNA, 20 nt, Artificial Sequence
  MKO10002881_A_Acvr1c
  gRNA
ugucagcugcgaugaaaccg

SEQ ID NO: 2882 - RNA, 20 nt, Artificial Sequence
  MKO10002882_A_Acvr1c
  gRNA
ucugauaaauuuccgccuca

SEQ ID NO: 2883 - RNA, 20 nt, Artificial Sequence
  MKO10002883_A_Acvr1
  gRNA
uguaagaccccgccgucacc

SEQ ID NO: 2884 - RNA, 20 nt, Artificial Sequence
  MKO10002884_A_Acvr1
  gRNA
acagugguccucguucccgc

SEQ ID NO: 2885 - RNA, 20 nt, Artificial Sequence
  MKO10002885_A_Acvr1
  gRNA
aauuaccgacacacuccaac

SEQ ID NO: 2886 - RNA, 20 nt, Artificial Sequence
  MKO10002886_A_Acvr2a
  gRNA
ccacauauucauugagcaac

SEQ ID NO: 2887 - RNA, 20 nt, Artificial Sequence
  MKO10002887_A_Acvr2a
  gRNA
acuugaguaggaacaaguac

SEQ ID NO: 2888 - RNA, 20 nt, Artificial Sequence
  MKO10002888_A_Acvr2a
  gRNA
cgguguaacaggauuugaag

SEQ ID NO: 2889 - RNA, 20 nt, Artificial Sequence
  MKO10002889_A_Acvr2b
  gRNA
gcccgagcuguugcgccacg

SEQ ID NO: 2890 - RNA, 20 nt, Artificial Sequence
  MKO10002890_A_Acvr2b
  gRNA
cgagcgcuucacccacuugc

SEQ ID NO: 2891 - RNA, 20 nt, Artificial Sequence
  MKO10002891_A_Acvr2b
  gRNA
gcaucuacuacaacgccaac

SEQ ID NO: 2892 - RNA, 20 nt, Artificial Sequence
  MKO10002892_A_Acvrl1
  gRNA
ccguaguacagucgcugucc

SEQ ID NO: 2893 - RNA, 20 nt, Artificial Sequence
  MKO10002893_A_Acvrl1
  gRNA
ucccgcagccccgauagacc

SEQ ID NO: 2894 - RNA, 20 nt, Artificial Sequence
  MKO10002894_A_Acvrl1
  gRNA
ccaggacugcucaucucgug

SEQ ID NO: 2895 - RNA, 20 nt, Artificial Sequence
  MKO10002895_A_Acy1
  gRNA
gggagugacggguuggugcc

SEQ ID NO: 2896 - RNA, 20 nt, Artificial Sequence
  MKO10002896_A_Acy1
  gRNA
gcgagggccaccgauucccu

SEQ ID NO: 2897 - RNA, 20 nt, Artificial Sequence
  MKO10002897_A_Acy1
  gRNA
aggaggggccaucaccuucc

SEQ ID NO: 2898 - RNA, 20 nt, Artificial Sequence
  MKO10002898_A_Acy3
  gRNA
ucggcccgcagcacgcccug

SEQ ID NO: 2899 - RNA, 20 nt, Artificial Sequence
  MKO10002899_A_Acy3
  gRNA
guucucccggaugcgagcuc

SEQ ID NO: 2900 - RNA, 20 nt, Artificial Sequence
  MKO10002900_A_Acy3
  gRNA
uagggaccaccuguagguag

SEQ ID NO: 2901 - RNA, 20 nt, Artificial Sequence
  MKO10002901_A_Acyp1
  gRNA
gcuggguucagaacaccgac

SEQ ID NO: 2902 - RNA, 20 nt, Artificial Sequence
  MKO10002902_A_Acyp1
  gRNA
cugcugcaugaagcgcaccu

SEQ ID NO: 2903 - RNA, 20 nt, Artificial Sequence
  MKO10002903_A_Acyp1
  gRNA
uucguaauccacugagacca

SEQ ID NO: 2904 - RNA, 20 nt, Artificial Sequence
  MKO10002904_A_Acyp2
  gRNA
guccuaguucucgcaucgac

SEQ ID NO: 2905 - RNA, 20 nt, Artificial Sequence
  MKO10002905_A_Acyp2
  gRNA
gaaguguucgggacagugca

SEQ ID NO: 2906 - RNA, 20 nt, Artificial Sequence
  MKO10002906_A_Acyp2
  gRNA
auacccagcuaaugcugcuc

SEQ ID NO: 2907 - RNA, 20 nt, Artificial Sequence
  MKO10002907_A_Adad1
  gRNA
accugucacuugcguaaccu

SEQ ID NO: 2908 - RNA, 20 nt, Artificial Sequence
  MKO10002908_A_Adad1
  gRNA
ucuugacgagcuucuacaac

SEQ ID NO: 2909 - RNA, 20 nt, Artificial Sequence
  MKO10002909_A_Adad1
  gRNA
aaguuguagucugucgaaua

SEQ ID NO: 2910 - RNA, 20 nt, Artificial Sequence
  MKO10002910_A_Adad2
  gRNA
auggucuggucaucgcccgc

SEQ ID NO: 2911 - RNA, 20 nt, Artificial Sequence
  MKO10002911_A_Adad2
  gRNA
gagugagagcucaccguacc

SEQ ID NO: 2912 - RNA, 20 nt, Artificial Sequence
  MKO10002912_A_Adad2
  gRNA
ugcagccaccguccccuuac

SEQ ID NO: 2913 - RNA, 20 nt, Artificial Sequence
  MKO10002913_A_Adal
  gRNA
ucagcuuacuacuagugcug

SEQ ID NO: 2914 - RNA, 20 nt, Artificial Sequence
  MKO10002914_A_Adal
  gRNA
aagccacaucuuaacguuca

SEQ ID NO: 2915 - RNA, 20 nt, Artificial Sequence
  MKO10002915_A_Adal
  gRNA
ggucacaaaagacgucauua

SEQ ID NO: 2916 - RNA, 20 nt, Artificial Sequence
  MKO10002916_A_Adam10
  gRNA
aguucaaccuacgaaugaag

SEQ ID NO: 2917 - RNA, 20 nt, Artificial Sequence
  MKO10002917_A_Adam10
  gRNA
caaacgagcagucucacaug

SEQ ID NO: 2918 - RNA, 20 nt, Artificial Sequence
  MKO10002918_A_Adam10
  gRNA
cucaugugagacugcucguu

SEQ ID NO: 2919 - RNA, 20 nt, Artificial Sequence
  MKO10002919_A_Adam11
  gRNA
ccgggaugacgaaacucacc

SEQ ID NO: 2920 - RNA, 20 nt, Artificial Sequence
  MKO10002920_A_Adam11
  gRNA
ggguccgccaggauccgccc

SEQ ID NO: 2921 - RNA, 20 nt, Artificial Sequence
  MKO10002921_A_Adam11
  gRNA
uuaccgcuucuccccccgcc

SEQ ID NO: 2922 - RNA, 20 nt, Artificial Sequence
  MKO10002922_A_Adam12
  gRNA
ccagagaggaacuuacgaag

SEQ ID NO: 2923 - RNA, 20 nt, Artificial Sequence
  MKO10002923_A_Adam12
  gRNA
ccacuucguaaguuccucuc

SEQ ID NO: 2924 - RNA, 20 nt, Artificial Sequence
  MKO10002924_A_Adam12
  gRNA
caggaucauuguuacuacca

SEQ ID NO: 2925 - RNA, 20 nt, Artificial Sequence
  MKO10002925_A_Adam15
  gRNA
uccccgccgcugccaaauau

SEQ ID NO: 2926 - RNA, 20 nt, Artificial Sequence
  MKO10002926_A_Adam15
  gRNA
gagccuagcagacgugcuuc

SEQ ID NO: 2927 - RNA, 20 nt, Artificial Sequence
  MKO10002927_A_Adam15
  gRNA
ucaccugaagcacgucugcu

SEQ ID NO: 2928 - RNA, 20 nt, Artificial Sequence
  MKO10002928_A_Adam17
  gRNA
aaagcgaguacagcgugaag

SEQ ID NO: 2929 - RNA, 20 nt, Artificial Sequence
  MKO10002929_A_Adam17
  gRNA
gaacuucuucaguggucacg

SEQ ID NO: 2930 - RNA, 20 nt, Artificial Sequence
  MKO10002930_A_Adam17
  gRNA
gugcugcugaauauuagcua

SEQ ID NO: 2931 - RNA, 20 nt, Artificial Sequence
  MKO10002931_A_Adam18
  gRNA
ucugcggcacugugauaugc

SEQ ID NO: 2932 - RNA, 20 nt, Artificial Sequence
  MKO10002932_A_Adam18
  gRNA
acauacgucauuaccauuga

SEQ ID NO: 2933 - RNA, 20 nt, Artificial Sequence
  MKO10002933_A_Adam18
  gRNA
ucugcaucuccgcccuugcg

SEQ ID NO: 2934 - RNA, 20 nt, Artificial Sequence
  MKO10002934_A_Adam19
  gRNA
ccacgucccucacagucccg

SEQ ID NO: 2935 - RNA, 20 nt, Artificial Sequence
  MKO10002935_A_Adam19
  gRNA
auugccacuugcaguguagc

SEQ ID NO: 2936 - RNA, 20 nt, Artificial Sequence
  MKO10002936_A_Adam19
  gRNA
gggccucuuaccuaauuccc

SEQ ID NO: 2937 - RNA, 20 nt, Artificial Sequence
  MKO10002937_A_Adam1a
  gRNA
uucgccaacauguacgcuua

SEQ ID NO: 2938 - RNA, 20 nt, Artificial Sequence
  MKO10002938_A_Adam1a
  gRNA
uaaugcugaucgccuaccuc

SEQ ID NO: 2939 - RNA, 20 nt, Artificial Sequence
  MKO10002939_A_Adam1a
  gRNA
cccuccuuaagcguacaugu

SEQ ID NO: 2940 - RNA, 20 nt, Artificial Sequence
  MKO10002940_A_Adam1b
  gRNA
uaacuuaaagcugaucgucc

SEQ ID NO: 2941 - RNA, 20 nt, Artificial Sequence
  MKO10002941_A_Adam1b
  gRNA
ccagauggagcgacuaaagc

SEQ ID NO: 2942 - RNA, 20 nt, Artificial Sequence
  MKO10002942_A_Adam1b
  gRNA
ugcaccucccgacugcaaag

SEQ ID NO: 2943 - RNA, 20 nt, Artificial Sequence
  MKO10002943_A_Adam20
  gRNA
uacuaccaauuguuugcgca

SEQ ID NO: 2944 - RNA, 20 nt, Artificial Sequence
  MKO10002944_A_Adam20
  gRNA
ugaaggaaaucuugugcccg

SEQ ID NO: 2945 - RNA, 20 nt, Artificial Sequence
  MKO10002945_A_Adam20
  gRNA
uaaugagucagaagcgcaac

SEQ ID NO: 2946 - RNA, 20 nt, Artificial Sequence
  MKO10002946_A_Adam21
  gRNA
uccguuaaacuacauagcau

SEQ ID NO: 2947 - RNA, 20 nt, Artificial Sequence
  MKO10002947_A_Adam21
  gRNA
gucuacggccaccaaauaca

SEQ ID NO: 2948 - RNA, 20 nt, Artificial Sequence
  MKO10002948_A_Adam21
  gRNA
acagcuucuugacucgcaua

SEQ ID NO: 2949 - RNA, 20 nt, Artificial Sequence
  MKO10002949_A_Adam22
  gRNA
uguagcgaguugcugucguc

SEQ ID NO: 2950 - RNA, 20 nt, Artificial Sequence
  MKO10002950_A_Adam22
  gRNA
ccacucaccugcgguccgcc

SEQ ID NO: 2951 - RNA, 20 nt, Artificial Sequence
  MKO10002951_A_Adam22
  gRNA
cccgcacccgcgugucgagc

SEQ ID NO: 2952 - RNA, 20 nt, Artificial Sequence
  MKO10002952_A_Adam23
  gRNA
cucccggcggccgacccuga

SEQ ID NO: 2953 - RNA, 20 nt, Artificial Sequence
  MKO10002953_A_Adam23
  gRNA
cgaugagccaugaagccgcc

SEQ ID NO: 2954 - RNA, 20 nt, Artificial Sequence
  MKO10002954_A_Adam23
  gRNA
uggagccgaaagcuucgauc

SEQ ID NO: 2955 - RNA, 20 nt, Artificial Sequence
  MKO10002955_A_Adam24
  gRNA
uacaaggaacucaauacucg

SEQ ID NO: 2956 - RNA, 20 nt, Artificial Sequence
  MKO10002956_A_Adam24
  gRNA
caauuacgccccaugagaug

SEQ ID NO: 2957 - RNA, 20 nt, Artificial Sequence
  MKO10002957_A_Adam24
  gRNA
uagggguuagcccauucauc

SEQ ID NO: 2958 - RNA, 20 nt, Artificial Sequence
  MKO10002958_A_Adam25
  gRNA
cuaugcuacguaccugcacg

SEQ ID NO: 2959 - RNA, 20 nt, Artificial Sequence
  MKO10002959_A_Adam25
  gRNA
uacugccaaguguaugcgca

SEQ ID NO: 2960 - RNA, 20 nt, Artificial Sequence
  MKO10002960_A_Adam25
  gRNA
acguauuauagcacaugaga

SEQ ID NO: 2961 - RNA, 20 nt, Artificial Sequence
  MKO10002961_A_Adam26a
  gRNA
ccaccagacugucaaaaacg

SEQ ID NO: 2962 - RNA, 20 nt, Artificial Sequence
  MKO10002962_A_Adam26a
  gRNA
acacauuguagcacacgaga

SEQ ID NO: 2963 - RNA, 20 nt, Artificial Sequence
  MKO10002963_A_Adam26a
  gRNA
caaauugcugauguacucug

SEQ ID NO: 2964 - RNA, 20 nt, Artificial Sequence
  MKO10002964_A_Adam26b
  gRNA
guauaaaauaugcgagcucg

SEQ ID NO: 2965 - RNA, 20 nt, Artificial Sequence
  MKO10002965_A_Adam26b
  gRNA
ugcaugucccaaauucuagu

SEQ ID NO: 2966 - RNA, 20 nt, Artificial Sequence
  MKO10002966_A_Adam26b
  gRNA
cuuuaguuggcauaaccaag

SEQ ID NO: 2967 - RNA, 20 nt, Artificial Sequence
  MKO10002967_A_Adam28
  gRNA
gcuccuugcgccugacuacu

SEQ ID NO: 2968 - RNA, 20 nt, Artificial Sequence
  MKO10002968_A_Adam28
  gRNA
caccacaagcccgcaaauca

SEQ ID NO: 2969 - RNA, 20 nt, Artificial Sequence
  MKO10002969_A_Adam28
  gRNA
gggaucgcagaaugcagcaa

SEQ ID NO: 2970 - RNA, 20 nt, Artificial Sequence
  MKO10002970_A_Adam29
  gRNA
acaacugcacaacuacguuu

SEQ ID NO: 2971 - RNA, 20 nt, Artificial Sequence
  MKO10002971_A_Adam29
  gRNA
aguguucaccuacucugauc

SEQ ID NO: 2972 - RNA, 20 nt, Artificial Sequence
  MKO10002972_A_Adam29
  gRNA
acuuugaaccuucgugccau

SEQ ID NO: 2973 - RNA, 20 nt, Artificial Sequence
  MKO10002973_A_Adam2
  gRNA
guauacaguuaugacaacgc

SEQ ID NO: 2974 - RNA, 20 nt, Artificial Sequence
  MKO10002974_A_Adam2
  gRNA
aagcaauggcuacgaaacac

SEQ ID NO: 2975 - RNA, 20 nt, Artificial Sequence
  MKO10002975_A_Adam2
  gRNA
accuacaaucucaaaaucga

SEQ ID NO: 2976 - RNA, 20 nt, Artificial Sequence
  MKO10002976_A_Adam30
  gRNA
auacaccacguguucgaaac

SEQ ID NO: 2977 - RNA, 20 nt, Artificial Sequence
  MKO10002977_A_Adam30
  gRNA
accagaccaguguaauuacg

SEQ ID NO: 2978 - RNA, 20 nt, Artificial Sequence
  MKO10002978_A_Adam30
  gRNA
acacacccgauuacgaccac

SEQ ID NO: 2979 - RNA, 20 nt, Artificial Sequence
  MKO10002979_A_Adam32
  gRNA
uuaaaucuuaccggaauguu

SEQ ID NO: 2980 - RNA, 20 nt, Artificial Sequence
  MKO10002980_A_Adam32
  gRNA
acacugugcaccuccagaaa

SEQ ID NO: 2981 - RNA, 20 nt, Artificial Sequence
  MKO10002981_A_Adam32
  gRNA
ucaguccagagcaugugcug

SEQ ID NO: 2982 - RNA, 20 nt, Artificial Sequence
  MKO10002982_A_Adam33
  gRNA
ggauacuuaccggcuccucc

SEQ ID NO: 2983 - RNA, 20 nt, Artificial Sequence
  MKO10002983_A_Adam33
  gRNA
agcacuaccggaugcccauc

SEQ ID NO: 2984 - RNA, 20 nt, Artificial Sequence
  MKO10002984_A_Adam33
  gRNA
ugcugcccucguguccgcug

SEQ ID NO: 2985 - RNA, 20 nt, Artificial Sequence
  MKO10002985_A_Adam34
  gRNA
gugagcgauggcacaacuug

SEQ ID NO: 2986 - RNA, 20 nt, Artificial Sequence
  MKO10002986_A_Adam34
  gRNA
aaccugaugccaaccaugug

SEQ ID NO: 2987 - RNA, 20 nt, Artificial Sequence
  MKO10002987_A_Adam34
  gRNA
cugugaacacauaaauaguc

SEQ ID NO: 2988 - RNA, 20 nt, Artificial Sequence
  MKO10002988_A_Adam39
  gRNA
uuauguuacgucccugcacg

SEQ ID NO: 2989 - RNA, 20 nt, Artificial Sequence
  MKO10002989_A_Adam39
  gRNA
uucgagauaccauuaucugc

SEQ ID NO: 2990 - RNA, 20 nt, Artificial Sequence
  MKO10002990_A_Adam39
  gRNA
accuuucaugcugcauguag

SEQ ID NO: 2991 - RNA, 20 nt, Artificial Sequence
  MKO10002991_A_Adam3
  gRNA
guugucacaggucacuuacg

SEQ ID NO: 2992 - RNA, 20 nt, Artificial Sequence
  MKO10002992_A_Adam3
  gRNA
aacauauuugcgugacaagu

SEQ ID NO: 2993 - RNA, 20 nt, Artificial Sequence
  MKO10002993_A_Adam3
  gRNA
gaaaaucgacaccaacaucc

SEQ ID NO: 2994 - RNA, 20 nt, Artificial Sequence
  MKO10002994_A_Adam4
  gRNA
aaaggugguaguacaaauag

SEQ ID NO: 2995 - RNA, 20 nt, Artificial Sequence
  MKO10002995_A_Adam4
  gRNA
auguaugaaguuccucguug

SEQ ID NO: 2996 - RNA, 20 nt, Artificial Sequence
  MKO10002996_A_Adam4
  gRNA
uguggcauuagaaucauacg

SEQ ID NO: 2997 - RNA, 20 nt, Artificial Sequence
  MKO10002997_A_Adam5
  gRNA
uucucaaccuuugucagcuc

SEQ ID NO: 2998 - RNA, 20 nt, Artificial Sequence
  MKO10002998_A_Adam5
  gRNA
ugagggucacgauagaguuu

SEQ ID NO: 2999 - RNA, 20 nt, Artificial Sequence
  MKO10002999_A_Adam5
  gRNA
gugacccucaccguuugcac

SEQ ID NO: 3000 - RNA, 20 nt, Artificial Sequence
  MKO10003000_A_Adam6a
  gRNA
ucucaugacuguguauaccg

SEQ ID NO: 3001 - RNA, 20 nt, Artificial Sequence
  MKO10003001_A_Adam6a
  gRNA
uuagagccacuacaguacuc

SEQ ID NO: 3002 - RNA, 20 nt, Artificial Sequence
  MKO10003002_A_Adam6a
  gRNA
auaauuaacaagaauucgcc

SEQ ID NO: 3003 - RNA, 20 nt, Artificial Sequence
  MKO10003003_A_Adam6b
  gRNA
uaauuauaagccgacccucc

SEQ ID NO: 3004 - RNA, 20 nt, Artificial Sequence
  MKO10003004_A_Adam6b
  gRNA
uugcaagcuacuuuacguuc

SEQ ID NO: 3005 - RNA, 20 nt, Artificial Sequence
  MKO10003005_A_Adam6b
  gRNA
uuagucccauuacaguacuc

SEQ ID NO: 3006 - RNA, 20 nt, Artificial Sequence
  MKO10003006_A_Adam7
  gRNA
auaccgguaugucagaguca

SEQ ID NO: 3007 - RNA, 20 nt, Artificial Sequence
  MKO10003007_A_Adam7
  gRNA
gcuaguaucagcacuugcaa

SEQ ID NO: 3008 - RNA, 20 nt, Artificial Sequence
  MKO10003008_A_Adam7
  gRNA
aagaucccguuuguguagca

SEQ ID NO: 3009 - RNA, 20 nt, Artificial Sequence
  MKO10003009_A_Adam8
  gRNA
cagggugaaaacgugcccgc

SEQ ID NO: 3010 - RNA, 20 nt, Artificial Sequence
  MKO10003010_A_Adam8
  gRNA
cggcuuaccuguucuuucga

SEQ ID NO: 3011 - RNA, 20 nt, Artificial Sequence
  MKO10003011_A_Adam8
  gRNA
agcccucguacccuuccaca

SEQ ID NO: 3012 - RNA, 20 nt, Artificial Sequence
  MKO10003012_A_Adam9
  gRNA
ggcagguuccgcucaacgcg

SEQ ID NO: 3013 - RNA, 20 nt, Artificial Sequence
  MKO10003013_A_Adam9
  gRNA
guccucgaggccgggcgacc

SEQ ID NO: 3014 - RNA, 20 nt, Artificial Sequence
  MKO10003014_A_Adam9
  gRNA
cucugaccaucccaacguac

SEQ ID NO: 3015 - RNA, 20 nt, Artificial Sequence
  MKO10003015_A_Adamdec1
  gRNA
uuaggacgaacuauuucgug

SEQ ID NO: 3016 - RNA, 20 nt, Artificial Sequence
  MKO10003016_A_Adamdec1
  gRNA
ccaaaaugcaaggggcucuc

SEQ ID NO: 3017 - RNA, 20 nt, Artificial Sequence
  MKO10003017_A_Adamdec1
  gRNA
ccagagagccccuugcauuu

SEQ ID NO: 3018 - RNA, 20 nt, Artificial Sequence
  MKO10003018_A_Adamts10
  gRNA
gauugccuucccaacucgag

SEQ ID NO: 3019 - RNA, 20 nt, Artificial Sequence
  MKO10003019_A_Adamts10
  gRNA
cgggcccacugccuauacgc

SEQ ID NO: 3020 - RNA, 20 nt, Artificial Sequence
  MKO10003020_A_Adamts10
  gRNA
ucaucuugucggcuaccacc

SEQ ID NO: 3021 - RNA, 20 nt, Artificial Sequence
  MKO10003021_A_Adamts12
  gRNA
ccuacccucaugucguauac

SEQ ID NO: 3022 - RNA, 20 nt, Artificial Sequence
  MKO10003022_A_Adamts12
  gRNA
cucccgacguuccauaagca

SEQ ID NO: 3023 - RNA, 20 nt, Artificial Sequence
  MKO10003023_A_Adamts12
  gRNA
ccaccagcaucgacuuggac

SEQ ID NO: 3024 - RNA, 20 nt, Artificial Sequence
  MKO10003024_A_Adamts13
  gRNA
cgaucaacccccacgaugac

SEQ ID NO: 3025 - RNA, 20 nt, Artificial Sequence
  MKO10003025_A_Adamts13
  gRNA
ccacucgcagacgcucauca

SEQ ID NO: 3026 - RNA, 20 nt, Artificial Sequence
  MKO10003026_A_Adamts13
  gRNA
uuagcuucaccaggugcacc

SEQ ID NO: 3027 - RNA, 20 nt, Artificial Sequence
  MKO10003027_A_Adamts14
  gRNA
cuucccggcgguauaccaca

SEQ ID NO: 3028 - RNA, 20 nt, Artificial Sequence
  MKO10003028_A_Adamts14
  gRNA
gauuuaccaugacgaaucgc

SEQ ID NO: 3029 - RNA, 20 nt, Artificial Sequence
  MKO10003029_A_Adamts14
  gRNA
aagcggcgacacgccaagcc

SEQ ID NO: 3030 - RNA, 20 nt, Artificial Sequence
  MKO10003030_A_Adamts15
  gRNA
gaaauaccgaucuugcaacu

SEQ ID NO: 3031 - RNA, 20 nt, Artificial Sequence
  MKO10003031_A_Adamts15
  gRNA
agauugaccgugccaacccc

SEQ ID NO: 3032 - RNA, 20 nt, Artificial Sequence
  MKO10003032_A_Adamts15
  gRNA
cacaggugguagccccgcau

SEQ ID NO: 3033 - RNA, 20 nt, Artificial Sequence
  MKO10003033_A_Adamts16
  gRNA
ucaagagcgagcgcuugugu

SEQ ID NO: 3034 - RNA, 20 nt, Artificial Sequence
  MKO10003034_A_Adamts16
  gRNA
acgaaguccugaugaucacc

SEQ ID NO: 3035 - RNA, 20 nt, Artificial Sequence
  MKO10003035_A_Adamts16
  gRNA
caagauguagaggucaucgu

SEQ ID NO: 3036 - RNA, 20 nt, Artificial Sequence
  MKO10003036_A_Adamts17
  gRNA
uauaggucgcgcccaaaggc

SEQ ID NO: 3037 - RNA, 20 nt, Artificial Sequence
  MKO10003037_A_Adamts17
  gRNA
gccgacauggugcaguacca

SEQ ID NO: 3038 - RNA, 20 nt, Artificial Sequence
  MKO10003038_A_Adamts17
  gRNA
uuacggggcguugucucaga

SEQ ID NO: 3039 - RNA, 20 nt, Artificial Sequence
  MKO10003039_A_Adamts18
  gRNA
ccgcccgaguccacuucuac

SEQ ID NO: 3040 - RNA, 20 nt, Artificial Sequence
  MKO10003040_A_Adamts18
  gRNA
auauucgucaaagcguagau

SEQ ID NO: 3041 - RNA, 20 nt, Artificial Sequence
  MKO10003041_A_Adamts18
  gRNA
agugaccaggauauguccgc

SEQ ID NO: 3042 - RNA, 20 nt, Artificial Sequence
  MKO10003042_A_Adamts19
  gRNA
cggucucgauguuguauucc

SEQ ID NO: 3043 - RNA, 20 nt, Artificial Sequence
  MKO10003043_A_Adamts19
  gRNA
ccgugguaggaaaccauugc

SEQ ID NO: 3044 - RNA, 20 nt, Artificial Sequence
  MKO10003044_A_Adamts19
  gRNA
ccguggcguucagcgacucc

SEQ ID NO: 3045 - RNA, 20 nt, Artificial Sequence
  MKO10003045_A_Adamts1
  gRNA
uguguccagcccccguuaug

SEQ ID NO: 3046 - RNA, 20 nt, Artificial Sequence
  MKO10003046_A_Adamts1
  gRNA
agccgacuuacccaauucau

SEQ ID NO: 3047 - RNA, 20 nt, Artificial Sequence
  MKO10003047_A_Adamts1
  gRNA
ggacuggucagcuacgagca

SEQ ID NO: 3048 - RNA, 20 nt, Artificial Sequence
  MKO10003048_A_Adamts20
  gRNA
uccgaacucauugacccgcg

SEQ ID NO: 3049 - RNA, 20 nt, Artificial Sequence
  MKO10003049_A_Adamts20
  gRNA
cgaccuuacccugucguggg

SEQ ID NO: 3050 - RNA, 20 nt, Artificial Sequence
  MKO10003050_A_Adamts20
  gRNA
aucgucaugcgcacucccau

SEQ ID NO: 3051 - RNA, 20 nt, Artificial Sequence
  MKO10003051_A_Adamts2
  gRNA
aauguuguagucaucguccg

SEQ ID NO: 3052 - RNA, 20 nt, Artificial Sequence
  MKO10003052_A_Adamts2
  gRNA
uggcccccggagccacgagc

SEQ ID NO: 3053 - RNA, 20 nt, Artificial Sequence
  MKO10003053_A_Adamts2
  gRNA
ggaguucuuuaucgaaccuc

SEQ ID NO: 3054 - RNA, 20 nt, Artificial Sequence
  MKO10003054_A_Adamts3
  gRNA
cugaagcacuuccguguaga

SEQ ID NO: 3055 - RNA, 20 nt, Artificial Sequence
  MKO10003055_A_Adamts3
  gRNA
ccaguuagcacgaaucuaaa

SEQ ID NO: 3056 - RNA, 20 nt, Artificial Sequence
  MKO10003056_A_Adamts3
  gRNA
ccaggcugguacugacgaaa

SEQ ID NO: 3057 - RNA, 20 nt, Artificial Sequence
  MKO10003057_A_Adamts4
  gRNA
cgcgucaccaccaaguugac

SEQ ID NO: 3058 - RNA, 20 nt, Artificial Sequence
  MKO10003058_A_Adamts4
  gRNA
ggugacgcgccuggugaucc

SEQ ID NO: 3059 - RNA, 20 nt, Artificial Sequence
  MKO10003059_A_Adamts4
  gRNA
gagccuccgguuugucuaag

SEQ ID NO: 3060 - RNA, 20 nt, Artificial Sequence
  MKO10003060_A_Adamts5
  gRNA
cucccgggcaggauuuaugu

SEQ ID NO: 3061 - RNA, 20 nt, Artificial Sequence
  MKO10003061_A_Adamts5
  gRNA
cguugggaccauauguucuc

SEQ ID NO: 3062 - RNA, 20 nt, Artificial Sequence
  MKO10003062_A_Adamts5
  gRNA
ggucaguguucucgcucaug

SEQ ID NO: 3063 - RNA, 20 nt, Artificial Sequence
  MKO10003063_A_Adamts6
  gRNA
gccucuaaagaauacuacag

SEQ ID NO: 3064 - RNA, 20 nt, Artificial Sequence
  MKO10003064_A_Adamts6
  gRNA
uuagacaacugucacuacac

SEQ ID NO: 3065 - RNA, 20 nt, Artificial Sequence
  MKO10003065_A_Adamts6
  gRNA
cuuuaucgugacuccagucu

SEQ ID NO: 3066 - RNA, 20 nt, Artificial Sequence
  MKO10003066_A_Adamts7
  gRNA
ucgcgcuugcgcagcacccg

SEQ ID NO: 3067 - RNA, 20 nt, Artificial Sequence
  MKO10003067_A_Adamts7
  gRNA
cauugugcgccuuaucauac

SEQ ID NO: 3068 - RNA, 20 nt, Artificial Sequence
  MKO10003068_A_Adamts7
  gRNA
gcagccauuagcgccugcga

SEQ ID NO: 3069 - RNA, 20 nt, Artificial Sequence
  MKO10003069_A_Adamts8
  gRNA
gcucaucacuaucccgauga

SEQ ID NO: 3070 - RNA, 20 nt, Artificial Sequence
  MKO10003070_A_Adamts8
  gRNA
cccccguuguccgacaccuc

SEQ ID NO: 3071 - RNA, 20 nt, Artificial Sequence
  MKO10003071_A_Adamts8
  gRNA
uuggggcagugucggaaauc

SEQ ID NO: 3072 - RNA, 20 nt, Artificial Sequence
  MKO10003072_A_Adamts9
  gRNA
gugcugacgcacgucaaugc

SEQ ID NO: 3073 - RNA, 20 nt, Artificial Sequence
  MKO10003073_A_Adamts9
  gRNA
ucugcugcccagcguacgcu

SEQ ID NO: 3074 - RNA, 20 nt, Artificial Sequence
  MKO10003074_A_Adamts9
  gRNA
caauacuguuguccgaauuc

SEQ ID NO: 3075 - RNA, 20 nt, Artificial Sequence
  MKO10003075_A_Adamtsl1
  gRNA
cgcguaccaucuaagaccuu

SEQ ID NO: 3076 - RNA, 20 nt, Artificial Sequence
  MKO10003076_A_Adamtsl1
  gRNA
uugucggggucauuagauac

SEQ ID NO: 3077 - RNA, 20 nt, Artificial Sequence
  MKO10003077_A_Adamtsl1
  gRNA
acggagauggcucaacgugc

SEQ ID NO: 3078 - RNA, 20 nt, Artificial Sequence
  MKO10003078_A_Adamtsl2
  gRNA
ccggcaccgugagcugccgu

SEQ ID NO: 3079 - RNA, 20 nt, Artificial Sequence
  MKO10003079_A_Adamtsl2
  gRNA
ccaacggcagcucacggugc

SEQ ID NO: 3080 - RNA, 20 nt, Artificial Sequence
  MKO10003080_A_Adamtsl2
  gRNA
ccguuuggacgugcccacac

SEQ ID NO: 3081 - RNA, 20 nt, Artificial Sequence
  MKO10003081_A_Adamtsl3
  gRNA
gcugacacgaaugaucuuua

SEQ ID NO: 3082 - RNA, 20 nt, Artificial Sequence
  MKO10003082_A_Adamtsl3
  gRNA
gagggagacuccuaugauau

SEQ ID NO: 3083 - RNA, 20 nt, Artificial Sequence
  MKO10003083_A_Adamtsl3
  gRNA
agugacugcucccggaccug

SEQ ID NO: 3084 - RNA, 20 nt, Artificial Sequence
  MKO10003084_A_Adamtsl4
  gRNA
agaaaccgcaccuucgguga

SEQ ID NO: 3085 - RNA, 20 nt, Artificial Sequence
  MKO10003085_A_Adamtsl4
  gRNA
guucgagaccccaucaagcc

SEQ ID NO: 3086 - RNA, 20 nt, Artificial Sequence
  MKO10003086_A_Adamtsl4
  gRNA
agucaaaggcggcacacugu

SEQ ID NO: 3087 - RNA, 20 nt, Artificial Sequence
  MKO10003087_A_Adamtsl5
  gRNA
ucccggguuaccggacacau

SEQ ID NO: 3088 - RNA, 20 nt, Artificial Sequence
  MKO10003088_A_Adamtsl5
  gRNA
gacgccccgaccacaagagc

SEQ ID NO: 3089 - RNA, 20 nt, Artificial Sequence
  MKO10003089_A_Adamtsl5
  gRNA
aggcuacucacccccgugga

SEQ ID NO: 3090 - RNA, 20 nt, Artificial Sequence
  MKO10003090_A_Adap1
  gRNA
aaguaccgcccuucuacuac

SEQ ID NO: 3091 - RNA, 20 nt, Artificial Sequence
  MKO10003091_A_Adap1
  gRNA
cacggauccacugcucacgu

SEQ ID NO: 3092 - RNA, 20 nt, Artificial Sequence
  MKO10003092_A_Adap1
  gRNA
caaggugaagucaguccguc

SEQ ID NO: 3093 - RNA, 20 nt, Artificial Sequence
  MKO10003093_A_Adap2
  gRNA
caaaguuaaauccgugagac

SEQ ID NO: 3094 - RNA, 20 nt, Artificial Sequence
  MKO10003094_A_Adap2
  gRNA
ggugguuaagguaaccgaga

SEQ ID NO: 3095 - RNA, 20 nt, Artificial Sequence
  MKO10003095_A_Adap2
  gRNA
ccuccugaaguacuacacca

SEQ ID NO: 3096 - RNA, 20 nt, Artificial Sequence
  MKO10003096_A_Adarb1
  gRNA
cacggacaugacgaagcucu

SEQ ID NO: 3097 - RNA, 20 nt, Artificial Sequence
  MKO10003097_A_Adarb1
  gRNA
aguaccgccugaagaagcga

SEQ ID NO: 3098 - RNA, 20 nt, Artificial Sequence
  MKO10003098_A_Adarb1
  gRNA
agcacuuuccuucgugcaug

SEQ ID NO: 3099 - RNA, 20 nt, Artificial Sequence
  MKO10003099_A_Adarb2
  gRNA
gaguagccguccucgccgau

SEQ ID NO: 3100 - RNA, 20 nt, Artificial Sequence
  MKO10003100_A_Adarb2
  gRNA
guacugaaugaguuacgcuc

SEQ ID NO: 3101 - RNA, 20 nt, Artificial Sequence
  MKO10003101_A_Adarb2
  gRNA
aaguuccgugaacugacagu

SEQ ID NO: 3102 - RNA, 20 nt, Artificial Sequence
  MKO10003102_A_Adar
  gRNA
cuuguccgucaaguaccaga

SEQ ID NO: 3103 - RNA, 20 nt, Artificial Sequence
  MKO10003103_A_Adar
  gRNA
agccaguucagcggaugacc

SEQ ID NO: 3104 - RNA, 20 nt, Artificial Sequence
  MKO10003104_A_Adar
  gRNA
uacucuaacaacccgcugac

SEQ ID NO: 3105 - RNA, 20 nt, Artificial Sequence
  MKO10003105_A_Adau1
  gRNA
cgggaagugcccguacagcc

SEQ ID NO: 3106 - RNA, 20 nt, Artificial Sequence
  MKO10003106_A_Adau1
  gRNA
cuuaccgcucucucgcaucu

SEQ ID NO: 3107 - RNA, 20 nt, Artificial Sequence
  MKO10003107_A_Adau1
  gRNA
uuacacgaaguagccccacc

SEQ ID NO: 3108 - RNA, 20 nt, Artificial Sequence
  MKO10003108_A_Adau2
  gRNA
aaaggauacucauaaggcgc

SEQ ID NO: 3109 - RNA, 20 nt, Artificial Sequence
  MKO10003109_A_Adau2
  gRNA
uucuguacuauaaaucccgc

SEQ ID NO: 3110 - RNA, 20 nt, Artificial Sequence
  MKO10003110_A_Adau2
  gRNA
caccguguuguacgucacug

SEQ ID NO: 3111 - RNA, 20 nt, Artificial Sequence
  MKO10003111_A_Adau3
  gRNA
agccgguagcgugcgcaagc

SEQ ID NO: 3112 - RNA, 20 nt, Artificial Sequence
  MKO10003112_A_Adau3
  gRNA
gggacgucuggcgcuugucc

SEQ ID NO: 3113 - RNA, 20 nt, Artificial Sequence
  MKO10003113_A_Adau3
  gRNA
uguggccaacacgcgguccg

SEQ ID NO: 3114 - RNA, 20 nt, Artificial Sequence
  MKO10003114_A_Ada
  gRNA
cgucaccccugaugacguug

SEQ ID NO: 3115 - RNA, 20 nt, Artificial Sequence
  MKO10003115_A_Ada
  gRNA
gguagaguuacacguccacc

SEQ ID NO: 3116 - RNA, 20 nt, Artificial Sequence
  MKO10003116_A_Ada
  gRNA
gcgcuauagcccacaccugc

SEQ ID NO: 3117 - RNA, 20 nt, Artificial Sequence
  MKO10003117_A_Adck1
  gRNA
guauuugcagcgucgauccc

SEQ ID NO: 3118 - RNA, 20 nt, Artificial Sequence
  MKO10003118_A_Adck1
  gRNA
aguuaagguccagcacccga

SEQ ID NO: 3119 - RNA, 20 nt, Artificial Sequence
  MKO10003119_A_Adck1
  gRNA
cgaagcucaggaacaaaucg

SEQ ID NO: 3120 - RNA, 20 nt, Artificial Sequence
  MKO10003120_A_Adck2
  gRNA
uucuggcagguauuacaccc

SEQ ID NO: 3121 - RNA, 20 nt, Artificial Sequence
  MKO10003121_A_Adck2
  gRNA
cacugcgcccccucaucacu

SEQ ID NO: 3122 - RNA, 20 nt, Artificial Sequence
  MKO10003122_A_Adck2
  gRNA
gaauucccaccgaucugaag

SEQ ID NO: 3123 - RNA, 20 nt, Artificial Sequence
  MKO10003123_A_Adck3
  gRNA
aaccgcccaauccggguaac

SEQ ID NO: 3124 - RNA, 20 nt, Artificial Sequence
  MKO10003124_A_Adck3
  gRNA
ggaucuucgcuggaugccgu

SEQ ID NO: 3125 - RNA, 20 nt, Artificial Sequence
  MKO10003125_A_Adck3
  gRNA
gcguggggccgcacugaagc

SEQ ID NO: 3126 - RNA, 20 nt, Artificial Sequence
  MKO10003126_A_Adck4
  gRNA
ugaucgcucucgugaacgca

SEQ ID NO: 3127 - RNA, 20 nt, Artificial Sequence
  MKO10003127_A_Adck4
  gRNA
cucacccuagagggcgucuc

SEQ ID NO: 3128 - RNA, 20 nt, Artificial Sequence
  MKO10003128_A_Adck4
  gRNA
cgaucuugagggcagccccc

SEQ ID NO: 3129 - RNA, 20 nt, Artificial Sequence
  MKO10003129_A_Adck5
  gRNA
gucagccgcacgcuggugac

SEQ ID NO: 3130 - RNA, 20 nt, Artificial Sequence
  MKO10003130_A_Adck5
  gRNA
cauccagacgcugcgugugc

SEQ ID NO: 3131 - RNA, 20 nt, Artificial Sequence
  MKO10003131_A_Adck5
  gRNA
ugcacaaacguuguccuucg

SEQ ID NO: 3132 - RNA, 20 nt, Artificial Sequence
  MKO10003132_A_Adcy10
  gRNA
cuaucuuaacucgaaugucc

SEQ ID NO: 3133 - RNA, 20 nt, Artificial Sequence
  MKO10003133_A_Adcy10
  gRNA
gaggaucuccacgagcuguu

SEQ ID NO: 3134 - RNA, 20 nt, Artificial Sequence
  MKO10003134_A_Adcy10
  gRNA
ccgaggagccgaacagcucg

SEQ ID NO: 3135 - RNA, 20 nt, Artificial Sequence
  MKO10003135_A_Adcy1
  gRNA
acauguauggcgucuucgug

SEQ ID NO: 3136 - RNA, 20 nt, Artificial Sequence
  MKO10003136_A_Adcy1
  gRNA
ugucgccgaaucaagauccu

SEQ ID NO: 3137 - RNA, 20 nt, Artificial Sequence
  MKO10003137_A_Adcy1
  gRNA
ucuugacagagcgcucccag

SEQ ID NO: 3138 - RNA, 20 nt, Artificial Sequence
  MKO10003138_A_Adcy2
  gRNA
ucaagcgacacaccaacgug

SEQ ID NO: 3139 - RNA, 20 nt, Artificial Sequence
  MKO10003139_A_Adcy2
  gRNA
gcaauuacaugugucccgau

SEQ ID NO: 3140 - RNA, 20 nt, Artificial Sequence
  MKO10003140_A_Adcy2
  gRNA
uggugugucgcuugacauac

SEQ ID NO: 3141 - RNA, 20 nt, Artificial Sequence
  MKO10003141_A_Adcy3
  gRNA
aaggucagccgcauaaagcg

SEQ ID NO: 3142 - RNA, 20 nt, Artificial Sequence
  MKO10003142_A_Adcy3
  gRNA
ggaccgagugagccgcaaag

SEQ ID NO: 3143 - RNA, 20 nt, Artificial Sequence
  MKO10003143_A_Adcy3
  gRNA
cuaccugugugcuaucaucg

SEQ ID NO: 3144 - RNA, 20 nt, Artificial Sequence
  MKO10003144_A_Adcy4
  gRNA
gagcauugcgggccacguuc

SEQ ID NO: 3145 - RNA, 20 nt, Artificial Sequence
  MKO10003145_A_Adcy4
  gRNA
cccgcaaugcucgcuccauc

SEQ ID NO: 3146 - RNA, 20 nt, Artificial Sequence
  MKO10003146_A_Adcy4
  gRNA
cguguacgccaugcugcccu

SEQ ID NO: 3147 - RNA, 20 nt, Artificial Sequence
  MKO10003147_A_Adcy5
  gRNA
cgcaguaguaacaauccccg

SEQ ID NO: 3148 - RNA, 20 nt, Artificial Sequence
  MKO10003148_A_Adcy5
  gRNA
agcagacaucaacgccaagc

SEQ ID NO: 3149 - RNA, 20 nt, Artificial Sequence
  MKO10003149_A_Adcy5
  gRNA
cccgggaguguauccaggcu

SEQ ID NO: 3150 - RNA, 20 nt, Artificial Sequence
  MKO10003150_A_Adcy6
  gRNA
ccaacagcucggugcuaacg

SEQ ID NO: 3151 - RNA, 20 nt, Artificial Sequence
  MKO10003151_A_Adcy6
  gRNA
cccgagguuacauccaggcg

SEQ ID NO: 3152 - RNA, 20 nt, Artificial Sequence
  MKO10003152_A_Adcy6
  gRNA
guugccccagcacguugcca

SEQ ID NO: 3153 - RNA, 20 nt, Artificial Sequence
  MKO10003153_A_Adcy7
  gRNA
ucaaaugcauccagauccgu

SEQ ID NO: 3154 - RNA, 20 nt, Artificial Sequence
  MKO10003154_A_Adcy7
  gRNA
ucuccacacgaagcuuccga

SEQ ID NO: 3155 - RNA, 20 nt, Artificial Sequence
  MKO10003155_A_Adcy7
  gRNA
ggaggucacgccugccacga

SEQ ID NO: 3156 - RNA, 20 nt, Artificial Sequence
  MKO10003156_A_Adcy8
  gRNA
uucagaccgugcccagcgcc

SEQ ID NO: 3157 - RNA, 20 nt, Artificial Sequence
  MKO10003157_A_Adcy8
  gRNA
aacucuuugccagauucgac

SEQ ID NO: 3158 - RNA, 20 nt, Artificial Sequence
  MKO10003158_A_Adcy8
  gRNA
accugacguucucauagcga

SEQ ID NO: 3159 - RNA, 20 nt, Artificial Sequence
  MKO10003159_A_Adcy9
  gRNA
uugaggucauugacgacuca

SEQ ID NO: 3160 - RNA, 20 nt, Artificial Sequence
  MKO10003160_A_Adcy9
  gRNA
acuaaccuuaagguuaucaa

SEQ ID NO: 3161 - RNA, 20 nt, Artificial Sequence
  MKO10003161_A_Adcy9
  gRNA
acguaccucuuccugguagc

SEQ ID NO: 3162 - RNA, 20 nt, Artificial Sequence
  MKO10003162_A_Adcyap1r1
  gRNA
ccaucaggucguuggcccuc

SEQ ID NO: 3163 - RNA, 20 nt, Artificial Sequence
  MKO10003163_A_Adcyap1r1
  gRNA
cuugguccggguugaagauc

SEQ ID NO: 3164 - RNA, 20 nt, Artificial Sequence
  MKO10003164_A_Adcyap1r1
  gRNA
cggaucuucaacccggacca

SEQ ID NO: 3165 - RNA, 20 nt, Artificial Sequence
  MKO10003165_A_Adcyap1
  gRNA
ggcguaagcgucacgcagcg

SEQ ID NO: 3166 - RNA, 20 nt, Artificial Sequence
  MKO10003166_A_Adcyap1
  gRNA
uggucguaagccucgucuuc

SEQ ID NO: 3167 - RNA, 20 nt, Artificial Sequence
  MKO10003167_A_Adcyap1
  gRNA
cugugaagaugccguccgag

SEQ ID NO: 3168 - RNA, 20 nt, Artificial Sequence
  MKO10003168_A_Adc
  gRNA
uugcacccgacagcauaaaa

SEQ ID NO: 3169 - RNA, 20 nt, Artificial Sequence
  MKO10003169_A_Adc
  gRNA
agccaggaaagccgccgcca

SEQ ID NO: 3170 - RNA, 20 nt, Artificial Sequence
  MKO10003170_A_Adc
  gRNA
acgaugaacauccuggaccu

SEQ ID NO: 3171 - RNA, 20 nt, Artificial Sequence
  MKO10003171_A_Add1
  gRNA
cauggcaccagaccuucguc

SEQ ID NO: 3172 - RNA, 20 nt, Artificial Sequence
  MKO10003172_A_Add1
  gRNA
cgauagaauccgacccucua

SEQ ID NO: 3173 - RNA, 20 nt, Artificial Sequence
  MKO10003173_A_Add1
  gRNA
ucauauugaaguccugacga

SEQ ID NO: 3174 - RNA, 20 nt, Artificial Sequence
  MKO10003174_A_Add2
  gRNA
guggauggcacaccgcacgu

SEQ ID NO: 3175 - RNA, 20 nt, Artificial Sequence
  MKO10003175_A_Add2
  gRNA
ccgacagaucgcggacuuca

SEQ ID NO: 3176 - RNA, 20 nt, Artificial Sequence
  MKO10003176_A_Add2
  gRNA
ugagcugcgcccagccguag

SEQ ID NO: 3177 - RNA, 20 nt, Artificial Sequence
  MKO10003177_A_Add3
  gRNA
uguaacgcuaauaagccgcu

SEQ ID NO: 3178 - RNA, 20 nt, Artificial Sequence
  MKO10003178_A_Add3
  gRNA
cuuguuugggugggcgcacc

SEQ ID NO: 3179 - RNA, 20 nt, Artificial Sequence
  MKO10003179_A_Add3
  gRNA
ccgagauguacguauuugcc

SEQ ID NO: 3180 - RNA, 20 nt, Artificial Sequence
  MKO10003180_A_Adgb
  gRNA
aguaugucgucaaacuuuac

SEQ ID NO: 3181 - RNA, 20 nt, Artificial Sequence
  MKO10003181_A_Adgb
  gRNA
uucccguagcuguugaacaa

SEQ ID NO: 3182 - RNA, 20 nt, Artificial Sequence
  MKO10003182_A_Adgb
  gRNA
augucugccucgcuccacuc

SEQ ID NO: 3183 - RNA, 20 nt, Artificial Sequence
  MKO10003183_A_Adh1
  gRNA
ugcgacuucuauguccucga

SEQ ID NO: 3184 - RNA, 20 nt, Artificial Sequence
  MKO10003184_A_Adh1
  gRNA
ccuucgcgcaaagucccccg

SEQ ID NO: 3185 - RNA, 20 nt, Artificial Sequence
  MKO10003185_A_Adh1
  gRNA
ucacaaacccuucaccaucg

SEQ ID NO: 3186 - RNA, 20 nt, Artificial Sequence
  MKO10003186_A_Adh4
  gRNA
auccgaaccucacaagcuuu

SEQ ID NO: 3187 - RNA, 20 nt, Artificial Sequence
  MKO10003187_A_Adh4
  gRNA
guguaccuuggcaguauuga

SEQ ID NO: 3188 - RNA, 20 nt, Artificial Sequence
  MKO10003188_A_Adh4
  gRNA
ucuugccagagucgaugaug

SEQ ID NO: 3189 - RNA, 20 nt, Artificial Sequence
  MKO10003189_A_Adh5
  gRNA
acuuuauccaaaggggccga

SEQ ID NO: 3190 - RNA, 20 nt, Artificial Sequence
  MKO10003190_A_Adh5
  gRNA
uguugcuaaaaucgauccuu

SEQ ID NO: 3191 - RNA, 20 nt, Artificial Sequence
  MKO10003191_A_Adh5
  gRNA
gauagaaguggccccuccaa

SEQ ID NO: 3192 - RNA, 20 nt, Artificial Sequence
  MKO10003192_A_Adh6a
  gRNA
gacgccugcuugcaccccaa

SEQ ID NO: 3193 - RNA, 20 nt, Artificial Sequence
  MKO10003193_A_Adh6a
  gRNA
caaguugagccaccgaaguc

SEQ ID NO: 3194 - RNA, 20 nt, Artificial Sequence
  MKO10003194_A_Adh6a
  gRNA
acagcagccccguagccagu

SEQ ID NO: 3195 - RNA, 20 nt, Artificial Sequence
  MKO10003195_A_Adh7
  gRNA
ggacgaauccuccguagcga

SEQ ID NO: 3196 - RNA, 20 nt, Artificial Sequence
  MKO10003196_A_Adh7
  gRNA
cgcaccgucaaccuucgcua

SEQ ID NO: 3197 - RNA, 20 nt, Artificial Sequence
  MKO10003197_A_Adh7
  gRNA
acacggacuuccuuagccuu

SEQ ID NO: 3198 - RNA, 20 nt, Artificial Sequence
  MKO10003198_A_Adhfe1
  gRNA
aacugaugccauucuucgau

SEQ ID NO: 3199 - RNA, 20 nt, Artificial Sequence
  MKO10003199_A_Adhfe1
  gRNA
aacagcagauuacgccuuug

SEQ ID NO: 3200 - RNA, 20 nt, Artificial Sequence
  MKO10003200_A_Adhfe1
  gRNA
gaauccauaacuauuuguac

SEQ ID NO: 3201 - RNA, 20 nt, Artificial Sequence
  MKO10003201_A_Adi1
  gRNA
acgaguccaccgccgacccg

SEQ ID NO: 3202 - RNA, 20 nt, Artificial Sequence
  MKO10003202_A_Adi1
  gRNA
guaguggguacuucgauguc

SEQ ID NO: 3203 - RNA, 20 nt, Artificial Sequence
  MKO10003203_A_Adi1
  gRNA
gcacgcucggagugcucuau

SEQ ID NO: 3204 - RNA, 20 nt, Artificial Sequence
  MKO10003204_A_Adig
  gRNA
ugcuguucuugacgaucguc

SEQ ID NO: 3205 - RNA, 20 nt, Artificial Sequence
  MKO10003205_A_Adig
  gRNA
guaugcgaugaaguacccuc

SEQ ID NO: 3206 - RNA, 20 nt, Artificial Sequence
  MKO10003206_A_Adig
  gRNA
uggaguccguccuccucacc

SEQ ID NO: 3207 - RNA, 20 nt, Artificial Sequence
  MKO10003207_A_Adipoq
  gRNA
cuucaccuacgaccaguauc

SEQ ID NO: 3208 - RNA, 20 nt, Artificial Sequence
  MKO10003208_A_Adipoq
  gRNA
cgcugagcgauacacauaag

SEQ ID NO: 3209 - RNA, 20 nt, Artificial Sequence
  MKO10003209_A_Adipoq
  gRNA
aauggcacaccaggccguga

SEQ ID NO: 3210 - RNA, 20 nt, Artificial Sequence
  MKO10003210_A_Adipor1
  gRNA
gauggaggaguucguguaua

SEQ ID NO: 3211 - RNA, 20 nt, Artificial Sequence
  MKO10003211_A_Adipor1
  gRNA
uuauggggagcuucguuccc

SEQ ID NO: 3212 - RNA, 20 nt, Artificial Sequence
  MKO10003212_A_Adipor1
  gRNA
gacaacgacuaccugcuaca

SEQ ID NO: 3213 - RNA, 20 nt, Artificial Sequence
  MKO10003213_A_Adipor2
  gRNA
cgugagggaucacucgccau

SEQ ID NO: 3214 - RNA, 20 nt, Artificial Sequence
  MKO10003214_A_Adipor2
  gRNA
gcucugaccccccgauacug

SEQ ID NO: 3215 - RNA, 20 nt, Artificial Sequence
  MKO10003215_A_Adipor2
  gRNA
uguuugccaccccucaguau

SEQ ID NO: 3216 - RNA, 20 nt, Artificial Sequence
  MKO10003216_A_Adk
  gRNA
acuugugcugcguguaucac

SEQ ID NO: 3217 - RNA, 20 nt, Artificial Sequence
  MKO10003217_A_Adk
  gRNA
cgucagcagccuuacgcuuc

SEQ ID NO: 3218 - RNA, 20 nt, Artificial Sequence
  MKO10003218_A_Adk
  gRNA
uacgcagaauucaaugaaag

SEQ ID NO: 3219 - RNA, 20 nt, Artificial Sequence
  MKO10003219_A_Adm2
  gRNA
cgacgagacuuccagacuac

SEQ ID NO: 3220 - RNA, 20 nt, Artificial Sequence
  MKO10003220_A_Adm2
  gRNA
agaaucuuagccaucgccug

SEQ ID NO: 3221 - RNA, 20 nt, Artificial Sequence
  MKO10003221_A_Adm2
  gRNA
uuaccgugaccaucagcaac

SEQ ID NO: 3222 - RNA, 20 nt, Artificial Sequence
  MKO10003222_A_Adm
  gRNA
gucucaucagcgagucccgu

SEQ ID NO: 3223 - RNA, 20 nt, Artificial Sequence
  MKO10003223_A_Adm
  gRNA
cgaagcggcauccauugcug

SEQ ID NO: 3224 - RNA, 20 nt, Artificial Sequence
  MKO10003224_A_Adm
  gRNA
cacuucuuucggaacugcga

SEQ ID NO: 3225 - RNA, 20 nt, Artificial Sequence
  MKO10003225_A_Adnp2
  gRNA
ggaacgcccuucguacuugc

SEQ ID NO: 3226 - RNA, 20 nt, Artificial Sequence
  MKO10003226_A_Adnp2
  gRNA
gugaaccaagcuguccgccc

SEQ ID NO: 3227 - RNA, 20 nt, Artificial Sequence
  MKO10003227_A_Adnp2
  gRNA
uuauaaaaguacuucucucc

SEQ ID NO: 3228 - RNA, 20 nt, Artificial Sequence
  MKO10003228_A_Adnp
  gRNA
acccucucuacgagaucguc

SEQ ID NO: 3229 - RNA, 20 nt, Artificial Sequence
  MKO10003229_A_Adnp
  gRNA
ugcucauacgugcgcuucac

SEQ ID NO: 3230 - RNA, 20 nt, Artificial Sequence
  MKO10003230_A_Adnp
  gRNA
cccuucucuuacgaaaaauc

SEQ ID NO: 3231 - RNA, 20 nt, Artificial Sequence
  MKO10003231_A_Adora1
  gRNA
gcucaagaucgccaagucgc

SEQ ID NO: 3232 - RNA, 20 nt, Artificial Sequence
  MKO10003232_A_Adora1
  gRNA
aacacugccguuggcuaucc

SEQ ID NO: 3233 - RNA, 20 nt, Artificial Sequence
  MKO10003233_A_Adora1
  gRNA
caccaugccgccguacaucu

SEQ ID NO: 3234 - RNA, 20 nt, Artificial Sequence
  MKO10003234_A_Adora2a
  gRNA
ucuggcggcggcugacaucg

SEQ ID NO: 3235 - RNA, 20 nt, Artificial Sequence
  MKO10003235_A_Adora2a
  gRNA
ucgccauccgaauuccacuc

SEQ ID NO: 3236 - RNA, 20 nt, Artificial Sequence
  MKO10003236_A_Adora2a
  gRNA
agcgaguccgcuccccuggu

SEQ ID NO: 3237 - RNA, 20 nt, Artificial Sequence
  MKO10003237_A_Adora2b
  gRNA
gacgcaagacgcgcuguacg

SEQ ID NO: 3238 - RNA, 20 nt, Artificial Sequence
  MKO10003238_A_Adora2b
  gRNA
gguggcugucgaccgauauc

SEQ ID NO: 3239 - RNA, 20 nt, Artificial Sequence
  MKO10003239_A_Adora2b
  gRNA
ucacugggacacgagcgaga

SEQ ID NO: 3240 - RNA, 20 nt, Artificial Sequence
  MKO10003240_A_Adora3
  gRNA
cccuaauagcaccaaccgug

SEQ ID NO: 3241 - RNA, 20 nt, Artificial Sequence
  MKO10003241_A_Adora3
  gRNA
uuugugccacuuccguuccg

SEQ ID NO: 3242 - RNA, 20 nt, Artificial Sequence
  MKO10003242_A_Adora3
  gRNA
accagaugucgcaaugugcc

SEQ ID NO: 3243 - RNA, 20 nt, Artificial Sequence
  MKO10003243_A_Ado
  gRNA
ccucaacaucgcgccgcgca

SEQ ID NO: 3244 - RNA, 20 nt, Artificial Sequence
  MKO10003244_A_Ado
  gRNA
aagcaugccccgcgacaaca

SEQ ID NO: 3245 - RNA, 20 nt, Artificial Sequence
  MKO10003245_A_Ado
  gRNA
acgccuggcgagcgaugcgc

SEQ ID NO: 3246 - RNA, 20 nt, Artificial Sequence
  MKO10003246_A_Adpgk
  gRNA
ucuacacucgagaagugauc

SEQ ID NO: 3247 - RNA, 20 nt, Artificial Sequence
  MKO10003247_A_Adpgk
  gRNA
uucuagagucaacgccugug

SEQ ID NO: 3248 - RNA, 20 nt, Artificial Sequence
  MKO10003248_A_Adpgk
  gRNA
ccaucaugugcaauccagaa

SEQ ID NO: 3249 - RNA, 20 nt, Artificial Sequence
  MKO10003249_A_Adprhl1
  gRNA
cauuccgaugcacaucgcuu

SEQ ID NO: 3250 - RNA, 20 nt, Artificial Sequence
  MKO10003250_A_Adprhl1
  gRNA
cacgcgaggagguaguuauc

SEQ ID NO: 3251 - RNA, 20 nt, Artificial Sequence
  MKO10003251_A_Adprhl1
  gRNA
cguagcgcuuuaccaucucu

SEQ ID NO: 3252 - RNA, 20 nt, Artificial Sequence
  MKO10003252_A_Adprhl2
  gRNA
aggaacccuucccguugaac

SEQ ID NO: 3253 - RNA, 20 nt, Artificial Sequence
  MKO10003253_A_Adprhl2
  gRNA
agccauguccaccucgucga

SEQ ID NO: 3254 - RNA, 20 nt, Artificial Sequence
  MKO10003254_A_Adprhl2
  gRNA
uucaacgggaaggguuccua

SEQ ID NO: 3255 - RNA, 20 nt, Artificial Sequence
  MKO10003255_A_Adprh
  gRNA
guauucgagcuucucguagu

SEQ ID NO: 3256 - RNA, 20 nt, Artificial Sequence
  MKO10003256_A_Adprh
  gRNA
cgcggccaggagggcaucgu

SEQ ID NO: 3257 - RNA, 20 nt, Artificial Sequence
  MKO10003257_A_Adprh
  gRNA
gccaugcgcgccaugugcau

SEQ ID NO: 3258 - RNA, 20 nt, Artificial Sequence
  MKO10003258_A_Adprm
  gRNA
uucccccacguguggugaac

SEQ ID NO: 3259 - RNA, 20 nt, Artificial Sequence
  MKO10003259_A_Adprm
  gRNA
ggagguuauggcugauaagc

SEQ ID NO: 3260 - RNA, 20 nt, Artificial Sequence
  MKO10003260_A_Adprm
  gRNA
uugacauggugcacgccgaa

SEQ ID NO: 3261 - RNA, 20 nt, Artificial Sequence
  MKO10003261_A_Adra1a
  gRNA
ggccaggauuaccaugccga

SEQ ID NO: 3262 - RNA, 20 nt, Artificial Sequence
  MKO10003262_A_Adra1a
  gRNA
ugguaauccuggccgauccc

SEQ ID NO: 3263 - RNA, 20 nt, Artificial Sequence
  MKO10003263_A_Adra1a
  gRNA
cgagugcagaugccgaugac

SEQ ID NO: 3264 - RNA, 20 nt, Artificial Sequence
  MKO10003264_A_Adra1b
  gRNA
acgcgccuucaugcguaucc

SEQ ID NO: 3265 - RNA, 20 nt, Artificial Sequence
  MKO10003265_A_Adra1b
  gRNA
gcgcuuacaccuaccggccg

SEQ ID NO: 3266 - RNA, 20 nt, Artificial Sequence
  MKO10003266_A_Adra1b
  gRNA
guacugccgagucuacaucg

SEQ ID NO: 3267 - RNA, 20 nt, Artificial Sequence
  MKO10003267_A_Adra1d
  gRNA
gugaauggcucggcggccgu

SEQ ID NO: 3268 - RNA, 20 nt, Artificial Sequence
  MKO10003268_A_Adra1d
  gRNA
ccggaccuucugcgacguau

SEQ ID NO: 3269 - RNA, 20 nt, Artificial Sequence
  MKO10003269_A_Adra1d
  gRNA
ggcgcgcuugaacucgcgac

SEQ ID NO: 3270 - RNA, 20 nt, Artificial Sequence
  MKO10003270_A_Adra2a
  gRNA
gguggugaucggcguguucg

SEQ ID NO: 3271 - RNA, 20 nt, Artificial Sequence
  MKO10003271_A_Adra2a
  gRNA
gccgaccgcuaugagcgugu

SEQ ID NO: 3272 - RNA, 20 nt, Artificial Sequence
  MKO10003272_A_Adra2a
  gRNA
caacgugcugguuauuaucg

SEQ ID NO: 3273 - RNA, 20 nt, Artificial Sequence
  MKO10003273_A_Adra2b
  gRNA
uaccagcgcauugccgaaaa

SEQ ID NO: 3274 - RNA, 20 nt, Artificial Sequence
  MKO10003274_A_Adra2b
  gRNA
gaacucccccggcggccgga

SEQ ID NO: 3275 - RNA, 20 nt, Artificial Sequence
  MKO10003275_A_Adra2b
  gRNA
acuuccgccgugccuuucga

SEQ ID NO: 3276 - RNA, 20 nt, Artificial Sequence
  MKO10003276_A_Adra2c
  gRNA
cucucgucucguucuaccgc

SEQ ID NO: 3277 - RNA, 20 nt, Artificial Sequence
  MKO10003277_A_Adra2c
  gRNA
cguacgcucagcgagaaacg

SEQ ID NO: 3278 - RNA, 20 nt, Artificial Sequence
  MKO10003278_A_Adra2c
  gRNA
cggacggcgucucggucccc

SEQ ID NO: 3279 - RNA, 20 nt, Artificial Sequence
  MKO10003279_A_Adrb1
  gRNA
gaacacccgcagguacacga

SEQ ID NO: 3280 - RNA, 20 nt, Artificial Sequence
  MKO10003280_A_Adrb1
  gRNA
cgcggguaugggccuacugc

SEQ ID NO: 3281 - RNA, 20 nt, Artificial Sequence
  MKO10003281_A_Adrb1
  gRNA
gcggcgcgcuucgucgcucu

SEQ ID NO: 3282 - RNA, 20 nt, Artificial Sequence
  MKO10003282_A_Adrb2
  gRNA
gcuagaguagccguucccau

SEQ ID NO: 3283 - RNA, 20 nt, Artificial Sequence
  MKO10003283_A_Adrb2
  gRNA
gccagaccacgacgucacuc

SEQ ID NO: 3284 - RNA, 20 nt, Artificial Sequence
  MKO10003284_A_Adrb2
  gRNA
agcuaucgauuguuacaccg

SEQ ID NO: 3285 - RNA, 20 nt, Artificial Sequence
  MKO10003285_A_Adrb3
  gRNA
cccggcgcagcaaaugccgu

SEQ ID NO: 3286 - RNA, 20 nt, Artificial Sequence
  MKO10003286_A_Adrb3
  gRNA
accagcgugccguaacgcaa

SEQ ID NO: 3287 - RNA, 20 nt, Artificial Sequence
  MKO10003287_A_Adrb3
  gRNA
acggcccuucacgugggaaa

SEQ ID NO: 3288 - RNA, 20 nt, Artificial Sequence
  MKO10003288_A_Adrbk1
  gRNA
cuugguggaguucuacgaag

SEQ ID NO: 3289 - RNA, 20 nt, Artificial Sequence
  MKO10003289_A_Adrbk1
  gRNA
agauuugucagaaccuccga

SEQ ID NO: 3290 - RNA, 20 nt, Artificial Sequence
  MKO10003290_A_Adrbk1
  gRNA
agucaaagaucucucggcug

SEQ ID NO: 3291 - RNA, 20 nt, Artificial Sequence
  MKO10003291_A_Adrbk2
  gRNA
uguaggcgucguacaucugc

SEQ ID NO: 3292 - RNA, 20 nt, Artificial Sequence
  MKO10003292_A_Adrbk2
  gRNA
acgaagaggauaggcuacgc

SEQ ID NO: 3293 - RNA, 20 nt, Artificial Sequence
  MKO10003293_A_Adrbk2
  gRNA
uguagccgucaccuguuucu

SEQ ID NO: 3294 - RNA, 20 nt, Artificial Sequence
  MKO10003294_A_Adrm1
  gRNA
gggcauuacccaguccuccc

SEQ ID NO: 3295 - RNA, 20 nt, Artificial Sequence
  MKO10003295_A_Adrm1
  gRNA
uauuucuguagguggacuug

SEQ ID NO: 3296 - RNA, 20 nt, Artificial Sequence
  MKO10003296_A_Adrm1
  gRNA
cagccagcagcucuucaucc

SEQ ID NO: 3297 - RNA, 20 nt, Artificial Sequence
  MKO10003297_A_Adsl
  gRNA
cgugcugaucugcccacguu

SEQ ID NO: 3298 - RNA, 20 nt, Artificial Sequence
  MKO10003298_A_Adsl
  gRNA
gagccaucacgucgugccgc

SEQ ID NO: 3299 - RNA, 20 nt, Artificial Sequence
  MKO10003299_A_Adsl
  gRNA
gcugcgcuuccgaggaguaa

SEQ ID NO: 3300 - RNA, 20 nt, Artificial Sequence
  MKO10003300_A_Adssl1
  gRNA
cacaguagugguggacggca

SEQ ID NO: 3301 - RNA, 20 nt, Artificial Sequence
  MKO10003301_A_Adssl1
  gRNA
cuugccgggcuuguuugaag

SEQ ID NO: 3302 - RNA, 20 nt, Artificial Sequence
  MKO10003302_A_Adssl1
  gRNA
uuucuaggggggcaacaaug

SEQ ID NO: 3303 - RNA, 20 nt, Artificial Sequence
  MKO10003303_A_Adss
  gRNA
uuucagggagggaauaacgc

SEQ ID NO: 3304 - RNA, 20 nt, Artificial Sequence
  MKO10003304_A_Adss
  gRNA
cacaguugucguagauucug

SEQ ID NO: 3305 - RNA, 20 nt, Artificial Sequence
  MKO10003305_A_Adss
  gRNA
cuuuccuaggucuagauggc

SEQ ID NO: 3306 - RNA, 20 nt, Artificial Sequence
  MKO10003306_A_Adtrp
  gRNA
agcauggguuaaccacgcaa

SEQ ID NO: 3307 - RNA, 20 nt, Artificial Sequence
  MKO10003307_A_Adtrp
  gRNA
auugcgugguuaacccaugc

SEQ ID NO: 3308 - RNA, 20 nt, Artificial Sequence
  MKO10003308_A_Adtrp
  gRNA
guacuugacacuccuuaauc

SEQ ID NO: 3309 - RNA, 20 nt, Artificial Sequence
  MKO10003309_A_Aebp1
  gRNA
uaaccgauccagcguuucca

SEQ ID NO: 3310 - RNA, 20 nt, Artificial Sequence
  MKO10003310_A_Aebp1
  gRNA
cccccuuggaaacgcuggau

SEQ ID NO: 3311 - RNA, 20 nt, Artificial Sequence
  MKO10003311_A_Aebp1
  gRNA
cguaauccuccuucucuauc

SEQ ID NO: 3312 - RNA, 20 nt, Artificial Sequence
  MKO10003312_A_Aebp2
  gRNA
auucgcuccauacaugucga

SEQ ID NO: 3313 - RNA, 20 nt, Artificial Sequence
  MKO10003313_A_Aebp2
  gRNA
acgcugaccaucgacaugua

SEQ ID NO: 3314 - RNA, 20 nt, Artificial Sequence
  MKO10003314_A_Aebp2
  gRNA
ccgcuguagccaacucugac

SEQ ID NO: 3315 - RNA, 20 nt, Artificial Sequence
  MKO10003315_A_Aen
  gRNA
uuguggacuaucgcacccgc

SEQ ID NO: 3316 - RNA, 20 nt, Artificial Sequence
  MKO10003316_A_Aen
  gRNA
gcgggugcgauaguccacaa

SEQ ID NO: 3317 - RNA, 20 nt, Artificial Sequence
  MKO10003317_A_Aen
  gRNA
ccagcucccuuauccgaacu

SEQ ID NO: 3318 - RNA, 20 nt, Artificial Sequence
  MKO10003318_A_Aes
  gRNA
caucucgauguucaauccgu

SEQ ID NO: 3319 - RNA, 20 nt, Artificial Sequence
  MKO10003319_A_Aes
  gRNA
gaagcuggagugcgacaagc

SEQ ID NO: 3320 - RNA, 20 nt, Artificial Sequence
  MKO10003320_A_Aes
  gRNA
uccaggcggaaauugugaag

SEQ ID NO: 3321 - RNA, 20 nt, Artificial Sequence
  MKO10003321_A_Afap1l1
  gRNA
cuucgggauaugucggacga

SEQ ID NO: 3322 - RNA, 20 nt, Artificial Sequence
  MKO10003322_A_Afap1l1
  gRNA
caucguccgacauaucccga

SEQ ID NO: 3323 - RNA, 20 nt, Artificial Sequence
  MKO10003323_A_Afap1l1
  gRNA
gcccaacaagcccccgcccg

SEQ ID NO: 3324 - RNA, 20 nt, Artificial Sequence
  MKO10003324_A_Afap1l2
  gRNA
ggacucgaucuuuggaacgg

SEQ ID NO: 3325 - RNA, 20 nt, Artificial Sequence
  MKO10003325_A_Afap1l2
  gRNA
cuagccacuucuugcgccac

SEQ ID NO: 3326 - RNA, 20 nt, Artificial Sequence
  MKO10003326_A_Afap1l2
  gRNA
uccaaagaucgaguccccug

SEQ ID NO: 3327 - RNA, 20 nt, Artificial Sequence
  MKO10003327_A_Afap1
  gRNA
caaagcguuucuugcgcagc

SEQ ID NO: 3328 - RNA, 20 nt, Artificial Sequence
  MKO10003328_A_Afap1
  gRNA
cugcugcgcaagaaacgcuu

SEQ ID NO: 3329 - RNA, 20 nt, Artificial Sequence
  MKO10003329_A_Afap1
  gRNA
ucagauggagcugccgcugc

SEQ ID NO: 3330 - RNA, 20 nt, Artificial Sequence
  MKO10003330_A_Aff1
  gRNA
ucuggacggcucggcuguac

SEQ ID NO: 3331 - RNA, 20 nt, Artificial Sequence
  MKO10003331_A_Aff1
  gRNA
agccugauccugaccgucca

SEQ ID NO: 3332 - RNA, 20 nt, Artificial Sequence
  MKO10003332_A_Aff1
  gRNA
cuguggcuaauguuaccgac

SEQ ID NO: 3333 - RNA, 20 nt, Artificial Sequence
  MKO10003333_A_Aff2
  gRNA
cuaguguuaugacuaucucg

SEQ ID NO: 3334 - RNA, 20 nt, Artificial Sequence
  MKO10003334_A_Aff2
  gRNA
gaauuuacagugcaagcacc

SEQ ID NO: 3335 - RNA, 20 nt, Artificial Sequence
  MKO10003335_A_Aff2
  gRNA
accguagugcacuuaaaaaa

SEQ ID NO: 3336 - RNA, 20 nt, Artificial Sequence
  MKO10003336_A_Aff3
  gRNA
gcugggcacccaccguccga

SEQ ID NO: 3337 - RNA, 20 nt, Artificial Sequence
  MKO10003337_A_Aff3
  gRNA
aaccggauccagaauacauu

SEQ ID NO: 3338 - RNA, 20 nt, Artificial Sequence
  MKO10003338_A_Aff3
  gRNA
uucagcuuaggagauucguc

SEQ ID NO: 3339 - RNA, 20 nt, Artificial Sequence
  MKO10003339_A_Aff4
  gRNA
cugcuuaaggcaucgguuuc

SEQ ID NO: 3340 - RNA, 20 nt, Artificial Sequence
  MKO10003340_A_Aff4
  gRNA
uguaugaauagccguuagag

SEQ ID NO: 3341 - RNA, 20 nt, Artificial Sequence
  MKO10003341_A_Aff4
  gRNA
gaaaauuccuucccgaccuu

SEQ ID NO: 3342 - RNA, 20 nt, Artificial Sequence
  MKO10003342_A_Afg3l1
  gRNA
cgacaaggacuuccggagcc

SEQ ID NO: 3343 - RNA, 20 nt, Artificial Sequence
  MKO10003343_A_Afg3l1
  gRNA
cggaaguccuugucguccca

SEQ ID NO: 3344 - RNA, 20 nt, Artificial Sequence
  MKO10003344_A_Afg3l1
  gRNA
acuguagaaccaaaaaaugc

SEQ ID NO: 3345 - RNA, 20 nt, Artificial Sequence
  MKO10003345_A_Afg3l2
  gRNA
uacuucguguucaagagcuc

SEQ ID NO: 3346 - RNA, 20 nt, Artificial Sequence
  MKO10003346_A_Afg3l2
  gRNA
uucuguucucgaccucccaa

SEQ ID NO: 3347 - RNA, 20 nt, Artificial Sequence
  MKO10003347_A_Afg3l2
  gRNA
auuucaggauguacuuucuc

SEQ ID NO: 3348 - RNA, 20 nt, Artificial Sequence
  MKO10003348_A_Afmid
  gRNA
ggacaucuacuuucccgaug

SEQ ID NO: 3349 - RNA, 20 nt, Artificial Sequence
  MKO10003349_A_Afmid
  gRNA
gcuuaugacauugcacccaa

SEQ ID NO: 3350 - RNA, 20 nt, Artificial Sequence
  MKO10003350_A_Afmid
  gRNA
cucacccuuggaauccucau

SEQ ID NO: 3351 - RNA, 20 nt, Artificial Sequence
  MKO10003351_A_Afm
  gRNA
auacugggaaaacgcgauga

SEQ ID NO: 3352 - RNA, 20 nt, Artificial Sequence
  MKO10003352_A_Afm
  gRNA
uguucagaaugacgcuaucc

SEQ ID NO: 3353 - RNA, 20 nt, Artificial Sequence
  MKO10003353_A_Afm
  gRNA
cgcccccguucuucuagccg

SEQ ID NO: 3354 - RNA, 20 nt, Artificial Sequence
  MKO10003354_A_Afp
  gRNA
ucaguacgacaaggucguuc

SEQ ID NO: 3355 - RNA, 20 nt, Artificial Sequence
  MKO10003355_A_Afp
  gRNA
cauucuucuccgucacgcac

SEQ ID NO: 3356 - RNA, 20 nt, Artificial Sequence
  MKO10003356_A_Afp
  gRNA
acggaacucucuaacaagua

SEQ ID NO: 3357 - RNA, 20 nt, Artificial Sequence
  MKO10003357_A_Aftph
  gRNA
accagauuauacucguccca

SEQ ID NO: 3358 - RNA, 20 nt, Artificial Sequence
  MKO10003358_A_Aftph
  gRNA
uuuacaccgcuccuuuguaa

SEQ ID NO: 3359 - RNA, 20 nt, Artificial Sequence
  MKO10003359_A_Aftph
  gRNA
guuucgagugucuauuccca

SEQ ID NO: 3360 - RNA, 20 nt, Artificial Sequence
  MKO10003360_A_Agap1
  gRNA
gacacucagccgaucgguac

SEQ ID NO: 3361 - RNA, 20 nt, Artificial Sequence
  MKO10003361_A_Agap1
  gRNA
ccugcacguacgugccuguc

SEQ ID NO: 3362 - RNA, 20 nt, Artificial Sequence
  MKO10003362_A_Agap1
  gRNA
ccugacaggcacguacgugc

SEQ ID NO: 3363 - RNA, 20 nt, Artificial Sequence
  MKO10003363_A_Agap2
  gRNA
aucaauucccgaacugcgcc

SEQ ID NO: 3364 - RNA, 20 nt, Artificial Sequence
  MKO10003364_A_Agap2
  gRNA
gcuaccuaccaggcgcaguu

SEQ ID NO: 3365 - RNA, 20 nt, Artificial Sequence
  MKO10003365_A_Agap2
  gRNA
augaacccgugaggaaucua

SEQ ID NO: 3366 - RNA, 20 nt, Artificial Sequence
  MKO10003366_A_Agap3
  gRNA
ggaaguaguuguacaccguc

SEQ ID NO: 3367 - RNA, 20 nt, Artificial Sequence
  MKO10003367_A_Agap3
  gRNA
ccuagggggucgauuuaaaa

SEQ ID NO: 3368 - RNA, 20 nt, Artificial Sequence
  MKO10003368_A_Agap3
  gRNA
auagugggcaaccugucuag

SEQ ID NO: 3369 - RNA, 20 nt, Artificial Sequence
  MKO10003369_A_Aga
  gRNA
ugaagguggcgaaaccaccc

SEQ ID NO: 3370 - RNA, 20 nt, Artificial Sequence
  MKO10003370_A_Aga
  gRNA
ccccacuaaaagcgugugug

SEQ ID NO: 3371 - RNA, 20 nt, Artificial Sequence
  MKO10003371_A_Aga
  gRNA
gugacuuaccaauaguauca

SEQ ID NO: 3372 - RNA, 20 nt, Artificial Sequence
  MKO10003372_A_Agbl1
  gRNA
augcucgguaccugauuguc

SEQ ID NO: 3373 - RNA, 20 nt, Artificial Sequence
  MKO10003373_A_Agbl1
  gRNA
caacagaaagcagaucgccg

SEQ ID NO: 3374 - RNA, 20 nt, Artificial Sequence
  MKO10003374_A_Agbl1
  gRNA
aguaaccacgggagccaugc

SEQ ID NO: 3375 - RNA, 20 nt, Artificial Sequence
  MKO10003375_A_Agbl2
  gRNA
uugaugaccucacauucgau

SEQ ID NO: 3376 - RNA, 20 nt, Artificial Sequence
  MKO10003376_A_Agbl2
  gRNA
aagauggccaaucgaaugug

SEQ ID NO: 3377 - RNA, 20 nt, Artificial Sequence
  MKO10003377_A_Agbl2
  gRNA
gagccauucaacauguaccg

SEQ ID NO: 3378 - RNA, 20 nt, Artificial Sequence
  MKO10003378_A_Agbl3
  gRNA
agauggguaccacgccuucg

SEQ ID NO: 3379 - RNA, 20 nt, Artificial Sequence
  MKO10003379_A_Agbl3
  gRNA
auguucgguuacccccaacu

SEQ ID NO: 3380 - RNA, 20 nt, Artificial Sequence
  MKO10003380_A_Agbl3
  gRNA
uauucauccgugcacacuac

SEQ ID NO: 3381 - RNA, 20 nt, Artificial Sequence
  MKO10003381_A_Agbl4
  gRNA
guaauccacgcuuccgaguc

SEQ ID NO: 3382 - RNA, 20 nt, Artificial Sequence
  MKO10003382_A_Agbl4
  gRNA
accaagagucuuuaccgaga

SEQ ID NO: 3383 - RNA, 20 nt, Artificial Sequence
  MKO10003383_A_Agbl4
  gRNA
aaucagagacuugcucaacc

SEQ ID NO: 3384 - RNA, 20 nt, Artificial Sequence
  MKO10003384_A_Agbl5
  gRNA
cucuacgaaacggugaacaa

SEQ ID NO: 3385 - RNA, 20 nt, Artificial Sequence
  MKO10003385_A_Agbl5
  gRNA
cugacuacgaguucaacgug

SEQ ID NO: 3386 - RNA, 20 nt, Artificial Sequence
  MKO10003386_A_Agbl5
  gRNA
cacacguugaacucguaguc

SEQ ID NO: 3387 - RNA, 20 nt, Artificial Sequence
  MKO10003387_A_Ager
  gRNA
ccuuacgguagacucggacu

SEQ ID NO: 3388 - RNA, 20 nt, Artificial Sequence
  MKO10003388_A_Ager
  gRNA
ugucgggcaacuaacaggcg

SEQ ID NO: 3389 - RNA, 20 nt, Artificial Sequence
  MKO10003389_A_Ager
  gRNA
gggaaacuucugauucccga

SEQ ID NO: 3390 - RNA, 20 nt, Artificial Sequence
  MKO10003390_A_Agfg1
  gRNA
ucgguucaugcgucuauuuc

SEQ ID NO: 3391 - RNA, 20 nt, Artificial Sequence
  MKO10003391_A_Agfg1
  gRNA
ugaaauagacgcaugaaccg

SEQ ID NO: 3392 - RNA, 20 nt, Artificial Sequence
  MKO10003392_A_Agfg1
  gRNA
gaggguuaaauccaccucac

SEQ ID NO: 3393 - RNA, 20 nt, Artificial Sequence
  MKO10003393_A_Agfg2
  gRNA
agauugacuugacucgauga

SEQ ID NO: 3394 - RNA, 20 nt, Artificial Sequence
  MKO10003394_A_Agfg2
  gRNA
uucaggucugucggaaaauc

SEQ ID NO: 3395 - RNA, 20 nt, Artificial Sequence
  MKO10003395_A_Agfg2
  gRNA
cucccccgauauccgccagc

SEQ ID NO: 3396 - RNA, 20 nt, Artificial Sequence
  MKO10003396_A_Aggf1
  gRNA
uaagcccgugcucucgucgu

SEQ ID NO: 3397 - RNA, 20 nt, Artificial Sequence
  MKO10003397_A_Aggf1
  gRNA
cuucaccuacgacgagagca

SEQ ID NO: 3398 - RNA, 20 nt, Artificial Sequence
  MKO10003398_A_Aggf1
  gRNA
ugaguaccugaaaucgccca

SEQ ID NO: 3399 - RNA, 20 nt, Artificial Sequence
  MKO10003399_A_Agk
  gRNA
gauauugcagacggauuaug

SEQ ID NO: 3400 - RNA, 20 nt, Artificial Sequence
  MKO10003400_A_Agk
  gRNA
cauuaccugagcuucuugac

SEQ ID NO: 3401 - RNA, 20 nt, Artificial Sequence
  MKO10003401_A_Agk
  gRNA
cauggaugugacuguuguca

SEQ ID NO: 3402 - RNA, 20 nt, Artificial Sequence
  MKO10003402_A_Agl
  gRNA
uuagcucuaacugaucggca

SEQ ID NO: 3403 - RNA, 20 nt, Artificial Sequence
  MKO10003403_A_Agl
  gRNA
uuugaacuacaguuccgauu

SEQ ID NO: 3404 - RNA, 20 nt, Artificial Sequence
  MKO10003404_A_Agl
  gRNA
ucgagaaaaguuccguuccu

SEQ ID NO: 3405 - RNA, 20 nt, Artificial Sequence
  MKO10003405_A_Agmau
  gRNA
uuuccgccgaaguguggaug

SEQ ID NO: 3406 - RNA, 20 nt, Artificial Sequence
  MKO10003406_A_Agmau
  gRNA
gauuuggacccugucgcauc

SEQ ID NO: 3407 - RNA, 20 nt, Artificial Sequence
  MKO10003407_A_Agmau
  gRNA
cgcggggcucaccccuaguc

SEQ ID NO: 3408 - RNA, 20 nt, Artificial Sequence
  MKO10003408_A_Agmo
  gRNA
cuacuacugguuccaccgca

SEQ ID NO: 3409 - RNA, 20 nt, Artificial Sequence
  MKO10003409_A_Agmo
  gRNA
gcaucauccaaacgaccuga

SEQ ID NO: 3410 - RNA, 20 nt, Artificial Sequence
  MKO10003410_A_Agmo
  gRNA
ucuugcagcaguauaguucc

SEQ ID NO: 3411 - RNA, 20 nt, Artificial Sequence
  MKO10003411_A_Ago1
  gRNA
gauugacguuuaccauuacg

SEQ ID NO: 3412 - RNA, 20 nt, Artificial Sequence
  MKO10003412_A_Ago1
  gRNA
uuucaggcaccccgccggcc

SEQ ID NO: 3413 - RNA, 20 nt, Artificial Sequence
  MKO10003413_A_Ago1
  gRNA
gaucgcaagccuguguauga

SEQ ID NO: 3414 - RNA, 20 nt, Artificial Sequence
  MKO10003414_A_Ago2
  gRNA
cguccccuucgagacgaucc

SEQ ID NO: 3415 - RNA, 20 nt, Artificial Sequence
  MKO10003415_A_Ago2
  gRNA
gugccgaaguccggccgagg

SEQ ID NO: 3416 - RNA, 20 nt, Artificial Sequence
  MKO10003416_A_Ago2
  gRNA
gugcaucguguaacgccugc

SEQ ID NO: 3417 - RNA, 20 nt, Artificial Sequence
  MKO10003417_A_Ago3
  gRNA
ccccguccaugccguugacg

SEQ ID NO: 3418 - RNA, 20 nt, Artificial Sequence
  MKO10003418_A_Ago3
  gRNA
gaccguagaccaguuuauga

SEQ ID NO: 3419 - RNA, 20 nt, Artificial Sequence
  MKO10003419_A_Ago3
  gRNA
gauuuagauguuacauuacc

SEQ ID NO: 3420 - RNA, 20 nt, Artificial Sequence
  MKO10003420_A_Ago4
  gRNA
aacggccucguagagucaac

SEQ ID NO: 3421 - RNA, 20 nt, Artificial Sequence
  MKO10003421_A_Ago4
  gRNA
gaucggcagccuggcuacga

SEQ ID NO: 3422 - RNA, 20 nt, Artificial Sequence
  MKO10003422_A_Ago4
  gRNA
cuuacccuaucccguccgau

SEQ ID NO: 3423 - RNA, 20 nt, Artificial Sequence
  MKO10003423_A_Agpau1
  gRNA
uggaaggcgccucguuugaa

SEQ ID NO: 3424 - RNA, 20 nt, Artificial Sequence
  MKO10003424_A_Agpau1
  gRNA
cgccaucagugucauguccg

SEQ ID NO: 3425 - RNA, 20 nt, Artificial Sequence
  MKO10003425_A_Agpau1
  gRNA
agcccauaguagcucacgcu

SEQ ID NO: 3426 - RNA, 20 nt, Artificial Sequence
  MKO10003426_A_Agpau2
  gRNA
cgaucugcacacagcgcuua

SEQ ID NO: 3427 - RNA, 20 nt, Artificial Sequence
  MKO10003427_A_Agpau2
  gRNA
guccgcugaccucaaagcga

SEQ ID NO: 3428 - RNA, 20 nt, Artificial Sequence
  MKO10003428_A_Agpau2
  gRNA
gaggguacacgcaacgacaa

SEQ ID NO: 3429 - RNA, 20 nt, Artificial Sequence
  MKO10003429_A_Agpau3
  gRNA
uucgagaucgacuuccuuug

SEQ ID NO: 3430 - RNA, 20 nt, Artificial Sequence
  MKO10003430_A_Agpau3
  gRNA
agcguguuccuucgcaguac

SEQ ID NO: 3431 - RNA, 20 nt, Artificial Sequence
  MKO10003431_A_Agpau3
  gRNA
gugcacucucuucaccgacc

SEQ ID NO: 3432 - RNA, 20 nt, Artificial Sequence
  MKO10003432_A_Agpau4
  gRNA
uaccaucuacaccgacccga

SEQ ID NO: 3433 - RNA, 20 nt, Artificial Sequence
  MKO10003433_A_Agpau4
  gRNA
aucacgcugacugcuacguu

SEQ ID NO: 3434 - RNA, 20 nt, Artificial Sequence
  MKO10003434_A_Agpau4
  gRNA
caccugcugccgcgcaccaa

SEQ ID NO: 3435 - RNA, 20 nt, Artificial Sequence
  MKO10003435_A_Agpau5
  gRNA
guacguagcgcacauguccu

SEQ ID NO: 3436 - RNA, 20 nt, Artificial Sequence
  MKO10003436_A_Agpau5
  gRNA
cuagcgaaucaucaaagcac

SEQ ID NO: 3437 - RNA, 20 nt, Artificial Sequence
  MKO10003437_A_Agpau5
  gRNA
gcauuauaccuuguucccuc

SEQ ID NO: 3438 - RNA, 20 nt, Artificial Sequence
  MKO10003438_A_Agpau6
  gRNA
uaagccgcaggcuuauguau

SEQ ID NO: 3439 - RNA, 20 nt, Artificial Sequence
  MKO10003439_A_Agpau6
  gRNA
aucaaagaaauucgucgaag

SEQ ID NO: 3440 - RNA, 20 nt, Artificial Sequence
  MKO10003440_A_Agpau6
  gRNA
ccuguugugguacguaauga

SEQ ID NO: 3441 - RNA, 20 nt, Artificial Sequence
  MKO10003441_A_Agpau9
  gRNA
gccacauuacgaauucagaa

SEQ ID NO: 3442 - RNA, 20 nt, Artificial Sequence
  MKO10003442_A_Agpau9
  gRNA
aucuguguucggucccuauc

SEQ ID NO: 3443 - RNA, 20 nt, Artificial Sequence
  MKO10003443_A_Agpau9
  gRNA
acuuucaguacaucagucca

SEQ ID NO: 3444 - RNA, 20 nt, Artificial Sequence
  MKO10003444_A_Agps
  gRNA
uaccuuagguacccacuuag

SEQ ID NO: 3445 - RNA, 20 nt, Artificial Sequence
  MKO10003445_A_Agps
  gRNA
cuuggccauacaacuauauc

SEQ ID NO: 3446 - RNA, 20 nt, Artificial Sequence
  MKO10003446_A_Agps
  gRNA
aggugcuucacuaggauuua

SEQ ID NO: 3447 - RNA, 20 nt, Artificial Sequence
  MKO10003447_A_Agr2
  gRNA
uuacagcaacagacccuuga

SEQ ID NO: 3448 - RNA, 20 nt, Artificial Sequence
  MKO10003448_A_Agr2
  gRNA
guuggggcgaucagcucauc

SEQ ID NO: 3449 - RNA, 20 nt, Artificial Sequence
  MKO10003449_A_Agr2
  gRNA
gacgaaugcccacacaguca

SEQ ID NO: 3450 - RNA, 20 nt, Artificial Sequence
  MKO10003450_A_Agr3
  gRNA
cguaccaacaaacaugaucc

SEQ ID NO: 3451 - RNA, 20 nt, Artificial Sequence
  MKO10003451_A_Agr3
  gRNA
acaagaacuugucaccugau

SEQ ID NO: 3452 - RNA, 20 nt, Artificial Sequence
  MKO10003452_A_Agr3
  gRNA
gucucuuucaugcucgcaaa

SEQ ID NO: 3453 - RNA, 20 nt, Artificial Sequence
  MKO10003453_A_Agrn
  gRNA
cgcauccgccuacuccgcca

SEQ ID NO: 3454 - RNA, 20 nt, Artificial Sequence
  MKO10003454_A_Agrn
  gRNA
uccgcaaagugauccgcaua

SEQ ID NO: 3455 - RNA, 20 nt, Artificial Sequence
  MKO10003455_A_Agrn
  gRNA
guaggcggaugcgccguugc

SEQ ID NO: 3456 - RNA, 20 nt, Artificial Sequence
  MKO10003456_A_Agrp
  gRNA
ucguggccguacccagcuug

SEQ ID NO: 3457 - RNA, 20 nt, Artificial Sequence
  MKO10003457_A_Agrp
  gRNA
uuggcuaggugcgacuacag

SEQ ID NO: 3458 - RNA, 20 nt, Artificial Sequence
  MKO10003458_A_Agrp
  gRNA
gccccaggucuaagucugaa

SEQ ID NO: 3459 - RNA, 20 nt, Artificial Sequence
  MKO10003459_A_Agupbp1
  gRNA
augacaaccaaagguucuac

SEQ ID NO: 3460 - RNA, 20 nt, Artificial Sequence
  MKO10003460_A_Agupbp1
  gRNA
ucccacaacccgagaacuau

SEQ ID NO: 3461 - RNA, 20 nt, Artificial Sequence
  MKO10003461_A_Agupbp1
  gRNA
ggaaguucuguugucaacau

SEQ ID NO: 3462 - RNA, 20 nt, Artificial Sequence
  MKO10003462_A_Agur1a
  gRNA
cuguaaaauugccgacaucg

SEQ ID NO: 3463 - RNA, 20 nt, Artificial Sequence
  MKO10003463_A_Agur1a
  gRNA
auaccgcuauggaauaccgc

SEQ ID NO: 3464 - RNA, 20 nt, Artificial Sequence
  MKO10003464_A_Agur1a
  gRNA
ucgccuccgccgcacgaugc

SEQ ID NO: 3465 - RNA, 20 nt, Artificial Sequence
  MKO10003465_A_Agur1b
  gRNA
uggcgaccagcauugugcgu

SEQ ID NO: 3466 - RNA, 20 nt, Artificial Sequence
  MKO10003466_A_Agur1b
  gRNA
ugauaacccugcaugcgacc

SEQ ID NO: 3467 - RNA, 20 nt, Artificial Sequence
  MKO10003467_A_Agur1b
  gRNA
ucgccuccgacgcacaaugc

SEQ ID NO: 3468 - RNA, 20 nt, Artificial Sequence
  MKO10003468_A_Agur2
  gRNA
gcuauuaaugauacccaucc

SEQ ID NO: 3469 - RNA, 20 nt, Artificial Sequence
  MKO10003469_A_Agur2
  gRNA
uuugauaaucucaacgcaac

SEQ ID NO: 3470 - RNA, 20 nt, Artificial Sequence
  MKO10003470_A_Agur2
  gRNA
gucagaaccauugaauacuu

SEQ ID NO: 3471 - RNA, 20 nt, Artificial Sequence
  MKO10003471_A_Agurap
  gRNA
uaccacaugcaccgugaacg

SEQ ID NO: 3472 - RNA, 20 nt, Artificial Sequence
  MKO10003472_A_Agurap
  gRNA
uucuacucgaguguugccac

SEQ ID NO: 3473 - RNA, 20 nt, Artificial Sequence
  MKO10003473_A_Agurap
  gRNA
cugaugaugagucaauuguc

SEQ ID NO: 3474 - RNA, 20 nt, Artificial Sequence
  MKO10003474_A_Agu
  gRNA
uccggaacgaccuccugacu

SEQ ID NO: 3475 - RNA, 20 nt, Artificial Sequence
  MKO10003475_A_Agu
  gRNA
cgcaaugaucgccaacuucg

SEQ ID NO: 3476 - RNA, 20 nt, Artificial Sequence
  MKO10003476_A_Agu
  gRNA
acaggcucgaacguugacuc

SEQ ID NO: 3477 - RNA, 20 nt, Artificial Sequence
  MKO10003477_A_Agxt2
  gRNA
caucaccauggccaggucgu

SEQ ID NO: 3478 - RNA, 20 nt, Artificial Sequence
  MKO10003478_A_Agxt2
  gRNA
uagcaaaggcuuccggaaau

SEQ ID NO: 3479 - RNA, 20 nt, Artificial Sequence
  MKO10003479_A_Agxt2
  gRNA
agacagaacuuguaugccac

SEQ ID NO: 3480 - RNA, 20 nt, Artificial Sequence
  MKO10003480_A_Agxt
  gRNA
cgccaguggaugacuccccg

SEQ ID NO: 3481 - RNA, 20 nt, Artificial Sequence
  MKO10003481_A_Agxt
  gRNA
gcagagauugcugaucgcau

SEQ ID NO: 3482 - RNA, 20 nt, Artificial Sequence
  MKO10003482_A_Agxt
  gRNA
ccgguuagaaaggagucccc

SEQ ID NO: 3483 - RNA, 20 nt, Artificial Sequence
  MKO10003483_A_Ahcuf1
  gRNA
uaaaugcuggguacucgcac

SEQ ID NO: 3484 - RNA, 20 nt, Artificial Sequence
  MKO10003484_A_Ahcuf1
  gRNA
cucccaaugggcuuacuaac

SEQ ID NO: 3485 - RNA, 20 nt, Artificial Sequence
  MKO10003485_A_Ahcuf1
  gRNA
gcauacugaccuaucuugug

SEQ ID NO: 3486 - RNA, 20 nt, Artificial Sequence
  MKO10003486_A_Ahcyl1
  gRNA
auugcugcugcccuucgagu

SEQ ID NO: 3487 - RNA, 20 nt, Artificial Sequence
  MKO10003487_A_Ahcyl1
  gRNA
agugggcuguacgcacauca

SEQ ID NO: 3488 - RNA, 20 nt, Artificial Sequence
  MKO10003488_A_Ahcyl1
  gRNA
cugaguugaauagauguugc

SEQ ID NO: 3489 - RNA, 20 nt, Artificial Sequence
  MKO10003489_A_Ahcyl2
  gRNA
caaagagcgacguccgauuu

SEQ ID NO: 3490 - RNA, 20 nt, Artificial Sequence
  MKO10003490_A_Ahcyl2
  gRNA
cugacgaugagacauccccc

SEQ ID NO: 3491 - RNA, 20 nt, Artificial Sequence
  MKO10003491_A_Ahcyl2
  gRNA
gugcguacaacccacaauuu

SEQ ID NO: 3492 - RNA, 20 nt, Artificial Sequence
  MKO10003492_A_Ahcy
  gRNA
ucccgcagcggacaucggac

SEQ ID NO: 3493 - RNA, 20 nt, Artificial Sequence
  MKO10003493_A_Ahcy
  gRNA
ugucaacgauucugucacca

SEQ ID NO: 3494 - RNA, 20 nt, Artificial Sequence
  MKO10003494_A_Ahcy
  gRNA
ugcgcaccugacagaagcug

SEQ ID NO: 3495 - RNA, 20 nt, Artificial Sequence
  MKO10003495_A_Ahdc1
  gRNA
agugcgccucaaggcguacu

SEQ ID NO: 3496 - RNA, 20 nt, Artificial Sequence
  MKO10003496_A_Ahdc1
  gRNA
cgggcaaagcguguuugccu

SEQ ID NO: 3497 - RNA, 20 nt, Artificial Sequence
  MKO10003497_A_Ahdc1
  gRNA
gggccgccgggguaguacuu

SEQ ID NO: 3498 - RNA, 20 nt, Artificial Sequence
  MKO10003498_A_Ahi1
  gRNA
gaugaacuaaccauccaucg

SEQ ID NO: 3499 - RNA, 20 nt, Artificial Sequence
  MKO10003499_A_Ahi1
  gRNA
ugguacggcagcguaagaaa

SEQ ID NO: 3500 - RNA, 20 nt, Artificial Sequence
  MKO10003500_A_Ahi1
  gRNA
ggggagcgcuccuuuaccuu

SEQ ID NO: 3501 - RNA, 20 nt, Artificial Sequence
  MKO10003501_A_Ahnak
  gRNA
ggccccuugacaccgauauc

SEQ ID NO: 3502 - RNA, 20 nt, Artificial Sequence
  MKO10003502_A_Ahnak
  gRNA
ggucccacugucguugcuag

SEQ ID NO: 3503 - RNA, 20 nt, Artificial Sequence
  MKO10003503_A_Ahnak
  gRNA
uuacuuaggggaccagauug

SEQ ID NO: 3504 - RNA, 20 nt, Artificial Sequence
  MKO10003504_A_Ahrr
  gRNA
cggucccggugccguuugga

SEQ ID NO: 3505 - RNA, 20 nt, Artificial Sequence
  MKO10003505_A_Ahrr
  gRNA
ggaccgccucaauacagagc

SEQ ID NO: 3506 - RNA, 20 nt, Artificial Sequence
  MKO10003506_A_Ahrr
  gRNA
gacccuccucaggugguguu

SEQ ID NO: 3507 - RNA, 20 nt, Artificial Sequence
  MKO10003507_A_Ahr
  gRNA
ugagcucauauacgcucuga

SEQ ID NO: 3508 - RNA, 20 nt, Artificial Sequence
  MKO10003508_A_Ahr
  gRNA
cggucucugugucgcuuaga

SEQ ID NO: 3509 - RNA, 20 nt, Artificial Sequence
  MKO10003509_A_Ahr
  gRNA
cuccacuauccaagauuacc

SEQ ID NO: 3510 - RNA, 20 nt, Artificial Sequence
  MKO10003510_A_Ahsa1
  gRNA
caccccgucuuccuucauua

SEQ ID NO: 3511 - RNA, 20 nt, Artificial Sequence
  MKO10003511_A_Ahsa1
  gRNA
uuugucugaugaaaauagcg

SEQ ID NO: 3512 - RNA, 20 nt, Artificial Sequence
  MKO10003512_A_Ahsa1
  gRNA
ugagccugacacaaaucucg

SEQ ID NO: 3513 - RNA, 20 nt, Artificial Sequence
  MKO10003513_A_Ahsa2
  gRNA
uacccgucuugagugccuuc

SEQ ID NO: 3514 - RNA, 20 nt, Artificial Sequence
  MKO10003514_A_Ahsa2
  gRNA
aaggaucucaugagaacgac

SEQ ID NO: 3515 - RNA, 20 nt, Artificial Sequence
  MKO10003515_A_Ahsa2
  gRNA
cagagcgggaugccaccauu

SEQ ID NO: 3516 - RNA, 20 nt, Artificial Sequence
  MKO10003516_A_Ahsg
  gRNA
uccguucaacgauaccaacg

SEQ ID NO: 3517 - RNA, 20 nt, Artificial Sequence
  MKO10003517_A_Ahsg
  gRNA
uccacagcggcccuucggag

SEQ ID NO: 3518 - RNA, 20 nt, Artificial Sequence
  MKO10003518_A_Ahsg
  gRNA
acguucguaaguugugccca

SEQ ID NO: 3519 - RNA, 20 nt, Artificial Sequence
  MKO10003519_A_Aicda
  gRNA
caagucaucgacuucguaca

SEQ ID NO: 3520 - RNA, 20 nt, Artificial Sequence
  MKO10003520_A_Aicda
  gRNA
gcgagaugcauuucguaugu

SEQ ID NO: 3521 - RNA, 20 nt, Artificial Sequence
  MKO10003521_A_Aicda
  gRNA
aaggaugcgccgaaguuguc

SEQ ID NO: 3522 - RNA, 20 nt, Artificial Sequence
  MKO10003522_A_Aida
  gRNA
auguucagccuauuccauua

SEQ ID NO: 3523 - RNA, 20 nt, Artificial Sequence
  MKO10003523_A_Aida
  gRNA
uaugaauaccuuaauggaau

SEQ ID NO: 3524 - RNA, 20 nt, Artificial Sequence
  MKO10003524_A_Aida
  gRNA
uacuugguucuagcuucuuc

SEQ ID NO: 3525 - RNA, 20 nt, Artificial Sequence
  MKO10003525_A_Aif1l
  gRNA
cccgcaggagggaaggcguu

SEQ ID NO: 3526 - RNA, 20 nt, Artificial Sequence
  MKO10003526_A_Aif1l
  gRNA
cugaauaaugaaggcgagau

SEQ ID NO: 3527 - RNA, 20 nt, Artificial Sequence
  MKO10003527_A_Aif1l
  gRNA
caaucucgccuucauuauuc

SEQ ID NO: 3528 - RNA, 20 nt, Artificial Sequence
  MKO10003528_A_Aif1
  gRNA
uauguccuugaagcgaaugc

SEQ ID NO: 3529 - RNA, 20 nt, Artificial Sequence
  MKO10003529_A_Aif1
  gRNA
agaguagcugaacgucuccu

SEQ ID NO: 3530 - RNA, 20 nt, Artificial Sequence
  MKO10003530_A_Aif1
  gRNA
acccuugaaggcuucaaguu

SEQ ID NO: 3531 - RNA, 20 nt, Artificial Sequence
  MKO10003531_A_Aifm1
  gRNA
aucccgagcccggauggauc

SEQ ID NO: 3532 - RNA, 20 nt, Artificial Sequence
  MKO10003532_A_Aifm1
  gRNA
ggucgcauguauggcaguuc

SEQ ID NO: 3533 - RNA, 20 nt, Artificial Sequence
  MKO10003533_A_Aifm1
  gRNA
uugcagcagccagauccauc

SEQ ID NO: 3534 - RNA, 20 nt, Artificial Sequence
  MKO10003534_A_Aifm2
  gRNA
ccagcgcucacaauucaucg

SEQ ID NO: 3535 - RNA, 20 nt, Artificial Sequence
  MKO10003535_A_Aifm2
  gRNA
ggauacaggagccgugcacg

SEQ ID NO: 3536 - RNA, 20 nt, Artificial Sequence
  MKO10003536_A_Aifm2
  gRNA
gcccacgaucaccacgugca

SEQ ID NO: 3537 - RNA, 20 nt, Artificial Sequence
  MKO10003537_A_Aifm3
  gRNA
uccucacuauggagcgcccc

SEQ ID NO: 3538 - RNA, 20 nt, Artificial Sequence
  MKO10003538_A_Aifm3
  gRNA
uaccugcuugcuugcccgaa

SEQ ID NO: 3539 - RNA, 20 nt, Artificial Sequence
  MKO10003539_A_Aifm3
  gRNA
aggggcagcgcacacguccc

SEQ ID NO: 3540 - RNA, 20 nt, Artificial Sequence
  MKO10003540_A_Aig1
  gRNA
agcucaucucucuccgggac

SEQ ID NO: 3541 - RNA, 20 nt, Artificial Sequence
  MKO10003541_A_Aig1
  gRNA
cgccauaugcaccuucuccg

SEQ ID NO: 3542 - RNA, 20 nt, Artificial Sequence
  MKO10003542_A_Aig1
  gRNA
cucauacucacaaccccgac

SEQ ID NO: 3543 - RNA, 20 nt, Artificial Sequence
  MKO10003543_A_Aim1l
  gRNA
gcguccauaagggugauccg

SEQ ID NO: 3544 - RNA, 20 nt, Artificial Sequence
  MKO10003544_A_Aim1l
  gRNA
ccagccucggaucacccuua

SEQ ID NO: 3545 - RNA, 20 nt, Artificial Sequence
  MKO10003545_A_Aim1l
  gRNA
ggagacuccacgcacacgcc

SEQ ID NO: 3546 - RNA, 20 nt, Artificial Sequence
  MKO10003546_A_Aim1
  gRNA
accccgacguccguaacaca

SEQ ID NO: 3547 - RNA, 20 nt, Artificial Sequence
  MKO10003547_A_Aim1
  gRNA
gcguccacgcucccaacauu

SEQ ID NO: 3548 - RNA, 20 nt, Artificial Sequence
  MKO10003548_A_Aim1
  gRNA
uuccaucagacacgugguuc

SEQ ID NO: 3549 - RNA, 20 nt, Artificial Sequence
  MKO10003549_A_Aim2
  gRNA
gcucucuuaacaacguuauu

SEQ ID NO: 3550 - RNA, 20 nt, Artificial Sequence
  MKO10003550_A_Aim2
  gRNA
agaagucuguccucaagcua

SEQ ID NO: 3551 - RNA, 20 nt, Artificial Sequence
  MKO10003551_A_Aim2
  gRNA
ucacuagccaccuuagcuug

SEQ ID NO: 3552 - RNA, 20 nt, Artificial Sequence
  MKO10003552_A_Aimp1
  gRNA
uccagacgcgaugcgucgau

SEQ ID NO: 3553 - RNA, 20 nt, Artificial Sequence
  MKO10003553_A_Aimp1
  gRNA
gccuaucgacgcaucgcguc

SEQ ID NO: 3554 - RNA, 20 nt, Artificial Sequence
  MKO10003554_A_Aimp1
  gRNA
gcaguacaguucgucugcag

SEQ ID NO: 3555 - RNA, 20 nt, Artificial Sequence
  MKO10003555_A_Aimp2
  gRNA
gucccgccacgaguaucagc

SEQ ID NO: 3556 - RNA, 20 nt, Artificial Sequence
  MKO10003556_A_Aimp2
  gRNA
cuuaagccaccgcugcacau

SEQ ID NO: 3557 - RNA, 20 nt, Artificial Sequence
  MKO10003557_A_Aimp2
  gRNA
ugaagcccagcugauacucg

SEQ ID NO: 3558 - RNA, 20 nt, Artificial Sequence
  MKO10003558_A_Aipl1
  gRNA
guggugucguagaaugucgc

SEQ ID NO: 3559 - RNA, 20 nt, Artificial Sequence
  MKO10003559_A_Aipl1
  gRNA
gaagugugaugacgagcgca

SEQ ID NO: 3560 - RNA, 20 nt, Artificial Sequence
  MKO10003560_A_Aipl1
  gRNA
gucucccucugguacucauu

SEQ ID NO: 3561 - RNA, 20 nt, Artificial Sequence
  MKO10003561_A_Aip
  gRNA
ggcgauggcgucauaguacu

SEQ ID NO: 3562 - RNA, 20 nt, Artificial Sequence
  MKO10003562_A_Aip
  gRNA
auagaugacagccgaacacg

SEQ ID NO: 3563 - RNA, 20 nt, Artificial Sequence
  MKO10003563_A_Aip
  gRNA
gagccuccgcaacaucgccg

SEQ ID NO: 3564 - RNA, 20 nt, Artificial Sequence
  MKO10003564_A_Aire
  gRNA
ggaucccuuccacggccccu

SEQ ID NO: 3565 - RNA, 20 nt, Artificial Sequence
  MKO10003565_A_Aire
  gRNA
gcaggagacgcuccgucuga

SEQ ID NO: 3566 - RNA, 20 nt, Artificial Sequence
  MKO10003566_A_Aire
  gRNA
ccgggacaguggggccaucc

SEQ ID NO: 3567 - RNA, 20 nt, Artificial Sequence
  MKO10003567_A_Ajap1
  gRNA
uucaacgauuucgacuuccg

SEQ ID NO: 3568 - RNA, 20 nt, Artificial Sequence
  MKO10003568_A_Ajap1
  gRNA
ggucgagugcagcgucucgu

SEQ ID NO: 3569 - RNA, 20 nt, Artificial Sequence
  MKO10003569_A_Ajap1
  gRNA
cccaacgaggcuaccgacac

SEQ ID NO: 3570 - RNA, 20 nt, Artificial Sequence
  MKO10003570_A_Ajuba
  gRNA
acuuguuacauacgaugcau

SEQ ID NO: 3571 - RNA, 20 nt, Artificial Sequence
  MKO10003571_A_Ajuba
  gRNA
caucguauguaacaagugcc

SEQ ID NO: 3572 - RNA, 20 nt, Artificial Sequence
  MKO10003572_A_Ajuba
  gRNA
ugcuucuaggacgaacuuug

SEQ ID NO: 3573 - RNA, 20 nt, Artificial Sequence
  MKO10003573_A_Ak1
  gRNA
ucuguacaaucuucucgcac

SEQ ID NO: 3574 - RNA, 20 nt, Artificial Sequence
  MKO10003574_A_Ak1
  gRNA
uggccgcguggaugacaacg

SEQ ID NO: 3575 - RNA, 20 nt, Artificial Sequence
  MKO10003575_A_Ak1
  gRNA
aucuccuucuaugacaagcg

SEQ ID NO: 3576 - RNA, 20 nt, Artificial Sequence
  MKO10003576_A_Ak2
  gRNA
gcccuucggaaucuccgguu

SEQ ID NO: 3577 - RNA, 20 nt, Artificial Sequence
  MKO10003577_A_Ak2
  gRNA
uuccgaaccggagauuccga

SEQ ID NO: 3578 - RNA, 20 nt, Artificial Sequence
  MKO10003578_A_Ak2
  gRNA
ggcuccacaggcacccaaac

SEQ ID NO: 3579 - RNA, 20 nt, Artificial Sequence
  MKO10003579_A_Ak3
  gRNA
aacagcgccuuacugcucgc

SEQ ID NO: 3580 - RNA, 20 nt, Artificial Sequence
  MKO10003580_A_Ak3
  gRNA
ucauccucgcgcugaaucag

SEQ ID NO: 3581 - RNA, 20 nt, Artificial Sequence
  MKO10003581_A_Ak3
  gRNA
aauguuguauacucgaccac

SEQ ID NO: 3582 - RNA, 20 nt, Artificial Sequence
  MKO10003582_A_Ak4
  gRNA
uuuaacagaaguuggugacg

SEQ ID NO: 3583 - RNA, 20 nt, Artificial Sequence
  MKO10003583_A_Ak4
  gRNA
auucccgaggacauuaguac

SEQ ID NO: 3584 - RNA, 20 nt, Artificial Sequence
  MKO10003584_A_Ak4
  gRNA
uuaaagaucgucugagccga

SEQ ID NO: 3585 - RNA, 20 nt, Artificial Sequence
  MKO10003585_A_Ak5
  gRNA
agccggucauaccgccgaua

SEQ ID NO: 3586 - RNA, 20 nt, Artificial Sequence
  MKO10003586_A_Ak5
  gRNA
ucagcuccgccgucuccgac

SEQ ID NO: 3587 - RNA, 20 nt, Artificial Sequence
  MKO10003587_A_Ak5
  gRNA
aagacguuaccgccccuaaa

SEQ ID NO: 3588 - RNA, 20 nt, Artificial Sequence
  MKO10003588_A_Ak6
  gRNA
cucccacguuaacguacuuc

SEQ ID NO: 3589 - RNA, 20 nt, Artificial Sequence
  MKO10003589_A_Ak6
  gRNA
gugacuucuuccccgaacgc

SEQ ID NO: 3590 - RNA, 20 nt, Artificial Sequence
  MKO10003590_A_Ak6
  gRNA
cuugcagggcaguuauacga

SEQ ID NO: 3591 - RNA, 20 nt, Artificial Sequence
  MKO10003591_A_Ak7
  gRNA
ucucccuuaggacgacaacg

SEQ ID NO: 3592 - RNA, 20 nt, Artificial Sequence
  MKO10003592_A_Ak7
  gRNA
uaagccuccacagcgaaguc

SEQ ID NO: 3593 - RNA, 20 nt, Artificial Sequence
  MKO10003593_A_Ak7
  gRNA
cagaagaggauuaucgaaga

SEQ ID NO: 3594 - RNA, 20 nt, Artificial Sequence
  MKO10003594_A_Ak8
  gRNA
cauuaucauuguuccugcgc

SEQ ID NO: 3595 - RNA, 20 nt, Artificial Sequence
  MKO10003595_A_Ak8
  gRNA
ucaugaucacucaccugcgc

SEQ ID NO: 3596 - RNA, 20 nt, Artificial Sequence
  MKO10003596_A_Ak8
  gRNA
ggaccuaauaucacaaccuu

SEQ ID NO: 3597 - RNA, 20 nt, Artificial Sequence
  MKO10003597_A_Akap10
  gRNA
ucagauucccaccgacuccc

SEQ ID NO: 3598 - RNA, 20 nt, Artificial Sequence
  MKO10003598_A_Akap10
  gRNA
acuucggagaauggagcacc

SEQ ID NO: 3599 - RNA, 20 nt, Artificial Sequence
  MKO10003599_A_Akap10
  gRNA
accgaugaugucguuucuca

SEQ ID NO: 3600 - RNA, 20 nt, Artificial Sequence
  MKO10003600_A_Akap11
  gRNA
gcuuacauuggacgauuuac

SEQ ID NO: 3601 - RNA, 20 nt, Artificial Sequence
  MKO10003601_A_Akap11
  gRNA
aagcaguaguccucuaaauc

SEQ ID NO: 3602 - RNA, 20 nt, Artificial Sequence
  MKO10003602_A_Akap11
  gRNA
gcggaugcgcgugcaugucc

SEQ ID NO: 3603 - RNA, 20 nt, Artificial Sequence
  MKO10003603_A_Akap12
  gRNA
gagcgacacgccgagcgagc

SEQ ID NO: 3604 - RNA, 20 nt, Artificial Sequence
  MKO10003604_A_Akap12
  gRNA
cgagaucgaaccaaguagag

SEQ ID NO: 3605 - RNA, 20 nt, Artificial Sequence
  MKO10003605_A_Akap12
  gRNA
aucaaugaccgcgacacuca

SEQ ID NO: 3606 - RNA, 20 nt, Artificial Sequence
  MKO10003606_A_Akap13
  gRNA
acacgguuccucgaucgauc

SEQ ID NO: 3607 - RNA, 20 nt, Artificial Sequence
  MKO10003607_A_Akap13
  gRNA
cugcaucauacgccucaucc

SEQ ID NO: 3608 - RNA, 20 nt, Artificial Sequence
  MKO10003608_A_Akap13
  gRNA
acguaucagaacugacuuuc

SEQ ID NO: 3609 - RNA, 20 nt, Artificial Sequence
  MKO10003609_A_Akap14
  gRNA
auuggcacugacucgugcca

SEQ ID NO: 3610 - RNA, 20 nt, Artificial Sequence
  MKO10003610_A_Akap14
  gRNA
aaauucgauuucgagaacag

SEQ ID NO: 3611 - RNA, 20 nt, Artificial Sequence
  MKO10003611_A_Akap14
  gRNA
caugggaguuucaaaaccgc

SEQ ID NO: 3612 - RNA, 20 nt, Artificial Sequence
  MKO10003612_A_Akap17b
  gRNA
uagaaugcucuagcccguuu

SEQ ID NO: 3613 - RNA, 20 nt, Artificial Sequence
  MKO10003613_A_Akap17b
  gRNA
ugccaucaaugccgccaaaa

SEQ ID NO: 3614 - RNA, 20 nt, Artificial Sequence
  MKO10003614_A_Akap17b
  gRNA
ggaggagcggaaguacuugc

SEQ ID NO: 3615 - RNA, 20 nt, Artificial Sequence
  MKO10003615_A_Akap1
  gRNA
cagugguggcgcauagauau

SEQ ID NO: 3616 - RNA, 20 nt, Artificial Sequence
  MKO10003616_A_Akap1
  gRNA
cacuuaguuggucgacugau

SEQ ID NO: 3617 - RNA, 20 nt, Artificial Sequence
  MKO10003617_A_Akap1
  gRNA
cgauagcccccagagugucc

SEQ ID NO: 3618 - RNA, 20 nt, Artificial Sequence
  MKO10003618_A_Akap2
  gRNA
uccguccguugaugaccccu

SEQ ID NO: 3619 - RNA, 20 nt, Artificial Sequence
  MKO10003619_A_Akap2
  gRNA
uggucgguggcuuguccgaa

SEQ ID NO: 3620 - RNA, 20 nt, Artificial Sequence
  MKO10003620_A_Akap2
  gRNA
cuuccuccgauuaacccgug

SEQ ID NO: 3621 - RNA, 20 nt, Artificial Sequence
  MKO10003621_A_Akap3
  gRNA
cuuggagcgugccgcaaaac

SEQ ID NO: 3622 - RNA, 20 nt, Artificial Sequence
  MKO10003622_A_Akap3
  gRNA
aauacuaccagauggcggau

SEQ ID NO: 3623 - RNA, 20 nt, Artificial Sequence
  MKO10003623_A_Akap3
  gRNA
gcagaaccuccccgacgcug

SEQ ID NO: 3624 - RNA, 20 nt, Artificial Sequence
  MKO10003624_A_Akap4
  gRNA
ggaggccaugcuaaagcguc

SEQ ID NO: 3625 - RNA, 20 nt, Artificial Sequence
  MKO10003625_A_Akap4
  gRNA
agugcacaauacgaaaaaug

SEQ ID NO: 3626 - RNA, 20 nt, Artificial Sequence
  MKO10003626_A_Akap4
  gRNA
agaugucugacgauauugac

SEQ ID NO: 3627 - RNA, 20 nt, Artificial Sequence
  MKO10003627_A_Akap5
  gRNA
cucuggucaacggcaaccag

SEQ ID NO: 3628 - RNA, 20 nt, Artificial Sequence
  MKO10003628_A_Akap5
  gRNA
aagaaacauacccccgaagc

SEQ ID NO: 3629 - RNA, 20 nt, Artificial Sequence
  MKO10003629_A_Akap5
  gRNA
gaaugugaucgccauagaac

SEQ ID NO: 3630 - RNA, 20 nt, Artificial Sequence
  MKO10003630_A_Akap6
  gRNA
uacgaugacauugaccgagu

SEQ ID NO: 3631 - RNA, 20 nt, Artificial Sequence
  MKO10003631_A_Akap6
  gRNA
cuggaggccuucgacugcgc

SEQ ID NO: 3632 - RNA, 20 nt, Artificial Sequence
  MKO10003632_A_Akap6
  gRNA
cccgagcucauccgaagcgu

SEQ ID NO: 3633 - RNA, 20 nt, Artificial Sequence
  MKO10003633_A_Akap7
  gRNA
uguccaaagcaccgaugcuc

SEQ ID NO: 3634 - RNA, 20 nt, Artificial Sequence
  MKO10003634_A_Akap7
  gRNA
uagcgguaccgaugcacuuu

SEQ ID NO: 3635 - RNA, 20 nt, Artificial Sequence
  MKO10003635_A_Akap7
  gRNA
agaccauguuagcgcacucc

SEQ ID NO: 3636 - RNA, 20 nt, Artificial Sequence
  MKO10003636_A_Akap8l
  gRNA
cgugaccaguuucgaaugcg

SEQ ID NO: 3637 - RNA, 20 nt, Artificial Sequence
  MKO10003637_A_Akap8l
  gRNA
aucggcacuggcgcuacccg

SEQ ID NO: 3638 - RNA, 20 nt, Artificial Sequence
  MKO10003638_A_Akap8l
  gRNA
cuuagauaugaugccgcacu

SEQ ID NO: 3639 - RNA, 20 nt, Artificial Sequence
  MKO10003639_A_Akap8
  gRNA
cccaaucccguauccgcguc

SEQ ID NO: 3640 - RNA, 20 nt, Artificial Sequence
  MKO10003640_A_Akap8
  gRNA
cuggcgucguaggacucgua

SEQ ID NO: 3641 - RNA, 20 nt, Artificial Sequence
  MKO10003641_A_Akap8
  gRNA
auaguuacggcccagccuca

SEQ ID NO: 3642 - RNA, 20 nt, Artificial Sequence
  MKO10003642_A_Akap9
  gRNA
gaugccgucucgcuguuuaa

SEQ ID NO: 3643 - RNA, 20 nt, Artificial Sequence
  MKO10003643_A_Akap9
  gRNA
gccgccauuaaacagcgaga

SEQ ID NO: 3644 - RNA, 20 nt, Artificial Sequence
  MKO10003644_A_Akap9
  gRNA
gcgcaccugcuucagcccuu

SEQ ID NO: 3645 - RNA, 20 nt, Artificial Sequence
  MKO10003645_A_Akip1
  gRNA
cuggguagacuucgauguag

SEQ ID NO: 3646 - RNA, 20 nt, Artificial Sequence
  MKO10003646_A_Akip1
  gRNA
ugcaaccacgugcgucuucu

SEQ ID NO: 3647 - RNA, 20 nt, Artificial Sequence
  MKO10003647_A_Akip1
  gRNA
gaauucagccauugcuccga

SEQ ID NO: 3648 - RNA, 20 nt, Artificial Sequence
  MKO10003648_A_Akirin1
  gRNA
ccucagccuaccugcgaguu

SEQ ID NO: 3649 - RNA, 20 nt, Artificial Sequence
  MKO10003649_A_Akirin1
  gRNA
auccucaguaccaaacucgc

SEQ ID NO: 3650 - RNA, 20 nt, Artificial Sequence
  MKO10003650_A_Akirin1
  gRNA
gucugcuuaccuggagaacc

SEQ ID NO: 3651 - RNA, 20 nt, Artificial Sequence
  MKO10003651_A_Akirin2
  gRNA
ugugaaucggaaguacaacc

SEQ ID NO: 3652 - RNA, 20 nt, Artificial Sequence
  MKO10003652_A_Akirin2
  gRNA
ggguuauuaccuggugaugc

SEQ ID NO: 3653 - RNA, 20 nt, Artificial Sequence
  MKO10003653_A_Akirin2
  gRNA
aacagcccuuauuuacucua

SEQ ID NO: 3654 - RNA, 20 nt, Artificial Sequence
  MKO10003654_A_Aknad1
  gRNA
ccauuugcaagacauaagac

SEQ ID NO: 3655 - RNA, 20 nt, Artificial Sequence
  MKO10003655_A_Aknad1
  gRNA
uacuaccugugagagguucu

SEQ ID NO: 3656 - RNA, 20 nt, Artificial Sequence
  MKO10003656_A_Aknad1
  gRNA
gacugaccaacugaagaaua

SEQ ID NO: 3657 - RNA, 20 nt, Artificial Sequence
  MKO10003657_A_Akna
  gRNA
acuaucgaccaacuucgccu

SEQ ID NO: 3658 - RNA, 20 nt, Artificial Sequence
  MKO10003658_A_Akna
  gRNA
uugccccaagccgaguacuc

SEQ ID NO: 3659 - RNA, 20 nt, Artificial Sequence
  MKO10003659_A_Akna
  gRNA
aguggccacgccgggggacg

SEQ ID NO: 3660 - RNA, 20 nt, Artificial Sequence
  MKO10003660_A_Akp3
  gRNA
guugcacuggucgaaucucg

SEQ ID NO: 3661 - RNA, 20 nt, Artificial Sequence
  MKO10003661_A_Akp3
  gRNA
gcaaccuucccgcagcgcag

SEQ ID NO: 3662 - RNA, 20 nt, Artificial Sequence
  MKO10003662_A_Akp3
  gRNA
ccgucuucaggaaaauccgu

SEQ ID NO: 3663 - RNA, 20 nt, Artificial Sequence
  MKO10003663_A_Akr1a1
  gRNA
auggcgccaagcacggucag

SEQ ID NO: 3664 - RNA, 20 nt, Artificial Sequence
  MKO10003664_A_Akr1a1
  gRNA
auuaaacaugcccuuagcgc

SEQ ID NO: 3665 - RNA, 20 nt, Artificial Sequence
  MKO10003665_A_Akr1a1
  gRNA
uggaccucuauuugaugcac

SEQ ID NO: 3666 - RNA, 20 nt, Artificial Sequence
  MKO10003666_A_Akr1b10
  gRNA
cagcaguaaauauacguucu

SEQ ID NO: 3667 - RNA, 20 nt, Artificial Sequence
  MKO10003667_A_Akr1b10
  gRNA
gcucucauucugauagacau

SEQ ID NO: 3668 - RNA, 20 nt, Artificial Sequence
  MKO10003668_A_Akr1b10
  gRNA
guaccuugcugacgaugaag

SEQ ID NO: 3669 - RNA, 20 nt, Artificial Sequence
  MKO10003669_A_Akr1b3
  gRNA
acgcuuaccugguucaccgc

SEQ ID NO: 3670 - RNA, 20 nt, Artificial Sequence
  MKO10003670_A_Akr1b3
  gRNA
ccccucaccuugaaccccgu

SEQ ID NO: 3671 - RNA, 20 nt, Artificial Sequence
  MKO10003671_A_Akr1b3
  gRNA
uuaggcuauggaacaacuag

SEQ ID NO: 3672 - RNA, 20 nt, Artificial Sequence
  MKO10003672_A_Akr1b7
  gRNA
ggacuaucuggaccuguauc

SEQ ID NO: 3673 - RNA, 20 nt, Artificial Sequence
  MKO10003673_A_Akr1b7
  gRNA
ccuucacggcuuccuugacu

SEQ ID NO: 3674 - RNA, 20 nt, Artificial Sequence
  MKO10003674_A_Akr1b7
  gRNA
auucucauugugauacacau

SEQ ID NO: 3675 - RNA, 20 nt, Artificial Sequence
  MKO10003675_A_Akr1b8
  gRNA
caccucauucucguugcaau

SEQ ID NO: 3676 - RNA, 20 nt, Artificial Sequence
  MKO10003676_A_Akr1b8
  gRNA
ugccuauugcaacgagaaug

SEQ ID NO: 3677 - RNA, 20 nt, Artificial Sequence
  MKO10003677_A_Akr1b8
  gRNA
caccaguaagacaacauucu

SEQ ID NO: 3678 - RNA, 20 nt, Artificial Sequence
  MKO10003678_A_Akr1c12
  gRNA
cgguugcuuucgaccagagc

SEQ ID NO: 3679 - RNA, 20 nt, Artificial Sequence
  MKO10003679_A_Akr1c12
  gRNA
aauuucccguucucaucuaa

SEQ ID NO: 3680 - RNA, 20 nt, Artificial Sequence
  MKO10003680_A_Akr1c12
  gRNA
gaucaacauaauccagcuga

SEQ ID NO: 3681 - RNA, 20 nt, Artificial Sequence
  MKO10003681_A_Akr1c13
  gRNA
ucacguaccuucauuggcac

SEQ ID NO: 3682 - RNA, 20 nt, Artificial Sequence
  MKO10003682_A_Akr1c13
  gRNA
cacuugcuuucgaccagagc

SEQ ID NO: 3683 - RNA, 20 nt, Artificial Sequence
  MKO10003683_A_Akr1c13
  gRNA
acuucaguccuggcuuauug

SEQ ID NO: 3684 - RNA, 20 nt, Artificial Sequence
  MKO10003684_A_Akr1c14
  gRNA
cuauuuccacgagacgaaca

SEQ ID NO: 3685 - RNA, 20 nt, Artificial Sequence
  MKO10003685_A_Akr1c14
  gRNA
gagugucgaacuuuaacuuc

SEQ ID NO: 3686 - RNA, 20 nt, Artificial Sequence
  MKO10003686_A_Akr1c14
  gRNA
guuaaaguucgacacuccga

SEQ ID NO: 3687 - RNA, 20 nt, Artificial Sequence
  MKO10003687_A_Akr1c18
  gRNA
aagcugggucugaccaacuc

SEQ ID NO: 3688 - RNA, 20 nt, Artificial Sequence
  MKO10003688_A_Akr1c18
  gRNA
aacuucccaucguccagagu

SEQ ID NO: 3689 - RNA, 20 nt, Artificial Sequence
  MKO10003689_A_Akr1c18
  gRNA
uaacuuuaaccguagacaac

SEQ ID NO: 3690 - RNA, 20 nt, Artificial Sequence
  MKO10003690_A_Akr1c19
  gRNA
agagcugguucgcucuaacu

SEQ ID NO: 3691 - RNA, 20 nt, Artificial Sequence
  MKO10003691_A_Akr1c19
  gRNA
aaguuagagcgaaccagcuc

SEQ ID NO: 3692 - RNA, 20 nt, Artificial Sequence
  MKO10003692_A_Akr1c19
  gRNA
cagcugccugcuauuaaagu

SEQ ID NO: 3693 - RNA, 20 nt, Artificial Sequence
  MKO10003693_A_Akr1c20
  gRNA
aacauuucaucguccagaac

SEQ ID NO: 3694 - RNA, 20 nt, Artificial Sequence
  MKO10003694_A_Akr1c20
  gRNA
acuugagccccggcuuacuc

SEQ ID NO: 3695 - RNA, 20 nt, Artificial Sequence
  MKO10003695_A_Akr1c20
  gRNA
aagcauaccugcaccaguuc

SEQ ID NO: 3696 - RNA, 20 nt, Artificial Sequence
  MKO10003696_A_Akr1c21
  gRNA
aaaacuucaguucgacuaug

SEQ ID NO: 3697 - RNA, 20 nt, Artificial Sequence
  MKO10003697_A_Akr1c21
  gRNA
gugucccaagaguaaagcua

SEQ ID NO: 3698 - RNA, 20 nt, Artificial Sequence
  MKO10003698_A_Akr1c21
  gRNA
caacauacuuucagggccau

SEQ ID NO: 3699 - RNA, 20 nt, Artificial Sequence
  MKO10003699_A_Akr1c6
  gRNA
uucaucguccagaacucgua

SEQ ID NO: 3700 - RNA, 20 nt, Artificial Sequence
  MKO10003700_A_Akr1c6
  gRNA
aagcagacccguacgaguuc

SEQ ID NO: 3701 - RNA, 20 nt, Artificial Sequence
  MKO10003701_A_Akr1c6
  gRNA
auccgaagcaagauagcaga

SEQ ID NO: 3702 - RNA, 20 nt, Artificial Sequence
  MKO10003702_A_Akr1cl
  gRNA
agggcuggccauccgaagca

SEQ ID NO: 3703 - RNA, 20 nt, Artificial Sequence
  MKO10003703_A_Akr1cl
  gRNA
ugccaucagcaaccuugcuu

SEQ ID NO: 3704 - RNA, 20 nt, Artificial Sequence
  MKO10003704_A_Akr1cl
  gRNA
uugcuuaccuucauggacac

SEQ ID NO: 3705 - RNA, 20 nt, Artificial Sequence
  MKO10003705_A_Akr1d1
  gRNA
cauaggcgccaucaaugugc

SEQ ID NO: 3706 - RNA, 20 nt, Artificial Sequence
  MKO10003706_A_Akr1d1
  gRNA
agcccuggaaaggacgcuaa

SEQ ID NO: 3707 - RNA, 20 nt, Artificial Sequence
  MKO10003707_A_Akr1d1
  gRNA
caccgacuucaugcucauug

SEQ ID NO: 3708 - RNA, 20 nt, Artificial Sequence
  MKO10003708_A_Akr1e1
  gRNA
accuugccauugcgauccaa

SEQ ID NO: 3709 - RNA, 20 nt, Artificial Sequence
  MKO10003709_A_Akr1e1
  gRNA
cuuauaccacaaugagagcg

SEQ ID NO: 3710 - RNA, 20 nt, Artificial Sequence
  MKO10003710_A_Akr1e1
  gRNA
agcccuaaacuuggauuacc

SEQ ID NO: 3711 - RNA, 20 nt, Artificial Sequence
  MKO10003711_A_Akr7a5
  gRNA
gcuucagagacgucucuaac

SEQ ID NO: 3712 - RNA, 20 nt, Artificial Sequence
  MKO10003712_A_Akr7a5
  gRNA
caacccgugggccgcuucuu

SEQ ID NO: 3713 - RNA, 20 nt, Artificial Sequence
  MKO10003713_A_Akr7a5
  gRNA
gcauguacaacgccaccacc

SEQ ID NO: 3714 - RNA, 20 nt, Artificial Sequence
  MKO10003714_A_Akt1s1
  gRNA
uauucggucuaggucgggcg

SEQ ID NO: 3715 - RNA, 20 nt, Artificial Sequence
  MKO10003715_A_Akt1s1
  gRNA
gcccgaccuagaccgaauag

SEQ ID NO: 3716 - RNA, 20 nt, Artificial Sequence
  MKO10003716_A_Akt1s1
  gRNA
ugugcgccugugcgaugucg

SEQ ID NO: 3717 - RNA, 20 nt, Artificial Sequence
  MKO10003717_A_Akt1
  gRNA
cgacgaugaccuccuucuug

SEQ ID NO: 3718 - RNA, 20 nt, Artificial Sequence
  MKO10003718_A_Akt1
  gRNA
uacuuccuccucaagaacga

SEQ ID NO: 3719 - RNA, 20 nt, Artificial Sequence
  MKO10003719_A_Akt1
  gRNA
cauugagcgcaccuuccaug

SEQ ID NO: 3720 - RNA, 20 nt, Artificial Sequence
  MKO10003720_A_Akt2
  gRNA
caggugaauacaucaagacc

SEQ ID NO: 3721 - RNA, 20 nt, Artificial Sequence
  MKO10003721_A_Akt2
  gRNA
caccuucggcaaggucauuc

SEQ ID NO: 3722 - RNA, 20 nt, Artificial Sequence
  MKO10003722_A_Akt2
  gRNA
cugcuacagagaaauuguuc

SEQ ID NO: 3723 - RNA, 20 nt, Artificial Sequence
  MKO10003723_A_Akt3
  gRNA
ccguagccgaccgauugcag

SEQ ID NO: 3724 - RNA, 20 nt, Artificial Sequence
  MKO10003724_A_Akt3
  gRNA
uccuauauuaucaaucugug

SEQ ID NO: 3725 - RNA, 20 nt, Artificial Sequence
  MKO10003725_A_Akt3
  gRNA
augagccaucugucuucaaa

SEQ ID NO: 3726 - RNA, 20 nt, Artificial Sequence
  MKO10003726_A_Aktip
  gRNA
ccguuuguugacugcgcugc

SEQ ID NO: 3727 - RNA, 20 nt, Artificial Sequence
  MKO10003727_A_Aktip
  gRNA
cuuaccggacagucgccauc

SEQ ID NO: 3728 - RNA, 20 nt, Artificial Sequence
  MKO10003728_A_Aktip
  gRNA
ugaaaagagcguucgcaaag

SEQ ID NO: 3729 - RNA, 20 nt, Artificial Sequence
  MKO10003729_A_Alad
  gRNA
ggggcacaagcagacgucac

SEQ ID NO: 3730 - RNA, 20 nt, Artificial Sequence
  MKO10003730_A_Alad
  gRNA
ccaccucugccaaccgcugu

SEQ ID NO: 3731 - RNA, 20 nt, Artificial Sequence
  MKO10003731_A_Alad
  gRNA
gcgauaggcuggacaucauc

SEQ ID NO: 3732 - RNA, 20 nt, Artificial Sequence
  MKO10003732_A_Alas1
  gRNA
agagcgccgcaucuuugccg

SEQ ID NO: 3733 - RNA, 20 nt, Artificial Sequence
  MKO10003733_A_Alas1
  gRNA
uccguguagucauccgccau

SEQ ID NO: 3734 - RNA, 20 nt, Artificial Sequence
  MKO10003734_A_Alas1
  gRNA
aaguucuucagcagucggcu

SEQ ID NO: 3735 - RNA, 20 nt, Artificial Sequence
  MKO10003735_A_Alas2
  gRNA
ggcagcguccaauacuaaau

SEQ ID NO: 3736 - RNA, 20 nt, Artificial Sequence
  MKO10003736_A_Alas2
  gRNA
ucuauggccugcaagacacg

SEQ ID NO: 3737 - RNA, 20 nt, Artificial Sequence
  MKO10003737_A_Alas2
  gRNA
uguucaagacugugaaucgu

SEQ ID NO: 3738 - RNA, 20 nt, Artificial Sequence
  MKO10003738_A_Alb
  gRNA
gcucaucguaugagcauuuc

SEQ ID NO: 3739 - RNA, 20 nt, Artificial Sequence
  MKO10003739_A_Alb
  gRNA
acaagagugagaucgcccau

SEQ ID NO: 3740 - RNA, 20 nt, Artificial Sequence
  MKO10003740_A_Alb
  gRNA
cucccaaaucauuauaccga

SEQ ID NO: 3741 - RNA, 20 nt, Artificial Sequence
  MKO10003741_A_Alcam
  gRNA
ugagguacaucgagacggca

SEQ ID NO: 3742 - RNA, 20 nt, Artificial Sequence
  MKO10003742_A_Alcam
  gRNA
ugaagcaccuacccuaguca

SEQ ID NO: 3743 - RNA, 20 nt, Artificial Sequence
  MKO10003743_A_Alcam
  gRNA
gacuuucaggaaaagcccga

SEQ ID NO: 3744 - RNA, 20 nt, Artificial Sequence
  MKO10003744_A_Aldh16a1
  gRNA
gcuguucgagagguucgaga

SEQ ID NO: 3745 - RNA, 20 nt, Artificial Sequence
  MKO10003745_A_Aldh16a1
  gRNA
ggacacccacaaccgccucu

SEQ ID NO: 3746 - RNA, 20 nt, Artificial Sequence
  MKO10003746_A_Aldh16a1
  gRNA
agucugccagugcgucaccc

SEQ ID NO: 3747 - RNA, 20 nt, Artificial Sequence
  MKO10003747_A_Aldh18a1
  gRNA
gcgcaggcgcuguuugccga

SEQ ID NO: 3748 - RNA, 20 nt, Artificial Sequence
  MKO10003748_A_Aldh18a1
  gRNA
acgaacaugucuaauagcug

SEQ ID NO: 3749 - RNA, 20 nt, Artificial Sequence
  MKO10003749_A_Aldh18a1
  gRNA
gccgcacgcucugagacaga

SEQ ID NO: 3750 - RNA, 20 nt, Artificial Sequence
  MKO10003750_A_Aldh1a1
  gRNA
uaaauccgacaaguaugcau

SEQ ID NO: 3751 - RNA, 20 nt, Artificial Sequence
  MKO10003751_A_Aldh1a1
  gRNA
aaagcauuaaaguacugugc

SEQ ID NO: 3752 - RNA, 20 nt, Artificial Sequence
  MKO10003752_A_Aldh1a1
  gRNA
gagaacuuacggggaugauu

SEQ ID NO: 3753 - RNA, 20 nt, Artificial Sequence
  MKO10003753_A_Aldh1a2
  gRNA
cacggaaugaccauuccugu

SEQ ID NO: 3754 - RNA, 20 nt, Artificial Sequence
  MKO10003754_A_Aldh1a2
  gRNA
aggauggaugcgucugaaag

SEQ ID NO: 3755 - RNA, 20 nt, Artificial Sequence
  MKO10003755_A_Aldh1a2
  gRNA
uucacaagacacgagcccau

SEQ ID NO: 3756 - RNA, 20 nt, Artificial Sequence
  MKO10003756_A_Aldh1a3
  gRNA
uacuuacagccaggaucgcu

SEQ ID NO: 3757 - RNA, 20 nt, Artificial Sequence
  MKO10003757_A_Aldh1a3
  gRNA
aauggccccacacaccccga

SEQ ID NO: 3758 - RNA, 20 nt, Artificial Sequence
  MKO10003758_A_Aldh1a3
  gRNA
ccacggggauccccgcugga

SEQ ID NO: 3759 - RNA, 20 nt, Artificial Sequence
  MKO10003759_A_Aldh1a7
  gRNA
aaagcauuacaguacuucgc

SEQ ID NO: 3760 - RNA, 20 nt, Artificial Sequence
  MKO10003760_A_Aldh1a7
  gRNA
acaauggaaucgaugaaugc

SEQ ID NO: 3761 - RNA, 20 nt, Artificial Sequence
  MKO10003761_A_Aldh1a7
  gRNA
uguccuuaacccugcaacug

SEQ ID NO: 3762 - RNA, 20 nt, Artificial Sequence
  MKO10003762_A_Aldh1b1
  gRNA
agcccgagaagccuuccgcc

SEQ ID NO: 3763 - RNA, 20 nt, Artificial Sequence
  MKO10003763_A_Aldh1b1
  gRNA
cuucacccgacaugagccag

SEQ ID NO: 3764 - RNA, 20 nt, Artificial Sequence
  MKO10003764_A_Aldh1b1
  gRNA
uguaccguuacuucgcuggc

SEQ ID NO: 3765 - RNA, 20 nt, Artificial Sequence
  MKO10003765_A_Aldh1l1
  gRNA
gucaucaaugccccccggca

SEQ ID NO: 3766 - RNA, 20 nt, Artificial Sequence
  MKO10003766_A_Aldh1l1
  gRNA
uguccucgagcccgccaccg

SEQ ID NO: 3767 - RNA, 20 nt, Artificial Sequence
  MKO10003767_A_Aldh1l1
  gRNA
gcugaugacggucuggacac

SEQ ID NO: 3768 - RNA, 20 nt, Artificial Sequence
  MKO10003768_A_Aldh1l2
  gRNA
ugagcucggcucccaccgac

SEQ ID NO: 3769 - RNA, 20 nt, Artificial Sequence
  MKO10003769_A_Aldh1l2
  gRNA
gccguccaacucauagcuga

SEQ ID NO: 3770 - RNA, 20 nt, Artificial Sequence
  MKO10003770_A_Aldh1l2
  gRNA
uauagacuuccuguccgaac

SEQ ID NO: 3771 - RNA, 20 nt, Artificial Sequence
  MKO10003771_A_Aldh2
  gRNA
acgggaccggaccuaccuag

SEQ ID NO: 3772 - RNA, 20 nt, Artificial Sequence
  MKO10003772_A_Aldh2
  gRNA
gcugaagaagucgccgucga

SEQ ID NO: 3773 - RNA, 20 nt, Artificial Sequence
  MKO10003773_A_Aldh2
  gRNA
gccuuaugucaucucguacc

SEQ ID NO: 3774 - RNA, 20 nt, Artificial Sequence
  MKO10003774_A_Aldh3a1
  gRNA
ugaauggaccuccuacuacg

SEQ ID NO: 3775 - RNA, 20 nt, Artificial Sequence
  MKO10003775_A_Aldh3a1
  gRNA
cgaaaucgauuucacgauua

SEQ ID NO: 3776 - RNA, 20 nt, Artificial Sequence
  MKO10003776_A_Aldh3a1
  gRNA
gggacacccccuuugaucac

SEQ ID NO: 3777 - RNA, 20 nt, Artificial Sequence
  MKO10003777_A_Aldh3a2
  gRNA
cgccauuaacaaucgcauac

SEQ ID NO: 3778 - RNA, 20 nt, Artificial Sequence
  MKO10003778_A_Aldh3a2
  gRNA
cguucuuaccaugcaaccgc

SEQ ID NO: 3779 - RNA, 20 nt, Artificial Sequence
  MKO10003779_A_Aldh3a2
  gRNA
gaccuguaugcgauuguuaa

SEQ ID NO: 3780 - RNA, 20 nt, Artificial Sequence
  MKO10003780_A_Aldh3b1
  gRNA
uaaccugacacucgugccgc

SEQ ID NO: 3781 - RNA, 20 nt, Artificial Sequence
  MKO10003781_A_Aldh3b1
  gRNA
ccaccagcggcacgaguguc

SEQ ID NO: 3782 - RNA, 20 nt, Artificial Sequence
  MKO10003782_A_Aldh3b1
  gRNA
cauccuucauccaagaccgc

SEQ ID NO: 3783 - RNA, 20 nt, Artificial Sequence
  MKO10003783_A_Aldh3b2
  gRNA
gguccaccucauucucgcac

SEQ ID NO: 3784 - RNA, 20 nt, Artificial Sequence
  MKO10003784_A_Aldh3b2
  gRNA
ccuucaaugcagggcggacu

SEQ ID NO: 3785 - RNA, 20 nt, Artificial Sequence
  MKO10003785_A_Aldh3b2
  gRNA
ugugcaguccgaaacucagu

SEQ ID NO: 3786 - RNA, 20 nt, Artificial Sequence
  MKO10003786_A_Aldh4a1
  gRNA
cgacaacugguacuguauau

SEQ ID NO: 3787 - RNA, 20 nt, Artificial Sequence
  MKO10003787_A_Aldh4a1
  gRNA
uggcaaggacuuccgcccuu

SEQ ID NO: 3788 - RNA, 20 nt, Artificial Sequence
  MKO10003788_A_Aldh4a1
  gRNA
cuccucguccccgacaacgc

SEQ ID NO: 3789 - RNA, 20 nt, Artificial Sequence
  MKO10003789_A_Aldh5a1
  gRNA
uuuccgggugaucaucgcac

SEQ ID NO: 3790 - RNA, 20 nt, Artificial Sequence
  MKO10003790_A_Aldh5a1
  gRNA
gguccuguguaccgauccau

SEQ ID NO: 3791 - RNA, 20 nt, Artificial Sequence
  MKO10003791_A_Aldh5a1
  gRNA
ggagcuuacuacuccguaaa

SEQ ID NO: 3792 - RNA, 20 nt, Artificial Sequence
  MKO10003792_A_Aldh6a1
  gRNA
gcaaacgugcuuucccugcg

SEQ ID NO: 3793 - RNA, 20 nt, Artificial Sequence
  MKO10003793_A_Aldh6a1
  gRNA
ugcguccaucucagcuuugg

SEQ ID NO: 3794 - RNA, 20 nt, Artificial Sequence
  MKO10003794_A_Aldh6a1
  gRNA
uuguuccagugugauuaacc

SEQ ID NO: 3795 - RNA, 20 nt, Artificial Sequence
  MKO10003795_A_Aldh7a1
  gRNA
cugacuauuucuccgcguuu

SEQ ID NO: 3796 - RNA, 20 nt, Artificial Sequence
  MKO10003796_A_Aldh7a1
  gRNA
acacgcccucguuauccucg

SEQ ID NO: 3797 - RNA, 20 nt, Artificial Sequence
  MKO10003797_A_Aldh7a1
  gRNA
accugucggacucuugcuau

SEQ ID NO: 3798 - RNA, 20 nt, Artificial Sequence
  MKO10003798_A_Aldh8a1
  gRNA
ucugugugcacuccgauacg

SEQ ID NO: 3799 - RNA, 20 nt, Artificial Sequence
  MKO10003799_A_Aldh8a1
  gRNA
cuccaaccugcaccacguau

SEQ ID NO: 3800 - RNA, 20 nt, Artificial Sequence
  MKO10003800_A_Aldh8a1
  gRNA
uugccgggauacacuccucc

SEQ ID NO: 3801 - RNA, 20 nt, Artificial Sequence
  MKO10003801_A_Aldh9a1
  gRNA
caccaaagcgggugcgccuc

SEQ ID NO: 3802 - RNA, 20 nt, Artificial Sequence
  MKO10003802_A_Aldh9a1
  gRNA
uucuccugaacacgcgaaag

SEQ ID NO: 3803 - RNA, 20 nt, Artificial Sequence
  MKO10003803_A_Aldh9a1
  gRNA
uacacccgaagagagccgcu

SEQ ID NO: 3804 - RNA, 20 nt, Artificial Sequence
  MKO10003804_A_Aldoart1
  gRNA
gcgauugcccaugcuuccaa

SEQ ID NO: 3805 - RNA, 20 nt, Artificial Sequence
  MKO10003805_A_Aldoart1
  gRNA
guggcuccagucuugccacu

SEQ ID NO: 3806 - RNA, 20 nt, Artificial Sequence
  MKO10003806_A_Aldoart1
  gRNA
guaugggcagggcauaguuc

SEQ ID NO: 3807 - RNA, 20 nt, Artificial Sequence
  MKO10003807_A_Aldoart2
  gRNA
cuugccaccccucacgacuu

SEQ ID NO: 3808 - RNA, 20 nt, Artificial Sequence
  MKO10003808_A_Aldoart2
  gRNA
uaccacacaccaaagucgug

SEQ ID NO: 3809 - RNA, 20 nt, Artificial Sequence
  MKO10003809_A_Aldoart2
  gRNA
ccuugaaaauucgaacuguu

SEQ ID NO: 3810 - RNA, 20 nt, Artificial Sequence
  MKO10003810_A_Aldoa
  gRNA
ugacaucgcucaccgcauug

SEQ ID NO: 3811 - RNA, 20 nt, Artificial Sequence
  MKO10003811_A_Aldoa
  gRNA
caauggcgagacaacuaccc

SEQ ID NO: 3812 - RNA, 20 nt, Artificial Sequence
  MKO10003812_A_Aldoa
  gRNA
cuggcagguagauaagggug

SEQ ID NO: 3813 - RNA, 20 nt, Artificial Sequence
  MKO10003813_A_Aldob
  gRNA
ggaucacuccgccgaugcuc

SEQ ID NO: 3814 - RNA, 20 nt, Artificial Sequence
  MKO10003814_A_Aldob
  gRNA
ggucccuauuguugagccag

SEQ ID NO: 3815 - RNA, 20 nt, Artificial Sequence
  MKO10003815_A_Aldob
  gRNA
ccaugggaaaccgccugcaa

SEQ ID NO: 3816 - RNA, 20 nt, Artificial Sequence
  MKO10003816_A_Aldoc
  gRNA
aaucagugaucgcacgccgu

SEQ ID NO: 3817 - RNA, 20 nt, Artificial Sequence
  MKO10003817_A_Aldoc
  gRNA
auuggagaaugccaacgugc

SEQ ID NO: 3818 - RNA, 20 nt, Artificial Sequence
  MKO10003818_A_Aldoc
  gRNA
gaaugggaucgugccuauug

SEQ ID NO: 3819 - RNA, 20 nt, Artificial Sequence
  MKO10003819_A_Alg10b
  gRNA
guaucuggugucggucggug

SEQ ID NO: 3820 - RNA, 20 nt, Artificial Sequence
  MKO10003820_A_Alg10b
  gRNA
caccgaccgacaccagauac

SEQ ID NO: 3821 - RNA, 20 nt, Artificial Sequence
  MKO10003821_A_Alg10b
  gRNA
cauaggaccucggccuugcu

SEQ ID NO: 3822 - RNA, 20 nt, Artificial Sequence
  MKO10003822_A_Alg11
  gRNA
ggugcguguacgccgugcug

SEQ ID NO: 3823 - RNA, 20 nt, Artificial Sequence
  MKO10003823_A_Alg11
  gRNA
uguugcgacacccuccaaua

SEQ ID NO: 3824 - RNA, 20 nt, Artificial Sequence
  MKO10003824_A_Alg11
  gRNA
gauaagauggcggcggacac

SEQ ID NO: 3825 - RNA, 20 nt, Artificial Sequence
  MKO10003825_A_Alg12
  gRNA
caagcggucauggccgcuuc

SEQ ID NO: 3826 - RNA, 20 nt, Artificial Sequence
  MKO10003826_A_Alg12
  gRNA
guuguuccuaggacguuccu

SEQ ID NO: 3827 - RNA, 20 nt, Artificial Sequence
  MKO10003827_A_Alg12
  gRNA
gauggcgugucggagcacuc

SEQ ID NO: 3828 - RNA, 20 nt, Artificial Sequence
  MKO10003828_A_Alg13
  gRNA
guuucgacgagcucgucgca

SEQ ID NO: 3829 - RNA, 20 nt, Artificial Sequence
  MKO10003829_A_Alg13
  gRNA
ggucgcuaacgacugcguuc

SEQ ID NO: 3830 - RNA, 20 nt, Artificial Sequence
  MKO10003830_A_Alg13
  gRNA
gguuguaacccagacucucg

SEQ ID NO: 3831 - RNA, 20 nt, Artificial Sequence
  MKO10003831_A_Alg14
  gRNA
uuugucaaacaauucgcccc

SEQ ID NO: 3832 - RNA, 20 nt, Artificial Sequence
  MKO10003832_A_Alg14
  gRNA
uucaccgaauuccgagaagc

SEQ ID NO: 3833 - RNA, 20 nt, Artificial Sequence
  MKO10003833_A_Alg14
  gRNA
uucucggaauucggugaagg

SEQ ID NO: 3834 - RNA, 20 nt, Artificial Sequence
  MKO10003834_A_Alg1
  gRNA
gggccccgaauucuccagua

SEQ ID NO: 3835 - RNA, 20 nt, Artificial Sequence
  MKO10003835_A_Alg1
  gRNA
uucugcaagaguucaucucg

SEQ ID NO: 3836 - RNA, 20 nt, Artificial Sequence
  MKO10003836_A_Alg1
  gRNA
auacaaccuugacuccauac

SEQ ID NO: 3837 - RNA, 20 nt, Artificial Sequence
  MKO10003837_A_Alg2
  gRNA
guauuccucgauccagucga

SEQ ID NO: 3838 - RNA, 20 nt, Artificial Sequence
  MKO10003838_A_Alg2
  gRNA
ucucuaucaaccgauacgaa

SEQ ID NO: 3839 - RNA, 20 nt, Artificial Sequence
  MKO10003839_A_Alg2
  gRNA
accuguaccgagcccguucc

SEQ ID NO: 3840 - RNA, 20 nt, Artificial Sequence
  MKO10003840_A_Alg3
  gRNA
gaaugugcugcucuucgccc

SEQ ID NO: 3841 - RNA, 20 nt, Artificial Sequence
  MKO10003841_A_Alg3
  gRNA
ccauagggauaucagugccc

SEQ ID NO: 3842 - RNA, 20 nt, Artificial Sequence
  MKO10003842_A_Alg3
  gRNA
ucaucuuccagcuacccagc

SEQ ID NO: 3843 - RNA, 20 nt, Artificial Sequence
  MKO10003843_A_Alg5
  gRNA
uccgcaccagcguuaucacc

SEQ ID NO: 3844 - RNA, 20 nt, Artificial Sequence
  MKO10003844_A_Alg5
  gRNA
caaaguccgggugauaacgc

SEQ ID NO: 3845 - RNA, 20 nt, Artificial Sequence
  MKO10003845_A_Alg5
  gRNA
ugauuguacguucacguaug

SEQ ID NO: 3846 - RNA, 20 nt, Artificial Sequence
  MKO10003846_A_Alg6
  gRNA
uuugcucauuuacguacccg

SEQ ID NO: 3847 - RNA, 20 nt, Artificial Sequence
  MKO10003847_A_Alg6
  gRNA
cuaugauaggccguaagagg

SEQ ID NO: 3848 - RNA, 20 nt, Artificial Sequence
  MKO10003848_A_Alg6
  gRNA
guugcucuccacacaucacg

SEQ ID NO: 3849 - RNA, 20 nt, Artificial Sequence
  MKO10003849_A_Alg8
  gRNA
agcacggacagaauaaacuu

SEQ ID NO: 3850 - RNA, 20 nt, Artificial Sequence
  MKO10003850_A_Alg8
  gRNA
guacuucaaaauccguggaa

SEQ ID NO: 3851 - RNA, 20 nt, Artificial Sequence
  MKO10003851_A_Alg8
  gRNA
uaccugaaauagacgugcaa

SEQ ID NO: 3852 - RNA, 20 nt, Artificial Sequence
  MKO10003852_A_Alg9
  gRNA
gcaugugagucgaaugaugc

SEQ ID NO: 3853 - RNA, 20 nt, Artificial Sequence
  MKO10003853_A_Alg9
  gRNA
cuuaccugcugcugcacgcc

SEQ ID NO: 3854 - RNA, 20 nt, Artificial Sequence
  MKO10003854_A_Alg9
  gRNA
ggcauguucugcucaucauc

SEQ ID NO: 3855 - RNA, 20 nt, Artificial Sequence
  MKO10003855_A_Alkbh1
  gRNA
ucacugagcgugaugccgag

SEQ ID NO: 3856 - RNA, 20 nt, Artificial Sequence
  MKO10003856_A_Alkbh1
  gRNA
agucuaggcgauaguaauuc

SEQ ID NO: 3857 - RNA, 20 nt, Artificial Sequence
  MKO10003857_A_Alkbh1
  gRNA
cuaucgccuagacuccacac

SEQ ID NO: 3858 - RNA, 20 nt, Artificial Sequence
  MKO10003858_A_Alkbh2
  gRNA
uggcgacaccuucgcgcgga

SEQ ID NO: 3859 - RNA, 20 nt, Artificial Sequence
  MKO10003859_A_Alkbh2
  gRNA
cgaaaagucaaguugacccg

SEQ ID NO: 3860 - RNA, 20 nt, Artificial Sequence
  MKO10003860_A_Alkbh2
  gRNA
ugugauuacaccguccuauu

SEQ ID NO: 3861 - RNA, 20 nt, Artificial Sequence
  MKO10003861_A_Alkbh3
  gRNA
agccgucuuucccagaccgc

SEQ ID NO: 3862 - RNA, 20 nt, Artificial Sequence
  MKO10003862_A_Alkbh3
  gRNA
uuaagggugugcuuauaucc

SEQ ID NO: 3863 - RNA, 20 nt, Artificial Sequence
  MKO10003863_A_Alkbh3
  gRNA
gcuuacuuacucaaucacuc

SEQ ID NO: 3864 - RNA, 20 nt, Artificial Sequence
  MKO10003864_A_Alkbh4
  gRNA
gucguccaagugggggucga

SEQ ID NO: 3865 - RNA, 20 nt, Artificial Sequence
  MKO10003865_A_Alkbh4
  gRNA
aguaccccgccgcuccuugc

SEQ ID NO: 3866 - RNA, 20 nt, Artificial Sequence
  MKO10003866_A_Alkbh4
  gRNA
agcugagauggugcgucuga

SEQ ID NO: 3867 - RNA, 20 nt, Artificial Sequence
  MKO10003867_A_Alkbh5
  gRNA
gguggugucccgcgccgaga

SEQ ID NO: 3868 - RNA, 20 nt, Artificial Sequence
  MKO10003868_A_Alkbh5
  gRNA
aucucgucgacgucgcccgg

SEQ ID NO: 3869 - RNA, 20 nt, Artificial Sequence
  MKO10003869_A_Alkbh5
  gRNA
aagauuagaugcaccgcgau

SEQ ID NO: 3870 - RNA, 20 nt, Artificial Sequence
  MKO10003870_A_Alkbh6
  gRNA
cgcucagggaccaucccccg

SEQ ID NO: 3871 - RNA, 20 nt, Artificial Sequence
  MKO10003871_A_Alkbh6
  gRNA
acaucaucgucuggcugucg

SEQ ID NO: 3872 - RNA, 20 nt, Artificial Sequence
  MKO10003872_A_Alkbh6
  gRNA
agaggaauauuugcuucgac

SEQ ID NO: 3873 - RNA, 20 nt, Artificial Sequence
  MKO10003873_A_Alkbh7
  gRNA
ggacacgcuaacacgcgaac

SEQ ID NO: 3874 - RNA, 20 nt, Artificial Sequence
  MKO10003874_A_Alkbh7
  gRNA
ggcgcuacgaguacgaccac

SEQ ID NO: 3875 - RNA, 20 nt, Artificial Sequence
  MKO10003875_A_Alkbh7
  gRNA
ucacugagaugcgucggccc

SEQ ID NO: 3876 - RNA, 20 nt, Artificial Sequence
  MKO10003876_A_Alkbh8
  gRNA
gucuggguaauggcgugagu

SEQ ID NO: 3877 - RNA, 20 nt, Artificial Sequence
  MKO10003877_A_Alkbh8
  gRNA
cauguacuuacccccaggua

SEQ ID NO: 3878 - RNA, 20 nt, Artificial Sequence
  MKO10003878_A_Alkbh8
  gRNA
gccauuacccagaccaccau

SEQ ID NO: 3879 - RNA, 20 nt, Artificial Sequence
  MKO10003879_A_Alk
  gRNA
cuuucccaccgcagucgaua

SEQ ID NO: 3880 - RNA, 20 nt, Artificial Sequence
  MKO10003880_A_Alk
  gRNA
uacacuuaccauaucgacug

SEQ ID NO: 3881 - RNA, 20 nt, Artificial Sequence
  MKO10003881_A_Alk
  gRNA
ugggcaacauaucuccccga

SEQ ID NO: 3882 - RNA, 20 nt, Artificial Sequence
  MKO10003882_A_Allc
  gRNA
cauuauucgugguaucgacg

SEQ ID NO: 3883 - RNA, 20 nt, Artificial Sequence
  MKO10003883_A_Allc
  gRNA
accagacguaagcgaauucc

SEQ ID NO: 3884 - RNA, 20 nt, Artificial Sequence
  MKO10003884_A_Allc
  gRNA
accuggaauucgcuuacguc

SEQ ID NO: 3885 - RNA, 20 nt, Artificial Sequence
  MKO10003885_A_Alms1
  gRNA
ucccacugacuugccgugua

SEQ ID NO: 3886 - RNA, 20 nt, Artificial Sequence
  MKO10003886_A_Alms1
  gRNA
aguaccagaccuacccucuc

SEQ ID NO: 3887 - RNA, 20 nt, Artificial Sequence
  MKO10003887_A_Alms1
  gRNA
cuacucugccgaucucaguc

SEQ ID NO: 3888 - RNA, 20 nt, Artificial Sequence
  MKO10003888_A_Alox12b
  gRNA
uugcggcaccgucggggagg

SEQ ID NO: 3889 - RNA, 20 nt, Artificial Sequence
  MKO10003889_A_Alox12b
  gRNA
uaucaucauccgucugcaca

SEQ ID NO: 3890 - RNA, 20 nt, Artificial Sequence
  MKO10003890_A_Alox12b
  gRNA
gccuuaauguugaugagaau

SEQ ID NO: 3891 - RNA, 20 nt, Artificial Sequence
  MKO10003891_A_Alox12e
  gRNA
gucgacguccccuugcaucu

SEQ ID NO: 3892 - RNA, 20 nt, Artificial Sequence
  MKO10003892_A_Alox12e
  gRNA
guuugcgcagcuucaccgcc

SEQ ID NO: 3893 - RNA, 20 nt, Artificial Sequence
  MKO10003893_A_Alox12e
  gRNA
guacugaacgggaccucccc

SEQ ID NO: 3894 - RNA, 20 nt, Artificial Sequence
  MKO10003894_A_Alox12
  gRNA
guuugacuucgacguucccg

SEQ ID NO: 3895 - RNA, 20 nt, Artificial Sequence
  MKO10003895_A_Alox12
  gRNA
ggaggguauaaacacguuug

SEQ ID NO: 3896 - RNA, 20 nt, Artificial Sequence
  MKO10003896_A_Alox12
  gRNA
caguccgcugcuauugucug

SEQ ID NO: 3897 - RNA, 20 nt, Artificial Sequence
  MKO10003897_A_Alox15
  gRNA
acacguuccccuguuaccga

SEQ ID NO: 3898 - RNA, 20 nt, Artificial Sequence
  MKO10003898_A_Alox15
  gRNA
ggaacguguacuccgauccc

SEQ ID NO: 3899 - RNA, 20 nt, Artificial Sequence
  MKO10003899_A_Alox15
  gRNA
uguagaccagcgauuucgag

SEQ ID NO: 3900 - RNA, 20 nt, Artificial Sequence
  MKO10003900_A_Alox5ap
  gRNA
aucaguccggcgaaggcggc

SEQ ID NO: 3901 - RNA, 20 nt, Artificial Sequence
  MKO10003901_A_Alox5ap
  gRNA
gguacgcaucuacgcaguuc

SEQ ID NO: 3902 - RNA, 20 nt, Artificial Sequence
  MKO10003902_A_Alox5ap
  gRNA
ggcaguguagacccgcucaa

SEQ ID NO: 3903 - RNA, 20 nt, Artificial Sequence
  MKO10003903_A_Alox5
  gRNA
ucgaguucccauguuaccgc

SEQ ID NO: 3904 - RNA, 20 nt, Artificial Sequence
  MKO10003904_A_Alox5
  gRNA
aaagucagcaaagucgugcc

SEQ ID NO: 3905 - RNA, 20 nt, Artificial Sequence
  MKO10003905_A_Alox5
  gRNA
aggcacggcaaaaacaguau

SEQ ID NO: 3906 - RNA, 20 nt, Artificial Sequence
  MKO10003906_A_Alox8
  gRNA
ucgcagaguacuugauguug

SEQ ID NO: 3907 - RNA, 20 nt, Artificial Sequence
  MKO10003907_A_Alox8
  gRNA
gcgaguccacaaagcacccc

SEQ ID NO: 3908 - RNA, 20 nt, Artificial Sequence
  MKO10003908_A_Alox8
  gRNA
gccgcugguucgagcuggag

SEQ ID NO: 3909 - RNA, 20 nt, Artificial Sequence
  MKO10003909_A_Aloxe3
  gRNA
uacaguagccaucgauccac

SEQ ID NO: 3910 - RNA, 20 nt, Artificial Sequence
  MKO10003910_A_Aloxe3
  gRNA
gguggcugaguaucgaaugu

SEQ ID NO: 3911 - RNA, 20 nt, Artificial Sequence
  MKO10003911_A_Aloxe3
  gRNA
aagcccgccaagaauguuau

SEQ ID NO: 3912 - RNA, 20 nt, Artificial Sequence
  MKO10003912_A_Alpi
  gRNA
cacacacggugaaccguaau

SEQ ID NO: 3913 - RNA, 20 nt, Artificial Sequence
  MKO10003913_A_Alpi
  gRNA
cuaaucgagcagcugcacuc

SEQ ID NO: 3914 - RNA, 20 nt, Artificial Sequence
  MKO10003914_A_Alpi
  gRNA
uccagcugaagaggagaacc

SEQ ID NO: 3915 - RNA, 20 nt, Artificial Sequence
  MKO10003915_A_Alpk1
  gRNA
cggagacgucgaguccauac

SEQ ID NO: 3916 - RNA, 20 nt, Artificial Sequence
  MKO10003916_A_Alpk1
  gRNA
ugcaacgcccaucgccccgc

SEQ ID NO: 3917 - RNA, 20 nt, Artificial Sequence
  MKO10003917_A_Alpk1
  gRNA
guaugcagaccgacuguacc

SEQ ID NO: 3918 - RNA, 20 nt, Artificial Sequence
  MKO10003918_A_Alpk2
  gRNA
ucauggcccuuggagcgaac

SEQ ID NO: 3919 - RNA, 20 nt, Artificial Sequence
  MKO10003919_A_Alpk2
  gRNA
accccaaaagcuuguuacgu

SEQ ID NO: 3920 - RNA, 20 nt, Artificial Sequence
  MKO10003920_A_Alpk2
  gRNA
cgcacagacgaaaaguaccc

SEQ ID NO: 3921 - RNA, 20 nt, Artificial Sequence
  MKO10003921_A_Alpk3
  gRNA
gugccgugucuccgucgagc

SEQ ID NO: 3922 - RNA, 20 nt, Artificial Sequence
  MKO10003922_A_Alpk3
  gRNA
cgcuuucuuuggaagcgguc

SEQ ID NO: 3923 - RNA, 20 nt, Artificial Sequence
  MKO10003923_A_Alpk3
  gRNA
ugaugagugaucucguauuu

SEQ ID NO: 3924 - RNA, 20 nt, Artificial Sequence
  MKO10003924_A_Alpl
  gRNA
guugcaucgcgugcgcucug

SEQ ID NO: 3925 - RNA, 20 nt, Artificial Sequence
  MKO10003925_A_Alpl
  gRNA
auccgaguaccagucccgau

SEQ ID NO: 3926 - RNA, 20 nt, Artificial Sequence
  MKO10003926_A_Alpl
  gRNA
aaccgcugcccgaauccuua

SEQ ID NO: 3927 - RNA, 20 nt, Artificial Sequence
  MKO10003927_A_Alppl2
  gRNA
uacgcgcacacugugaaccg

SEQ ID NO: 3928 - RNA, 20 nt, Artificial Sequence
  MKO10003928_A_Alppl2
  gRNA
ugucuacaguaaccgcuacc

SEQ ID NO: 3929 - RNA, 20 nt, Artificial Sequence
  MKO10003929_A_Alppl2
  gRNA
uaccccaugucguguugcac

SEQ ID NO: 3930 - RNA, 20 nt, Artificial Sequence
  MKO10003930_A_Als2cl
  gRNA
cgccaccacgcaaucagugu

SEQ ID NO: 3931 - RNA, 20 nt, Artificial Sequence
  MKO10003931_A_Als2cl
  gRNA
gccucugccgcagcgaaagc

SEQ ID NO: 3932 - RNA, 20 nt, Artificial Sequence
  MKO10003932_A_Als2cl
  gRNA
caaguccuacacugauugcg

SEQ ID NO: 3933 - RNA, 20 nt, Artificial Sequence
  MKO10003933_A_Als2cr11
  gRNA
ccgcucaucaucuugacguc

SEQ ID NO: 3934 - RNA, 20 nt, Artificial Sequence
  MKO10003934_A_Als2cr11
  gRNA
augugauucugcaccgccua

SEQ ID NO: 3935 - RNA, 20 nt, Artificial Sequence
  MKO10003935_A_Als2cr11
  gRNA
acaccgaacuugauaccauu

SEQ ID NO: 3936 - RNA, 20 nt, Artificial Sequence
  MKO10003936_A_Als2cr12
  gRNA
ugcagggacaagguccaguc

SEQ ID NO: 3937 - RNA, 20 nt, Artificial Sequence
  MKO10003937_A_Als2cr12
  gRNA
aacucacuccugucccaacc

SEQ ID NO: 3938 - RNA, 20 nt, Artificial Sequence
  MKO10003938_A_Als2cr12
  gRNA
uuucgaaugaguguauagcc

SEQ ID NO: 3939 - RNA, 20 nt, Artificial Sequence
  MKO10003939_A_Als2
  gRNA
uuccacccagcagaacgucg

SEQ ID NO: 3940 - RNA, 20 nt, Artificial Sequence
  MKO10003940_A_Als2
  gRNA
ggaacaccuugcuggacgcg

SEQ ID NO: 3941 - RNA, 20 nt, Artificial Sequence
  MKO10003941_A_Als2
  gRNA
uuaccuugcgacaacaaccc

SEQ ID NO: 3942 - RNA, 20 nt, Artificial Sequence
  MKO10003942_A_Alx1
  gRNA
cgcacgugaugcuccgcucg

SEQ ID NO: 3943 - RNA, 20 nt, Artificial Sequence
  MKO10003943_A_Alx1
  gRNA
agccgucgcuuugccguaaa

SEQ ID NO: 3944 - RNA, 20 nt, Artificial Sequence
  MKO10003944_A_Alx1
  gRNA
guucgaaaaccccguauaac

SEQ ID NO: 3945 - RNA, 20 nt, Artificial Sequence
  MKO10003945_A_Alx3
  gRNA
agaaaggcgcgcagcgcucg

SEQ ID NO: 3946 - RNA, 20 nt, Artificial Sequence
  MKO10003946_A_Alx3
  gRNA
gcgcugcgcgccuuucuccg

SEQ ID NO: 3947 - RNA, 20 nt, Artificial Sequence
  MKO10003947_A_Alx3
  gRNA
aaccuucagcacguuccagc

SEQ ID NO: 3948 - RNA, 20 nt, Artificial Sequence
  MKO10003948_A_Alx4
  gRNA
guuaaaggauccccgcgccc

SEQ ID NO: 3949 - RNA, 20 nt, Artificial Sequence
  MKO10003949_A_Alx4
  gRNA
cggccacaacgcggccuugc

SEQ ID NO: 3950 - RNA, 20 nt, Artificial Sequence
  MKO10003950_A_Alx4
  gRNA
cguucaucucguagccauug

SEQ ID NO: 3951 - RNA, 20 nt, Artificial Sequence
  MKO10003951_A_Alyref2
  gRNA
uucggucuacuguacggugc

SEQ ID NO: 3952 - RNA, 20 nt, Artificial Sequence
  MKO10003952_A_Alyref2
  gRNA
guuccugccgccgcgggcga

SEQ ID NO: 3953 - RNA, 20 nt, Artificial Sequence
  MKO10003953_A_Alyref2
  gRNA
agcugaaccguaaccagcgc

SEQ ID NO: 3954 - RNA, 20 nt, Artificial Sequence
  MKO10003954_A_Alyref
  gRNA
ccccgaagccgcugucgaag

SEQ ID NO: 3955 - RNA, 20 nt, Artificial Sequence
  MKO10003955_A_Alyref
  gRNA
ggacaccagcagcuucccgc

SEQ ID NO: 3956 - RNA, 20 nt, Artificial Sequence
  MKO10003956_A_Alyref
  gRNA
cacagcgaagaccugcacag

SEQ ID NO: 3957 - RNA, 20 nt, Artificial Sequence
  MKO10003957_A_Amacr
  gRNA
uugaaucgaugaccugcccu

SEQ ID NO: 3958 - RNA, 20 nt, Artificial Sequence
  MKO10003958_A_Amacr
  gRNA
cucuuugaacgcacacgcuc

SEQ ID NO: 3959 - RNA, 20 nt, Artificial Sequence
  MKO10003959_A_Amacr
  gRNA
cugagcggauuuggccaauc

SEQ ID NO: 3960 - RNA, 20 nt, Artificial Sequence
  MKO10003960_A_Ambn
  gRNA
auggacuuaccggcacggcg

SEQ ID NO: 3961 - RNA, 20 nt, Artificial Sequence
  MKO10003961_A_Ambn
  gRNA
gaaaaugagccucgccgugc

SEQ ID NO: 3962 - RNA, 20 nt, Artificial Sequence
  MKO10003962_A_Ambn
  gRNA
aggcucaaacuagccaugcc

SEQ ID NO: 3963 - RNA, 20 nt, Artificial Sequence
  MKO10003963_A_Ambp
  gRNA
cacucaccgccaucgaguac

SEQ ID NO: 3964 - RNA, 20 nt, Artificial Sequence
  MKO10003964_A_Ambp
  gRNA
caagaugagcgugagcacgc

SEQ ID NO: 3965 - RNA, 20 nt, Artificial Sequence
  MKO10003965_A_Ambp
  gRNA
cacuggggcguaccagaaga

SEQ ID NO: 3966 - RNA, 20 nt, Artificial Sequence
  MKO10003966_A_Ambra1
  gRNA
uggcacgagugccccguucu

SEQ ID NO: 3967 - RNA, 20 nt, Artificial Sequence
  MKO10003967_A_Ambra1
  gRNA
ccggacacgcuccaucucac

SEQ ID NO: 3968 - RNA, 20 nt, Artificial Sequence
  MKO10003968_A_Ambra1
  gRNA
uccacgcucgaccuucuuac

SEQ ID NO: 3969 - RNA, 20 nt, Artificial Sequence
  MKO10003969_A_Amd1
  gRNA
agauggagcagcauauugua

SEQ ID NO: 3970 - RNA, 20 nt, Artificial Sequence
  MKO10003970_A_Amd1
  gRNA
agcacugcacauccuucaaa

SEQ ID NO: 3971 - RNA, 20 nt, Artificial Sequence
  MKO10003971_A_Amd1
  gRNA
ugugacaaagacugacaagc

SEQ ID NO: 3972 - RNA, 20 nt, Artificial Sequence
  MKO10003972_A_Amd2
  gRNA
ccuccuaugaccaccugauc

SEQ ID NO: 3973 - RNA, 20 nt, Artificial Sequence
  MKO10003973_A_Amd2
  gRNA
ggucauaggaggucugacuu

SEQ ID NO: 3974 - RNA, 20 nt, Artificial Sequence
  MKO10003974_A_Amd2
  gRNA
uugcuguuucuuagcaaaac

SEQ ID NO: 3975 - RNA, 20 nt, Artificial Sequence
  MKO10003975_A_Amdhd1
  gRNA
ugcgcguaaucgagcgcgcc

SEQ ID NO: 3976 - RNA, 20 nt, Artificial Sequence
  MKO10003976_A_Amdhd1
  gRNA
cacgguggagcacacccgcc

SEQ ID NO: 3977 - RNA, 20 nt, Artificial Sequence
  MKO10003977_A_Amdhd1
  gRNA
ccacccgaugaaggcugccg

SEQ ID NO: 3978 - RNA, 20 nt, Artificial Sequence
  MKO10003978_A_Amdhd2
  gRNA
cuacggaggacguggguucg

SEQ ID NO: 3979 - RNA, 20 nt, Artificial Sequence
  MKO10003979_A_Amdhd2
  gRNA
ucauggcuccggucuaguuc

SEQ ID NO: 3980 - RNA, 20 nt, Artificial Sequence
  MKO10003980_A_Amdhd2
  gRNA
acccacguccuccguagccu

SEQ ID NO: 3981 - RNA, 20 nt, Artificial Sequence
  MKO10003981_A_Amelx
  gRNA
ccggcugccuuaucaugcuc

SEQ ID NO: 3982 - RNA, 20 nt, Artificial Sequence
  MKO10003982_A_Amelx
  gRNA
uagcuuaaguugauauaacc

SEQ ID NO: 3983 - RNA, 20 nt, Artificial Sequence
  MKO10003983_A_Amelx
  gRNA
gucgcuggccaagcuuccag

SEQ ID NO: 3984 - RNA, 20 nt, Artificial Sequence
  MKO10003984_A_Amer1
  gRNA
uuagcaguauccgccgucac

SEQ ID NO: 3985 - RNA, 20 nt, Artificial Sequence
  MKO10003985_A_Amer1
  gRNA
acuucgccgggagcagcgug

SEQ ID NO: 3986 - RNA, 20 nt, Artificial Sequence
  MKO10003986_A_Amer1
  gRNA
ggaguccuaaguaucgaggg

SEQ ID NO: 3987 - RNA, 20 nt, Artificial Sequence
  MKO10003987_A_Amer2
  gRNA
gacgccucgcgacacgcagc

SEQ ID NO: 3988 - RNA, 20 nt, Artificial Sequence
  MKO10003988_A_Amer2
  gRNA
cgacggacuagccgaggugu

SEQ ID NO: 3989 - RNA, 20 nt, Artificial Sequence
  MKO10003989_A_Amer2
  gRNA
gucccccuugucgacuccga

SEQ ID NO: 3990 - RNA, 20 nt, Artificial Sequence
  MKO10003990_A_Amer3
  gRNA
ccaugguugacgagucccga

SEQ ID NO: 3991 - RNA, 20 nt, Artificial Sequence
  MKO10003991_A_Amer3
  gRNA
uugggagcucuucucgccau

SEQ ID NO: 3992 - RNA, 20 nt, Artificial Sequence
  MKO10003992_A_Amer3
  gRNA
gaaaugccgugaccuauucc

SEQ ID NO: 3993 - RNA, 20 nt, Artificial Sequence
  MKO10003993_A_Amfr
  gRNA
ugucuuucacucacucgaag

SEQ ID NO: 3994 - RNA, 20 nt, Artificial Sequence
  MKO10003994_A_Amfr
  gRNA
aaguggugauguggugccuc

SEQ ID NO: 3995 - RNA, 20 nt, Artificial Sequence
  MKO10003995_A_Amfr
  gRNA
agagcagcauagcaaucagc

SEQ ID NO: 3996 - RNA, 20 nt, Artificial Sequence
  MKO10003996_A_Amhr2
  gRNA
uucagcccugcuacaacgaa

SEQ ID NO: 3997 - RNA, 20 nt, Artificial Sequence
  MKO10003997_A_Amhr2
  gRNA
gcuguccaggugggcccguc

SEQ ID NO: 3998 - RNA, 20 nt, Artificial Sequence
  MKO10003998_A_Amhr2
  gRNA
guugcugaguagcaucaucu

SEQ ID NO: 3999 - RNA, 20 nt, Artificial Sequence
  MKO10003999_A_Amh
  gRNA
ucugaccguaauccgcgcua

SEQ ID NO: 4000 - RNA, 20 nt, Artificial Sequence
  MKO10004000_A_Amh
  gRNA
cgcggauuacggucagacug

SEQ ID NO: 4001 - RNA, 20 nt, Artificial Sequence
  MKO10004001_A_Amh
  gRNA
ccacgguuagcaccaaauag

SEQ ID NO: 4002 - RNA, 20 nt, Artificial Sequence
  MKO10004002_A_Amica1
  gRNA
uuccaaccuuagcgugccua

SEQ ID NO: 4003 - RNA, 20 nt, Artificial Sequence
  MKO10004003_A_Amica1
  gRNA
agcgccccguaggcacgcua

SEQ ID NO: 4004 - RNA, 20 nt, Artificial Sequence
  MKO10004004_A_Amica1
  gRNA
agccccuguagguuauccac

SEQ ID NO: 4005 - RNA, 20 nt, Artificial Sequence
  MKO10004005_A_Amigo1
  gRNA
gagcuugcagucgcacucca

SEQ ID NO: 4006 - RNA, 20 nt, Artificial Sequence
  MKO10004006_A_Amigo1
  gRNA
ucguccccguacccaaccuu

SEQ ID NO: 4007 - RNA, 20 nt, Artificial Sequence
  MKO10004007_A_Amigo1
  gRNA
uguguauaccuguuacgcca

SEQ ID NO: 4008 - RNA, 20 nt, Artificial Sequence
  MKO10004008_A_Amigo2
  gRNA
ugccuuccgaucgucagcag

SEQ ID NO: 4009 - RNA, 20 nt, Artificial Sequence
  MKO10004009_A_Amigo2
  gRNA
auuugcaugggcacggcguc

SEQ ID NO: 4010 - RNA, 20 nt, Artificial Sequence
  MKO10004010_A_Amigo2
  gRNA
uaggcacuuuagcuccguga

SEQ ID NO: 4011 - RNA, 20 nt, Artificial Sequence
  MKO10004011_A_Amigo3
  gRNA
uuaaccccagaccgugcaag

SEQ ID NO: 4012 - RNA, 20 nt, Artificial Sequence
  MKO10004012_A_Amigo3
  gRNA
acucgcguucaaaaucaugc

SEQ ID NO: 4013 - RNA, 20 nt, Artificial Sequence
  MKO10004013_A_Amigo3
  gRNA
uuguuugcaccacccugucg

SEQ ID NO: 4014 - RNA, 20 nt, Artificial Sequence
  MKO10004014_A_Ammecr1l
  gRNA
gggcgagacaagcggcuucg

SEQ ID NO: 4015 - RNA, 20 nt, Artificial Sequence
  MKO10004015_A_Ammecr1l
  gRNA
auucccuccccugacccgag

SEQ ID NO: 4016 - RNA, 20 nt, Artificial Sequence
  MKO10004016_A_Ammecr1l
  gRNA
agcuccucucgggucagggg

SEQ ID NO: 4017 - RNA, 20 nt, Artificial Sequence
  MKO10004017_A_Ammecr1
  gRNA
acgcaccgccaccuaccuac

SEQ ID NO: 4018 - RNA, 20 nt, Artificial Sequence
  MKO10004018_A_Ammecr1
  gRNA
ggucgagacaaaagacugcg

SEQ ID NO: 4019 - RNA, 20 nt, Artificial Sequence
  MKO10004019_A_Ammecr1
  gRNA
gacaccgagcagaaaagccu

SEQ ID NO: 4020 - RNA, 20 nt, Artificial Sequence
  MKO10004020_A_Amn1
  gRNA
uguugacauuucaacuacgc

SEQ ID NO: 4021 - RNA, 20 nt, Artificial Sequence
  MKO10004021_A_Amn1
  gRNA
agaucuagucuuugaacuuc

SEQ ID NO: 4022 - RNA, 20 nt, Artificial Sequence
  MKO10004022_A_Amn1
  gRNA
cauucuuaccucacuuauau

SEQ ID NO: 4023 - RNA, 20 nt, Artificial Sequence
  MKO10004023_A_Amn
  gRNA
aagauccaucgcgcgggaag

SEQ ID NO: 4024 - RNA, 20 nt, Artificial Sequence
  MKO10004024_A_Amn
  gRNA
ggugcacguucgcagcgucu

SEQ ID NO: 4025 - RNA, 20 nt, Artificial Sequence
  MKO10004025_A_Amn
  gRNA
ugaaccgcaucucccgcgca

SEQ ID NO: 4026 - RNA, 20 nt, Artificial Sequence
  MKO10004026_A_Amotl1
  gRNA
gucggcccgccaagaaccgc

SEQ ID NO: 4027 - RNA, 20 nt, Artificial Sequence
  MKO10004027_A_Amotl1
  gRNA
accggaugccuuugcgauug

SEQ ID NO: 4028 - RNA, 20 nt, Artificial Sequence
  MKO10004028_A_Amotl1
  gRNA
cuaugcugcugcaccguaga

SEQ ID NO: 4029 - RNA, 20 nt, Artificial Sequence
  MKO10004029_A_Amotl2
  gRNA
augcacaaagccgugccgcc

SEQ ID NO: 4030 - RNA, 20 nt, Artificial Sequence
  MKO10004030_A_Amotl2
  gRNA
gcaguucagcaugucgccgc

SEQ ID NO: 4031 - RNA, 20 nt, Artificial Sequence
  MKO10004031_A_Amotl2
  gRNA
cggugagaugagacgguugc

SEQ ID NO: 4032 - RNA, 20 nt, Artificial Sequence
  MKO10004032_A_Amot
  gRNA
ggucaccuugguucgagacc

SEQ ID NO: 4033 - RNA, 20 nt, Artificial Sequence
  MKO10004033_A_Amot
  gRNA
ggaccacuaccgucacgccc

SEQ ID NO: 4034 - RNA, 20 nt, Artificial Sequence
  MKO10004034_A_Amot
  gRNA
gaaggaguacgagggguccg

SEQ ID NO: 4035 - RNA, 20 nt, Artificial Sequence
  MKO10004035_A_Ampd1
  gRNA
cgagaucucccccuucgacg

SEQ ID NO: 4036 - RNA, 20 nt, Artificial Sequence
  MKO10004036_A_Ampd1
  gRNA
gcagaucucauccacgucga

SEQ ID NO: 4037 - RNA, 20 nt, Artificial Sequence
  MKO10004037_A_Ampd1
  gRNA
ucaggcacacucucguaggu

SEQ ID NO: 4038 - RNA, 20 nt, Artificial Sequence
  MKO10004038_A_Ampd2
  gRNA
ggaguuguucagccgcucac

SEQ ID NO: 4039 - RNA, 20 nt, Artificial Sequence
  MKO10004039_A_Ampd2
  gRNA
gcuugaccugcgcacgucua

SEQ ID NO: 4040 - RNA, 20 nt, Artificial Sequence
  MKO10004040_A_Ampd2
  gRNA
ugccauccauagacgugcgc

SEQ ID NO: 4041 - RNA, 20 nt, Artificial Sequence
  MKO10004041_A_Ampd3
  gRNA
uaccugguucgcaugcacgg

SEQ ID NO: 4042 - RNA, 20 nt, Artificial Sequence
  MKO10004042_A_Ampd3
  gRNA
caagccgugcauacuucucc

SEQ ID NO: 4043 - RNA, 20 nt, Artificial Sequence
  MKO10004043_A_Ampd3
  gRNA
caccuccgugcaugcgaacc

SEQ ID NO: 4044 - RNA, 20 nt, Artificial Sequence
  MKO10004044_A_Amph
  gRNA
augaagucuacgagccagac

SEQ ID NO: 4045 - RNA, 20 nt, Artificial Sequence
  MKO10004045_A_Amph
  gRNA
ucuucccguccauaccaguc

SEQ ID NO: 4046 - RNA, 20 nt, Artificial Sequence
  MKO10004046_A_Amph
  gRNA
ccuccugccguuugaaguuc

SEQ ID NO: 4047 - RNA, 20 nt, Artificial Sequence
  MKO10004047_A_Amtn
  gRNA
acgggagaguaugugcgccg

SEQ ID NO: 4048 - RNA, 20 nt, Artificial Sequence
  MKO10004048_A_Amtn
  gRNA
acauacucucccguucaccc

SEQ ID NO: 4049 - RNA, 20 nt, Artificial Sequence
  MKO10004049_A_Amtn
  gRNA
uccaaguugugccacaauaa

SEQ ID NO: 4050 - RNA, 20 nt, Artificial Sequence
  MKO10004050_A_Amt
  gRNA
ucuuuguuuaccaacgaagc

SEQ ID NO: 4051 - RNA, 20 nt, Artificial Sequence
  MKO10004051_A_Amt
  gRNA
uaagaugccuccagcuucgu

SEQ ID NO: 4052 - RNA, 20 nt, Artificial Sequence
  MKO10004052_A_Amt
  gRNA
uaugacuuccaccuagcuca

SEQ ID NO: 4053 - RNA, 20 nt, Artificial Sequence
  MKO10004053_A_Amy1
  gRNA
ugggcaaaguuaugcgcaag

SEQ ID NO: 4054 - RNA, 20 nt, Artificial Sequence
  MKO10004054_A_Amy1
  gRNA
gaacuaccaagaugcugcuc

SEQ ID NO: 4055 - RNA, 20 nt, Artificial Sequence
  MKO10004055_A_Amy1
  gRNA
ggaaaauguagaacugcaag

SEQ ID NO: 4056 - RNA, 20 nt, Artificial Sequence
  MKO10004056_A_Amy2a2
  gRNA
uucauaacccaucaagaccu

SEQ ID NO: 4057 - RNA, 20 nt, Artificial Sequence
  MKO10004057_A_Amy2a2
  gRNA
ucagcuauaaaaucugcaca

SEQ ID NO: 4058 - RNA, 20 nt, Artificial Sequence
  MKO10004058_A_Amy2a2
  gRNA
uuguuagguccguauuuaug

SEQ ID NO: 4059 - RNA, 20 nt, Artificial Sequence
  MKO10004059_A_Amy2a3
  gRNA
uucauaacccaucaagaccu

SEQ ID NO: 4060 - RNA, 20 nt, Artificial Sequence
  MKO10004060_A_Amy2a3
  gRNA
ucagcuauaaaaucugcaca

SEQ ID NO: 4061 - RNA, 20 nt, Artificial Sequence
  MKO10004061_A_Amy2a3
  gRNA
uuguuagguccguauuuaug

SEQ ID NO: 4062 - RNA, 20 nt, Artificial Sequence
  MKO10004062_A_Amy2a4
  gRNA
uucauaacccaucaagaccu

SEQ ID NO: 4063 - RNA, 20 nt, Artificial Sequence
  MKO10004063_A_Amy2a4
  gRNA
ucagcuauaaaaucugcaca

SEQ ID NO: 4064 - RNA, 20 nt, Artificial Sequence
  MKO10004064_A_Amy2a4
  gRNA
uuguuagguccguauuuaug

SEQ ID NO: 4065 - RNA, 20 nt, Artificial Sequence
  MKO10004065_A_Amy2a5
  gRNA
uucauaacccaucaagaccu

SEQ ID NO: 4066 - RNA, 20 nt, Artificial Sequence
  MKO10004066_A_Amy2a5
  gRNA
ucagcuauaaaaucugcaca

SEQ ID NO: 4067 - RNA, 20 nt, Artificial Sequence
  MKO10004067_A_Amy2a5
  gRNA
uuguuagguccguauuuaug

SEQ ID NO: 4068 - RNA, 20 nt, Artificial Sequence
  MKO10004068_A_Amy2b
  gRNA
uuguaauucauaacccauca

SEQ ID NO: 4069 - RNA, 20 nt, Artificial Sequence
  MKO10004069_A_Amy2b
  gRNA
ucagcuacaaaauuugcaca

SEQ ID NO: 4070 - RNA, 20 nt, Artificial Sequence
  MKO10004070_A_Amy2b
  gRNA
cguguaacagaauucaaguu

SEQ ID NO: 4071 - RNA, 20 nt, Artificial Sequence
  MKO10004071_A_Amz1
  gRNA
aagccucggcgcagcuccga

SEQ ID NO: 4072 - RNA, 20 nt, Artificial Sequence
  MKO10004072_A_Amz1
  gRNA
ccaccuucggagcugcgccg

SEQ ID NO: 4073 - RNA, 20 nt, Artificial Sequence
  MKO10004073_A_Amz1
  gRNA
gugcgugcugggccucacgc

SEQ ID NO: 4074 - RNA, 20 nt, Artificial Sequence
  MKO10004074_A_Amz2
  gRNA
uucuacaccucgaaauacga

SEQ ID NO: 4075 - RNA, 20 nt, Artificial Sequence
  MKO10004075_A_Amz2
  gRNA
cacauugccuucguauuucg

SEQ ID NO: 4076 - RNA, 20 nt, Artificial Sequence
  MKO10004076_A_Amz2
  gRNA
gacucguggaacuucgucuu

SEQ ID NO: 4077 - RNA, 20 nt, Artificial Sequence
  MKO10004077_A_Anapc10
  gRNA
aauuggauguucacuaagug

SEQ ID NO: 4078 - RNA, 20 nt, Artificial Sequence
  MKO10004078_A_Anapc10
  gRNA
ucaugauguaucguucaaua

SEQ ID NO: 4079 - RNA, 20 nt, Artificial Sequence
  MKO10004079_A_Anapc10
  gRNA
aacauacccggauuucuuga

SEQ ID NO: 4080 - RNA, 20 nt, Artificial Sequence
  MKO10004080_A_Anapc11
  gRNA
ugaugacugcccccucgugu

SEQ ID NO: 4081 - RNA, 20 nt, Artificial Sequence
  MKO10004081_A_Anapc11
  gRNA
gcacugccccaugugucgcc

SEQ ID NO: 4082 - RNA, 20 nt, Artificial Sequence
  MKO10004082_A_Anapc11
  gRNA
gaugccgcaguucucaucau

SEQ ID NO: 4083 - RNA, 20 nt, Artificial Sequence
  MKO10004083_A_Anapc13
  gRNA
cacgagaacgucccacccgc

SEQ ID NO: 4084 - RNA, 20 nt, Artificial Sequence
  MKO10004084_A_Anapc13
  gRNA
ugaggaugucgccauuccac

SEQ ID NO: 4085 - RNA, 20 nt, Artificial Sequence
  MKO10004085_A_Anapc13
  gRNA
agcccggcaucaguuuccag

SEQ ID NO: 4086 - RNA, 20 nt, Artificial Sequence
  MKO10004086_A_Anapc15
  gRNA
aauuggcaagccggccucag

SEQ ID NO: 4087 - RNA, 20 nt, Artificial Sequence
  MKO10004087_A_Anapc15
  gRNA
ugucuaccuagaucauccac

SEQ ID NO: 4088 - RNA, 20 nt, Artificial Sequence
  MKO10004088_A_Anapc15
  gRNA
cuaccagcacuacgaugaug

SEQ ID NO: 4089 - RNA, 20 nt, Artificial Sequence
  MKO10004089_A_Anapc16
  gRNA
gcucuguucaccuacccgaa

SEQ ID NO: 4090 - RNA, 20 nt, Artificial Sequence
  MKO10004090_A_Anapc16
  gRNA
augcuucaccuguuuaagcg

SEQ ID NO: 4091 - RNA, 20 nt, Artificial Sequence
  MKO10004091_A_Anapc16
  gRNA
cucuagaucagcaagucgcu

SEQ ID NO: 4092 - RNA, 20 nt, Artificial Sequence
  MKO10004092_A_Anapc1
  gRNA
aguguacaaagcguucacag

SEQ ID NO: 4093 - RNA, 20 nt, Artificial Sequence
  MKO10004093_A_Anapc1
  gRNA
gugugacuucauuauaucac

SEQ ID NO: 4094 - RNA, 20 nt, Artificial Sequence
  MKO10004094_A_Anapc1
  gRNA
auugauagguggcaaauguu

SEQ ID NO: 4095 - RNA, 20 nt, Artificial Sequence
  MKO10004095_A_Anapc2
  gRNA
auagccgguaugcccgccgc

SEQ ID NO: 4096 - RNA, 20 nt, Artificial Sequence
  MKO10004096_A_Anapc2
  gRNA
cuaugccacccuacgcaucg

SEQ ID NO: 4097 - RNA, 20 nt, Artificial Sequence
  MKO10004097_A_Anapc2
  gRNA
ugaaaagcuccucgaugcgu

SEQ ID NO: 4098 - RNA, 20 nt, Artificial Sequence
  MKO10004098_A_Anapc4
  gRNA
auuaucauacguuugccguc

SEQ ID NO: 4099 - RNA, 20 nt, Artificial Sequence
  MKO10004099_A_Anapc4
  gRNA
aaacucgaugaaaacuugca

SEQ ID NO: 4100 - RNA, 20 nt, Artificial Sequence
  MKO10004100_A_Anapc4
  gRNA
cuccggucucuuguaugcau

SEQ ID NO: 4101 - RNA, 20 nt, Artificial Sequence
  MKO10004101_A_Anapc5
  gRNA
aagagcucgacguguccgug

SEQ ID NO: 4102 - RNA, 20 nt, Artificial Sequence
  MKO10004102_A_Anapc5
  gRNA
guucacaaaacgaguguagu

SEQ ID NO: 4103 - RNA, 20 nt, Artificial Sequence
  MKO10004103_A_Anapc5
  gRNA
guuccugcgccacaugaucu

SEQ ID NO: 4104 - RNA, 20 nt, Artificial Sequence
  MKO10004104_A_Anapc7
  gRNA
gauugcucucgaguugucac

SEQ ID NO: 4105 - RNA, 20 nt, Artificial Sequence
  MKO10004105_A_Anapc7
  gRNA
agacucucuguuucacgaua

SEQ ID NO: 4106 - RNA, 20 nt, Artificial Sequence
  MKO10004106_A_Anapc7
  gRNA
augccauugcuguacucgau

SEQ ID NO: 4107 - RNA, 20 nt, Artificial Sequence
  MKO10004107_A_Ang2
  gRNA
auucuuaaauuucguccaua

SEQ ID NO: 4108 - RNA, 20 nt, Artificial Sequence
  MKO10004108_A_Ang2
  gRNA
cucgguaccugcauggaggc

SEQ ID NO: 4109 - RNA, 20 nt, Artificial Sequence
  MKO10004109_A_Ang2
  gRNA
ggaucacaaccagacccaac

SEQ ID NO: 4110 - RNA, 20 nt, Artificial Sequence
  MKO10004110_A_Ang3
  gRNA
uggcaucauaguguugauuc

SEQ ID NO: 4111 - RNA, 20 nt, Artificial Sequence
  MKO10004111_A_Ang3
  gRNA
ugugcuugcaaguugugauc

SEQ ID NO: 4112 - RNA, 20 nt, Artificial Sequence
  MKO10004112_A_Ang3
  gRNA
ggagucuagcugugugcucc

SEQ ID NO: 4113 - RNA, 20 nt, Artificial Sequence
  MKO10004113_A_Ang4
  gRNA
cgcuccugagugcguacaag

SEQ ID NO: 4114 - RNA, 20 nt, Artificial Sequence
  MKO10004114_A_Ang4
  gRNA
aucaccacuuguacgcacuc

SEQ ID NO: 4115 - RNA, 20 nt, Artificial Sequence
  MKO10004115_A_Ang4
  gRNA
uggcaucauagugcugacgu

SEQ ID NO: 4116 - RNA, 20 nt, Artificial Sequence
  MKO10004116_A_Ang5
  gRNA
uggcaucauaguguugauuc

SEQ ID NO: 4117 - RNA, 20 nt, Artificial Sequence
  MKO10004117_A_Ang5
  gRNA
ugugcuugcaaguugugauc

SEQ ID NO: 4118 - RNA, 20 nt, Artificial Sequence
  MKO10004118_A_Ang5
  gRNA
auucuuaaguuuacuccaua

SEQ ID NO: 4119 - RNA, 20 nt, Artificial Sequence
  MKO10004119_A_Ang6
  gRNA
aucaccacuugcaaucacuc

SEQ ID NO: 4120 - RNA, 20 nt, Artificial Sequence
  MKO10004120_A_Ang6
  gRNA
cccuccugagugauugcaag

SEQ ID NO: 4121 - RNA, 20 nt, Artificial Sequence
  MKO10004121_A_Ang6
  gRNA
auucuaaaguuugcuccaua

SEQ ID NO: 4122 - RNA, 20 nt, Artificial Sequence
  MKO10004122_A_Angel1
  gRNA
auguccuguacaacccgcgu

SEQ ID NO: 4123 - RNA, 20 nt, Artificial Sequence
  MKO10004123_A_Angel1
  gRNA
agcuugacaucaccccgacg

SEQ ID NO: 4124 - RNA, 20 nt, Artificial Sequence
  MKO10004124_A_Angel1
  gRNA
gugcgauggccgcagaacag

SEQ ID NO: 4125 - RNA, 20 nt, Artificial Sequence
  MKO10004125_A_Angel2
  gRNA
gccgacguccaguguuacac

SEQ ID NO: 4126 - RNA, 20 nt, Artificial Sequence
  MKO10004126_A_Angel2
  gRNA
ccgccgcgacauuccucugc

SEQ ID NO: 4127 - RNA, 20 nt, Artificial Sequence
  MKO10004127_A_Angel2
  gRNA
gucuuauaacauccucucgc

SEQ ID NO: 4128 - RNA, 20 nt, Artificial Sequence
  MKO10004128_A_Angpt1
  gRNA
uaccaccuucuuuagugcaa

SEQ ID NO: 4129 - RNA, 20 nt, Artificial Sequence
  MKO10004129_A_Angpt1
  gRNA
ucgucagacauucaucaucc

SEQ ID NO: 4130 - RNA, 20 nt, Artificial Sequence
  MKO10004130_A_Angpt1
  gRNA
acaucugcacagucucgaaa

SEQ ID NO: 4131 - RNA, 20 nt, Artificial Sequence
  MKO10004131_A_Angpt2
  gRNA
acggauagcaaccgagcucu

SEQ ID NO: 4132 - RNA, 20 nt, Artificial Sequence
  MKO10004132_A_Angpt2
  gRNA
gcagcucgagucuugucguc

SEQ ID NO: 4133 - RNA, 20 nt, Artificial Sequence
  MKO10004133_A_Angpt2
  gRNA
aaggagcgaguuguugaccg

SEQ ID NO: 4134 - RNA, 20 nt, Artificial Sequence
  MKO10004134_A_Angpt4
  gRNA
auagaugguauagacaccgc

SEQ ID NO: 4135 - RNA, 20 nt, Artificial Sequence
  MKO10004135_A_Angpt4
  gRNA
ugugcagagaucaagcgcuc

SEQ ID NO: 4136 - RNA, 20 nt, Artificial Sequence
  MKO10004136_A_Angpt4
  gRNA
gagcgugcagauugugcuuc

SEQ ID NO: 4137 - RNA, 20 nt, Artificial Sequence
  MKO10004137_A_Angptl1
  gRNA
ugacuacuacagacugcgcc

SEQ ID NO: 4138 - RNA, 20 nt, Artificial Sequence
  MKO10004138_A_Angptl1
  gRNA
aacugcgcccacuuccauaa

SEQ ID NO: 4139 - RNA, 20 nt, Artificial Sequence
  MKO10004139_A_Angptl1
  gRNA
agaauacagcagcuuucguc

SEQ ID NO: 4140 - RNA, 20 nt, Artificial Sequence
  MKO10004140_A_Angptl2
  gRNA
ucgaaagcgagacaaugcgc

SEQ ID NO: 4141 - RNA, 20 nt, Artificial Sequence
  MKO10004141_A_Angptl2
  gRNA
gaauaccaaccgccugaugc

SEQ ID NO: 4142 - RNA, 20 nt, Artificial Sequence
  MKO10004142_A_Angptl2
  gRNA
agacggaggcaucgugagcg

SEQ ID NO: 4143 - RNA, 20 nt, Artificial Sequence
  MKO10004143_A_Angptl3
  gRNA
cacaggacuucaacgaaaca

SEQ ID NO: 4144 - RNA, 20 nt, Artificial Sequence
  MKO10004144_A_Angptl3
  gRNA
gaaaacuacgaaaagggcuu

SEQ ID NO: 4145 - RNA, 20 nt, Artificial Sequence
  MKO10004145_A_Angptl3
  gRNA
auguucgccucuguuauaaa

SEQ ID NO: 4146 - RNA, 20 nt, Artificial Sequence
  MKO10004146_A_Angptl4
  gRNA
aagaguuccuggcagucccg

SEQ ID NO: 4147 - RNA, 20 nt, Artificial Sequence
  MKO10004147_A_Angptl4
  gRNA
ugaaguccacagagccguuc

SEQ ID NO: 4148 - RNA, 20 nt, Artificial Sequence
  MKO10004148_A_Angptl4
  gRNA
aucuccgaagccauccuugu

SEQ ID NO: 4149 - RNA, 20 nt, Artificial Sequence
  MKO10004149_A_Angptl6
  gRNA
gccgucguguaguagccgug

SEQ ID NO: 4150 - RNA, 20 nt, Artificial Sequence
  MKO10004150_A_Angptl6
  gRNA
cuccggcaucgccgugguac

SEQ ID NO: 4151 - RNA, 20 nt, Artificial Sequence
  MKO10004151_A_Angptl6
  gRNA
ggccaguaccacggcgaugc

SEQ ID NO: 4152 - RNA, 20 nt, Artificial Sequence
  MKO10004152_A_Angptl7
  gRNA
ggcgguaguacaccccauug

SEQ ID NO: 4153 - RNA, 20 nt, Artificial Sequence
  MKO10004153_A_Angptl7
  gRNA
aagccggcuucguguggagc

SEQ ID NO: 4154 - RNA, 20 nt, Artificial Sequence
  MKO10004154_A_Angptl7
  gRNA
caaggccacucuuacgucuc

SEQ ID NO: 4155 - RNA, 20 nt, Artificial Sequence
  MKO10004155_A_Ang
  gRNA
aacaugucugaacccugcag

SEQ ID NO: 4156 - RNA, 20 nt, Artificial Sequence
  MKO10004156_A_Ang
  gRNA
guuguucuugaucuucgugc

SEQ ID NO: 4157 - RNA, 20 nt, Artificial Sequence
  MKO10004157_A_Ang
  gRNA
cucgguacuggcauggaggu

SEQ ID NO: 4158 - RNA, 20 nt, Artificial Sequence
  MKO10004158_A_Ank1
  gRNA
uaauguccacuccauugcgc

SEQ ID NO: 4159 - RNA, 20 nt, Artificial Sequence
  MKO10004159_A_Ank1
  gRNA
gcgugccgcccgcagaaagc

SEQ ID NO: 4160 - RNA, 20 nt, Artificial Sequence
  MKO10004160_A_Ank1
  gRNA
aggcuuuacuccccuguaca

SEQ ID NO: 4161 - RNA, 20 nt, Artificial Sequence
  MKO10004161_A_Ank2
  gRNA
ccuugugaaacgccaucgac

SEQ ID NO: 4162 - RNA, 20 nt, Artificial Sequence
  MKO10004162_A_Ank2
  gRNA
uccgacuucaaucaggcggc

SEQ ID NO: 4163 - RNA, 20 nt, Artificial Sequence
  MKO10004163_A_Ank2
  gRNA
cacaaccgugucgucaauca

SEQ ID NO: 4164 - RNA, 20 nt, Artificial Sequence
  MKO10004164_A_Ank3
  gRNA
gugggggccguacacuuucg

SEQ ID NO: 4165 - RNA, 20 nt, Artificial Sequence
  MKO10004165_A_Ank3
  gRNA
guaggaccuauccgaacuga

SEQ ID NO: 4166 - RNA, 20 nt, Artificial Sequence
  MKO10004166_A_Ank3
  gRNA
uucagcaccugacguucacg

SEQ ID NO: 4167 - RNA, 20 nt, Artificial Sequence
  MKO10004167_A_Ankar
  gRNA
auucaauuccuccgugaacg

SEQ ID NO: 4168 - RNA, 20 nt, Artificial Sequence
  MKO10004168_A_Ankar
  gRNA
uuuccguucaacuccaugac

SEQ ID NO: 4169 - RNA, 20 nt, Artificial Sequence
  MKO10004169_A_Ankar
  gRNA
aguuuacccaauaccaguca

SEQ ID NO: 4170 - RNA, 20 nt, Artificial Sequence
  MKO10004170_A_Ankdd1b
  gRNA
cgaccugaaccagcccaaug

SEQ ID NO: 4171 - RNA, 20 nt, Artificial Sequence
  MKO10004171_A_Ankdd1b
  gRNA
gcaggugcaagucgugaaug

SEQ ID NO: 4172 - RNA, 20 nt, Artificial Sequence
  MKO10004172_A_Ankdd1b
  gRNA
cacagcccugcacuuugccg

SEQ ID NO: 4173 - RNA, 20 nt, Artificial Sequence
  MKO10004173_A_Ankef1
  gRNA
gcaucgauagugccgcuuag

SEQ ID NO: 4174 - RNA, 20 nt, Artificial Sequence
  MKO10004174_A_Ankef1
  gRNA
acgccuuuaaguucguggac

SEQ ID NO: 4175 - RNA, 20 nt, Artificial Sequence
  MKO10004175_A_Ankef1
  gRNA
gccgcuaaacucgcuaagac

SEQ ID NO: 4176 - RNA, 20 nt, Artificial Sequence
  MKO10004176_A_Ankfn1
  gRNA
ccaacaacgugcccauugcg

SEQ ID NO: 4177 - RNA, 20 nt, Artificial Sequence
  MKO10004177_A_Ankfn1
  gRNA
aguggagguaccggcucuac

SEQ ID NO: 4178 - RNA, 20 nt, Artificial Sequence
  MKO10004178_A_Ankfn1
  gRNA
ccgcagaagaauccucgcaa

SEQ ID NO: 4179 - RNA, 20 nt, Artificial Sequence
  MKO10004179_A_Ankfy1
  gRNA
acaauaguucaucagcguac

SEQ ID NO: 4180 - RNA, 20 nt, Artificial Sequence
  MKO10004180_A_Ankfy1
  gRNA
cuaacuagaugcgaauccug

SEQ ID NO: 4181 - RNA, 20 nt, Artificial Sequence
  MKO10004181_A_Ankfy1
  gRNA
cucauagagaccugccacua

SEQ ID NO: 4182 - RNA, 20 nt, Artificial Sequence
  MKO10004182_A_Ankhd1
  gRNA
gucagucuccggaguacuuc

SEQ ID NO: 4183 - RNA, 20 nt, Artificial Sequence
  MKO10004183_A_Ankhd1
  gRNA
ucuacauaccuguugccgac

SEQ ID NO: 4184 - RNA, 20 nt, Artificial Sequence
  MKO10004184_A_Ankhd1
  gRNA
guucguaaauuacuagauga

SEQ ID NO: 4185 - RNA, 20 nt, Artificial Sequence
  MKO10004185_A_Ankib1
  gRNA
ccguaccucucgcuugucua

SEQ ID NO: 4186 - RNA, 20 nt, Artificial Sequence
  MKO10004186_A_Ankib1
  gRNA
ccgcucucucauauucgccu

SEQ ID NO: 4187 - RNA, 20 nt, Artificial Sequence
  MKO10004187_A_Ankib1
  gRNA
ccgugcuaagcgaggaugaa

SEQ ID NO: 4188 - RNA, 20 nt, Artificial Sequence
  MKO10004188_A_Ankk1
  gRNA
ugaaccugaugaagcgcugu

SEQ ID NO: 4189 - RNA, 20 nt, Artificial Sequence
  MKO10004189_A_Ankk1
  gRNA
gcagcuuugcaauugucauc

SEQ ID NO: 4190 - RNA, 20 nt, Artificial Sequence
  MKO10004190_A_Ankk1
  gRNA
accauuugauguaccuccuc

SEQ ID NO: 4191 - RNA, 20 nt, Artificial Sequence
  MKO10004191_A_Ankle1
  gRNA
acacuaucuacggcggcugc

SEQ ID NO: 4192 - RNA, 20 nt, Artificial Sequence
  MKO10004192_A_Ankle1
  gRNA
ccgccguagauaguguccuc

SEQ ID NO: 4193 - RNA, 20 nt, Artificial Sequence
  MKO10004193_A_Ankle1
  gRNA
gcagcacucgugcgcaguug

SEQ ID NO: 4194 - RNA, 20 nt, Artificial Sequence
  MKO10004194_A_Ankle2
  gRNA
gauacaggucaacaacguag

SEQ ID NO: 4195 - RNA, 20 nt, Artificial Sequence
  MKO10004195_A_Ankle2
  gRNA
uucgacagcuuuccgcagcu

SEQ ID NO: 4196 - RNA, 20 nt, Artificial Sequence
  MKO10004196_A_Ankle2
  gRNA
ccagaaccaauuagauaucg

SEQ ID NO: 4197 - RNA, 20 nt, Artificial Sequence
  MKO10004197_A_Ankmy1
  gRNA
ucuucguccucaaugaacgg

SEQ ID NO: 4198 - RNA, 20 nt, Artificial Sequence
  MKO10004198_A_Ankmy1
  gRNA
gguaaacuaccccgaauucu

SEQ ID NO: 4199 - RNA, 20 nt, Artificial Sequence
  MKO10004199_A_Ankmy1
  gRNA
ugaaggcaccgugggcgagc

SEQ ID NO: 4200 - RNA, 20 nt, Artificial Sequence
  MKO10004200_A_Ankmy2
  gRNA
uaaaggucagcacgauugcg

SEQ ID NO: 4201 - RNA, 20 nt, Artificial Sequence
  MKO10004201_A_Ankmy2
  gRNA
cucauguuugcugcgcuuuc

SEQ ID NO: 4202 - RNA, 20 nt, Artificial Sequence
  MKO10004202_A_Ankmy2
  gRNA
ucccaccgaguucacaacau

SEQ ID NO: 4203 - RNA, 20 nt, Artificial Sequence
  MKO10004203_A_Ankra2
  gRNA
cuuguucaauacgaguagcc

SEQ ID NO: 4204 - RNA, 20 nt, Artificial Sequence
  MKO10004204_A_Ankra2
  gRNA
cuacuuuaaccaacaagcac

SEQ ID NO: 4205 - RNA, 20 nt, Artificial Sequence
  MKO10004205_A_Ankra2
  gRNA
aaggauuuaccccccugaug

SEQ ID NO: 4206 - RNA, 20 nt, Artificial Sequence
  MKO10004206_A_Ankrd10
  gRNA
gcagcgaacagagcgcgacc

SEQ ID NO: 4207 - RNA, 20 nt, Artificial Sequence
  MKO10004207_A_Ankrd10
  gRNA
acugcccacucacguuagcc

SEQ ID NO: 4208 - RNA, 20 nt, Artificial Sequence
  MKO10004208_A_Ankrd10
  gRNA
ucccgcugcaccgcgccugc

SEQ ID NO: 4209 - RNA, 20 nt, Artificial Sequence
  MKO10004209_A_Ankrd11
  gRNA
uggcgaugucguaauagccc

SEQ ID NO: 4210 - RNA, 20 nt, Artificial Sequence
  MKO10004210_A_Ankrd11
  gRNA
ugaugaguuccuugaugcgc

SEQ ID NO: 4211 - RNA, 20 nt, Artificial Sequence
  MKO10004211_A_Ankrd11
  gRNA
cugcaccgagcagcuauccg

SEQ ID NO: 4212 - RNA, 20 nt, Artificial Sequence
  MKO10004212_A_Ankrd12
  gRNA
agagacuuauaucuucuuac

SEQ ID NO: 4213 - RNA, 20 nt, Artificial Sequence
  MKO10004213_A_Ankrd12
  gRNA
acauacaagugaaaauuggg

SEQ ID NO: 4214 - RNA, 20 nt, Artificial Sequence
  MKO10004214_A_Ankrd12
  gRNA
ucgcgcuccucauuucucga

SEQ ID NO: 4215 - RNA, 20 nt, Artificial Sequence
  MKO10004215_A_Ankrd13a
  gRNA
ccauaugcgacagacaucgu

SEQ ID NO: 4216 - RNA, 20 nt, Artificial Sequence
  MKO10004216_A_Ankrd13a
  gRNA
ccaacgaugucugucgcaua

SEQ ID NO: 4217 - RNA, 20 nt, Artificial Sequence
  MKO10004217_A_Ankrd13a
  gRNA
ugcaguaauguccgaccccg

SEQ ID NO: 4218 - RNA, 20 nt, Artificial Sequence
  MKO10004218_A_Ankrd13b
  gRNA
ccagcggguggugaagcgac

SEQ ID NO: 4219 - RNA, 20 nt, Artificial Sequence
  MKO10004219_A_Ankrd13b
  gRNA
auggucaaagcccaaaagcg

SEQ ID NO: 4220 - RNA, 20 nt, Artificial Sequence
  MKO10004220_A_Ankrd13b
  gRNA
gagaaucgcagugguuggac

SEQ ID NO: 4221 - RNA, 20 nt, Artificial Sequence
  MKO10004221_A_Ankrd13c
  gRNA
cuugcggaagccaucagcua

SEQ ID NO: 4222 - RNA, 20 nt, Artificial Sequence
  MKO10004222_A_Ankrd13c
  gRNA
agaaugcgcacauuuacugu

SEQ ID NO: 4223 - RNA, 20 nt, Artificial Sequence
  MKO10004223_A_Ankrd13c
  gRNA
uuacaucuugcugugauguu

SEQ ID NO: 4224 - RNA, 20 nt, Artificial Sequence
  MKO10004224_A_Ankrd13d
  gRNA
uuaggccccugauuucuacg

SEQ ID NO: 4225 - RNA, 20 nt, Artificial Sequence
  MKO10004225_A_Ankrd13d
  gRNA
cgagcgauguguaccgugug

SEQ ID NO: 4226 - RNA, 20 nt, Artificial Sequence
  MKO10004226_A_Ankrd13d
  gRNA
cccucuggaagucccgauac

SEQ ID NO: 4227 - RNA, 20 nt, Artificial Sequence
  MKO10004227_A_Ankrd16
  gRNA
cgaugccaagaccgcauacc

SEQ ID NO: 4228 - RNA, 20 nt, Artificial Sequence
  MKO10004228_A_Ankrd16
  gRNA
ggaugaagccauacgguucc

SEQ ID NO: 4229 - RNA, 20 nt, Artificial Sequence
  MKO10004229_A_Ankrd16
  gRNA
cuugugcacgccaucaucag

SEQ ID NO: 4230 - RNA, 20 nt, Artificial Sequence
  MKO10004230_A_Ankrd17
  gRNA
gugcggaaacuacucauuga

SEQ ID NO: 4231 - RNA, 20 nt, Artificial Sequence
  MKO10004231_A_Ankrd17
  gRNA
cagacucgcaccaucccacg

SEQ ID NO: 4232 - RNA, 20 nt, Artificial Sequence
  MKO10004232_A_Ankrd17
  gRNA
aucgucugucaguugugcgu

SEQ ID NO: 4233 - RNA, 20 nt, Artificial Sequence
  MKO10004233_A_Ankrd1
  gRNA
cagccccgacgucugcgaug

SEQ ID NO: 4234 - RNA, 20 nt, Artificial Sequence
  MKO10004234_A_Ankrd1
  gRNA
gcuuaccucaucgcagacgu

SEQ ID NO: 4235 - RNA, 20 nt, Artificial Sequence
  MKO10004235_A_Ankrd1
  gRNA
ccauaucucggaauucaauc

SEQ ID NO: 4236 - RNA, 20 nt, Artificial Sequence
  MKO10004236_A_Ankrd22
  gRNA
cagccuaccagaacgacuug

SEQ ID NO: 4237 - RNA, 20 nt, Artificial Sequence
  MKO10004237_A_Ankrd22
  gRNA
ucucagguggccccgccugc

SEQ ID NO: 4238 - RNA, 20 nt, Artificial Sequence
  MKO10004238_A_Ankrd22
  gRNA
uaacuucuacgccagcauua

SEQ ID NO: 4239 - RNA, 20 nt, Artificial Sequence
  MKO10004239_A_Ankrd23
  gRNA
aaagcguuggaguuuggacg

SEQ ID NO: 4240 - RNA, 20 nt, Artificial Sequence
  MKO10004240_A_Ankrd23
  gRNA
ccgccagguacuugucaauc

SEQ ID NO: 4241 - RNA, 20 nt, Artificial Sequence
  MKO10004241_A_Ankrd23
  gRNA
ggaccccaaugcccaugaca

SEQ ID NO: 4242 - RNA, 20 nt, Artificial Sequence
  MKO10004242_A_Ankrd24
  gRNA
guccucgauguccaccacgc

SEQ ID NO: 4243 - RNA, 20 nt, Artificial Sequence
  MKO10004243_A_Ankrd24
  gRNA
ccucguugaucgcccacaag

SEQ ID NO: 4244 - RNA, 20 nt, Artificial Sequence
  MKO10004244_A_Ankrd24
  gRNA
agguuacaaugcccuucacc

SEQ ID NO: 4245 - RNA, 20 nt, Artificial Sequence
  MKO10004245_A_Ankrd26
  gRNA
ucucacuguagaccgcguag

SEQ ID NO: 4246 - RNA, 20 nt, Artificial Sequence
  MKO10004246_A_Ankrd26
  gRNA
cuacagugagaacacgucca

SEQ ID NO: 4247 - RNA, 20 nt, Artificial Sequence
  MKO10004247_A_Ankrd26
  gRNA
auucacgcaguugaucagcu

SEQ ID NO: 4248 - RNA, 20 nt, Artificial Sequence
  MKO10004248_A_Ankrd27
  gRNA
uuccaggcugucgucauuga

SEQ ID NO: 4249 - RNA, 20 nt, Artificial Sequence
  MKO10004249_A_Ankrd27
  gRNA
gacuuucuacaacgagaaag

SEQ ID NO: 4250 - RNA, 20 nt, Artificial Sequence
  MKO10004250_A_Ankrd27
  gRNA
ggauacuaacuauguggugg

SEQ ID NO: 4251 - RNA, 20 nt, Artificial Sequence
  MKO10004251_A_Ankrd28
  gRNA
gugaacguguccgaccgagc

SEQ ID NO: 4252 - RNA, 20 nt, Artificial Sequence
  MKO10004252_A_Ankrd28
  gRNA
agcaguugcaucguguagug

SEQ ID NO: 4253 - RNA, 20 nt, Artificial Sequence
  MKO10004253_A_Ankrd28
  gRNA
gauuucugcgucaccaagau

SEQ ID NO: 4254 - RNA, 20 nt, Artificial Sequence
  MKO10004254_A_Ankrd29
  gRNA
uacuuugguccgacauucag

SEQ ID NO: 4255 - RNA, 20 nt, Artificial Sequence
  MKO10004255_A_Ankrd29
  gRNA
gcacggcaccacacuucuca

SEQ ID NO: 4256 - RNA, 20 nt, Artificial Sequence
  MKO10004256_A_Ankrd29
  gRNA
cauacugacuagcagccaac

SEQ ID NO: 4257 - RNA, 20 nt, Artificial Sequence
  MKO10004257_A_Ankrd2
  gRNA
augucuugcgcacgcgcucu

SEQ ID NO: 4258 - RNA, 20 nt, Artificial Sequence
  MKO10004258_A_Ankrd2
  gRNA
aaacuucgaagauccgcucc

SEQ ID NO: 4259 - RNA, 20 nt, Artificial Sequence
  MKO10004259_A_Ankrd2
  gRNA
ccgcugaaccuccguccgcc

SEQ ID NO: 4260 - RNA, 20 nt, Artificial Sequence
  MKO10004260_A_Ankrd32
  gRNA
aucaagccaucugccacuuu

SEQ ID NO: 4261 - RNA, 20 nt, Artificial Sequence
  MKO10004261_A_Ankrd32
  gRNA
uccgcuuaucugcccuaaca

SEQ ID NO: 4262 - RNA, 20 nt, Artificial Sequence
  MKO10004262_A_Ankrd32
  gRNA
agcacugauucuugcauuac

SEQ ID NO: 4263 - RNA, 20 nt, Artificial Sequence
  MKO10004263_A_Ankrd33b
  gRNA
ccgcagcaaccccacgucgu

SEQ ID NO: 4264 - RNA, 20 nt, Artificial Sequence
  MKO10004264_A_Ankrd33b
  gRNA
aaucguccgaugcgaugcug

SEQ ID NO: 4265 - RNA, 20 nt, Artificial Sequence
  MKO10004265_A_Ankrd33b
  gRNA
guccccacguugacgucaac

SEQ ID NO: 4266 - RNA, 20 nt, Artificial Sequence
  MKO10004266_A_Ankrd33
  gRNA
acacucggagcgaucuugaa

SEQ ID NO: 4267 - RNA, 20 nt, Artificial Sequence
  MKO10004267_A_Ankrd33
  gRNA
gccacucuggcugguaaugc

SEQ ID NO: 4268 - RNA, 20 nt, Artificial Sequence
  MKO10004268_A_Ankrd33
  gRNA
gucagcucauaccgugcaga

SEQ ID NO: 4269 - RNA, 20 nt, Artificial Sequence
  MKO10004269_A_Ankrd34a
  gRNA
ucagcgcgguacguccuaaa

SEQ ID NO: 4270 - RNA, 20 nt, Artificial Sequence
  MKO10004270_A_Ankrd34a
  gRNA
gucgucguaacgggcccuac

SEQ ID NO: 4271 - RNA, 20 nt, Artificial Sequence
  MKO10004271_A_Ankrd34a
  gRNA
gcgcugaugcaugcuugcgc

SEQ ID NO: 4272 - RNA, 20 nt, Artificial Sequence
  MKO10004272_A_Ankrd34b
  gRNA
ccgcgugauuccuccugcuc

SEQ ID NO: 4273 - RNA, 20 nt, Artificial Sequence
  MKO10004273_A_Ankrd34b
  gRNA
ccaaaaagcgcuuaugccga

SEQ ID NO: 4274 - RNA, 20 nt, Artificial Sequence
  MKO10004274_A_Ankrd34b
  gRNA
accacagcgaagucgcccuc

SEQ ID NO: 4275 - RNA, 20 nt, Artificial Sequence
  MKO10004275_A_Ankrd34c
  gRNA
ucgaccgcauugcucacacg

SEQ ID NO: 4276 - RNA, 20 nt, Artificial Sequence
  MKO10004276_A_Ankrd34c
  gRNA
cucccaccucaguucgccgc

SEQ ID NO: 4277 - RNA, 20 nt, Artificial Sequence
  MKO10004277_A_Ankrd34c
  gRNA
uaagcugcuuuccacgaagc

SEQ ID NO: 4278 - RNA, 20 nt, Artificial Sequence
  MKO10004278_A_Ankrd35
  gRNA
ccagcagcuucugaucacgu

SEQ ID NO: 4279 - RNA, 20 nt, Artificial Sequence
  MKO10004279_A_Ankrd35
  gRNA
ccgacgugaucagaagcugc

SEQ ID NO: 4280 - RNA, 20 nt, Artificial Sequence
  MKO10004280_A_Ankrd35
  gRNA
uuccaucuggcagccuccaa

SEQ ID NO: 4281 - RNA, 20 nt, Artificial Sequence
  MKO10004281_A_Ankrd36
  gRNA
ccuuguuguagaccguguag

SEQ ID NO: 4282 - RNA, 20 nt, Artificial Sequence
  MKO10004282_A_Ankrd36
  gRNA
gauaccucuugcaguuaucc

SEQ ID NO: 4283 - RNA, 20 nt, Artificial Sequence
  MKO10004283_A_Ankrd36
  gRNA
ucuucacacagaucucgugc

SEQ ID NO: 4284 - RNA, 20 nt, Artificial Sequence
  MKO10004284_A_Ankrd37
  gRNA
ggaugaccuuaagaguuugc

SEQ ID NO: 4285 - RNA, 20 nt, Artificial Sequence
  MKO10004285_A_Ankrd37
  gRNA
uucagcguaugcaauaagaa

SEQ ID NO: 4286 - RNA, 20 nt, Artificial Sequence
  MKO10004286_A_Ankrd37
  gRNA
agcaucagugaacgcaccuc

SEQ ID NO: 4287 - RNA, 20 nt, Artificial Sequence
  MKO10004287_A_Ankrd39
  gRNA
cagcacuacgccagccgcaa

SEQ ID NO: 4288 - RNA, 20 nt, Artificial Sequence
  MKO10004288_A_Ankrd39
  gRNA
ggcggcgccgcaccuuugcg

SEQ ID NO: 4289 - RNA, 20 nt, Artificial Sequence
  MKO10004289_A_Ankrd39
  gRNA
cuaggcgugcuuugcgaucc

SEQ ID NO: 4290 - RNA, 20 nt, Artificial Sequence
  MKO10004290_A_Ankrd40
  gRNA
ccugcauacgucccguucug

SEQ ID NO: 4291 - RNA, 20 nt, Artificial Sequence
  MKO10004291_A_Ankrd40
  gRNA
ggaugugaacucgcaaaaug

SEQ ID NO: 4292 - RNA, 20 nt, Artificial Sequence
  MKO10004292_A_Ankrd40
  gRNA
guguccuaccugcuacaauc

SEQ ID NO: 4293 - RNA, 20 nt, Artificial Sequence
  MKO10004293_A_Ankrd42
  gRNA
aucgaagacguggacuacaa

SEQ ID NO: 4294 - RNA, 20 nt, Artificial Sequence
  MKO10004294_A_Ankrd42
  gRNA
cggcucacauagcugcaauc

SEQ ID NO: 4295 - RNA, 20 nt, Artificial Sequence
  MKO10004295_A_Ankrd42
  gRNA
cuagcaacucaagaugaucg

SEQ ID NO: 4296 - RNA, 20 nt, Artificial Sequence
  MKO10004296_A_Ankrd44
  gRNA
gacugaagacguaaacgcac

SEQ ID NO: 4297 - RNA, 20 nt, Artificial Sequence
  MKO10004297_A_Ankrd44
  gRNA
gaaacgaaccccgcuucaug

SEQ ID NO: 4298 - RNA, 20 nt, Artificial Sequence
  MKO10004298_A_Ankrd44
  gRNA
uugcaccacgccgcucugaa

SEQ ID NO: 4299 - RNA, 20 nt, Artificial Sequence
  MKO10004299_A_Ankrd45
  gRNA
aagugacguaauuaaagccu

SEQ ID NO: 4300 - RNA, 20 nt, Artificial Sequence
  MKO10004300_A_Ankrd45
  gRNA
caaaguuuccagacggcccc

SEQ ID NO: 4301 - RNA, 20 nt, Artificial Sequence
  MKO10004301_A_Ankrd45
  gRNA
cgugccgucugaaaaacgag

SEQ ID NO: 4302 - RNA, 20 nt, Artificial Sequence
  MKO10004302_A_Ankrd46
  gRNA
aacgggccuucaccucgccg

SEQ ID NO: 4303 - RNA, 20 nt, Artificial Sequence
  MKO10004303_A_Ankrd46
  gRNA
acaggacgccuucgccuugc

SEQ ID NO: 4304 - RNA, 20 nt, Artificial Sequence
  MKO10004304_A_Ankrd46
  gRNA
cagaggcgcgcacucgaagc

SEQ ID NO: 4305 - RNA, 20 nt, Artificial Sequence
  MKO10004305_A_Ankrd49
  gRNA
ugauguaacgauucaucagg

SEQ ID NO: 4306 - RNA, 20 nt, Artificial Sequence
  MKO10004306_A_Ankrd49
  gRNA
gggucaaaaggccuuucguu

SEQ ID NO: 4307 - RNA, 20 nt, Artificial Sequence
  MKO10004307_A_Ankrd49
  gRNA
gcccaaagaagcaauuugcu

SEQ ID NO: 4308 - RNA, 20 nt, Artificial Sequence
  MKO10004308_A_Ankrd50
  gRNA
uauucccagcguugccgacg

SEQ ID NO: 4309 - RNA, 20 nt, Artificial Sequence
  MKO10004309_A_Ankrd50
  gRNA
gccacugcacagucccucgu

SEQ ID NO: 4310 - RNA, 20 nt, Artificial Sequence
  MKO10004310_A_Ankrd50
  gRNA
cacauugcagccuucgucca

SEQ ID NO: 4311 - RNA, 20 nt, Artificial Sequence
  MKO10004311_A_Ankrd52
  gRNA
ggucuguaccucguuucggg

SEQ ID NO: 4312 - RNA, 20 nt, Artificial Sequence
  MKO10004312_A_Ankrd52
  gRNA
gauggggacaucgccuacgu

SEQ ID NO: 4313 - RNA, 20 nt, Artificial Sequence
  MKO10004313_A_Ankrd52
  gRNA
aggugcuaacgucaacgcua

SEQ ID NO: 4314 - RNA, 20 nt, Artificial Sequence
  MKO10004314_A_Ankrd53
  gRNA
ggagaucauagucgacgaca

SEQ ID NO: 4315 - RNA, 20 nt, Artificial Sequence
  MKO10004315_A_Ankrd53
  gRNA
ugaccaagugcaggggcguc

SEQ ID NO: 4316 - RNA, 20 nt, Artificial Sequence
  MKO10004316_A_Ankrd53
  gRNA
ccaaagucugcaauagucga

SEQ ID NO: 4317 - RNA, 20 nt, Artificial Sequence
  MKO10004317_A_Ankrd54
  gRNA
gccuuuaucauccgcugcgc

SEQ ID NO: 4318 - RNA, 20 nt, Artificial Sequence
  MKO10004318_A_Ankrd54
  gRNA
cucaccuguuucuacgucgu

SEQ ID NO: 4319 - RNA, 20 nt, Artificial Sequence
  MKO10004319_A_Ankrd54
  gRNA
gggcaacacgccauugcacc

SEQ ID NO: 4320 - RNA, 20 nt, Artificial Sequence
  MKO10004320_A_Ankrd55
  gRNA
ggacggauccucccgaauga

SEQ ID NO: 4321 - RNA, 20 nt, Artificial Sequence
  MKO10004321_A_Ankrd55
  gRNA
cgaccuggcaaugguguauc

SEQ ID NO: 4322 - RNA, 20 nt, Artificial Sequence
  MKO10004322_A_Ankrd55
  gRNA
uccugaaaccgcgugcauca

SEQ ID NO: 4323 - RNA, 20 nt, Artificial Sequence
  MKO10004323_A_Ankrd60
  gRNA
gggucgucccccugccguuu

SEQ ID NO: 4324 - RNA, 20 nt, Artificial Sequence
  MKO10004324_A_Ankrd60
  gRNA
cgggcgcgcguccgccgaaa

SEQ ID NO: 4325 - RNA, 20 nt, Artificial Sequence
  MKO10004325_A_Ankrd60
  gRNA
uuacgaugguuggacggaac

SEQ ID NO: 4326 - RNA, 20 nt, Artificial Sequence
  MKO10004326_A_Ankrd61
  gRNA
ugcgguacucggcggccaga

SEQ ID NO: 4327 - RNA, 20 nt, Artificial Sequence
  MKO10004327_A_Ankrd61
  gRNA
auaagugcgguaaaguaguc

SEQ ID NO: 4328 - RNA, 20 nt, Artificial Sequence
  MKO10004328_A_Ankrd61
  gRNA
agguaacuuaccuuacuucu

SEQ ID NO: 4329 - RNA, 20 nt, Artificial Sequence
  MKO10004329_A_Ankrd63
  gRNA
gcgcgguaaacgacggggac

SEQ ID NO: 4330 - RNA, 20 nt, Artificial Sequence
  MKO10004330_A_Ankrd63
  gRNA
gacgccgcuuaugguggccg

SEQ ID NO: 4331 - RNA, 20 nt, Artificial Sequence
  MKO10004331_A_Ankrd63
  gRNA
gcaguucagcggcgauccgg

SEQ ID NO: 4332 - RNA, 20 nt, Artificial Sequence
  MKO10004332_A_Ankrd66
  gRNA
cgucaagcaacagcccucuc

SEQ ID NO: 4333 - RNA, 20 nt, Artificial Sequence
  MKO10004333_A_Ankrd66
  gRNA
gagggcuguugcuugacgag

SEQ ID NO: 4334 - RNA, 20 nt, Artificial Sequence
  MKO10004334_A_Ankrd66
  gRNA
cugaucgcagcccagugaag

SEQ ID NO: 4335 - RNA, 20 nt, Artificial Sequence
  MKO10004335_A_Ankrd6
  gRNA
uccggcuuuaacgagcagcu

SEQ ID NO: 4336 - RNA, 20 nt, Artificial Sequence
  MKO10004336_A_Ankrd6
  gRNA
agauccucacagcgcuuauc

SEQ ID NO: 4337 - RNA, 20 nt, Artificial Sequence
  MKO10004337_A_Ankrd6
  gRNA
cuugcaccucgcugccaaua

SEQ ID NO: 4338 - RNA, 20 nt, Artificial Sequence
  MKO10004338_A_Ankrd7
  gRNA
ucuuuaagugcuuaucucga

SEQ ID NO: 4339 - RNA, 20 nt, Artificial Sequence
  MKO10004339_A_Ankrd7
  gRNA
gauauccuccaccuauggac

SEQ ID NO: 4340 - RNA, 20 nt, Artificial Sequence
  MKO10004340_A_Ankrd7
  gRNA
auggaacacaccuuaaucaa

SEQ ID NO: 4341 - RNA, 20 nt, Artificial Sequence
  MKO10004341_A_Ankrd9
  gRNA
ggcggugcgcuacaaccgcg

SEQ ID NO: 4342 - RNA, 20 nt, Artificial Sequence
  MKO10004342_A_Ankrd9
  gRNA
ggcgagugcacaccgcggga

SEQ ID NO: 4343 - RNA, 20 nt, Artificial Sequence
  MKO10004343_A_Ankrd9
  gRNA
cgcugcggccuauucgccuu

SEQ ID NO: 4344 - RNA, 20 nt, Artificial Sequence
  MKO10004344_A_Anks1b
  gRNA
agcgauccagcuccuuccaa

SEQ ID NO: 4345 - RNA, 20 nt, Artificial Sequence
  MKO10004345_A_Anks1b
  gRNA
augguagccaucauggccga

SEQ ID NO: 4346 - RNA, 20 nt, Artificial Sequence
  MKO10004346_A_Anks1b
  gRNA
aucccaccucuguagccgag

SEQ ID NO: 4347 - RNA, 20 nt, Artificial Sequence
  MKO10004347_A_Anks1
  gRNA
accaacguugcugacucgaa

SEQ ID NO: 4348 - RNA, 20 nt, Artificial Sequence
  MKO10004348_A_Anks1
  gRNA
ucagcgcgucguuccucaga

SEQ ID NO: 4349 - RNA, 20 nt, Artificial Sequence
  MKO10004349_A_Anks1
  gRNA
gagccuucacgaccuccgug

SEQ ID NO: 4350 - RNA, 20 nt, Artificial Sequence
  MKO10004350_A_Anks3
  gRNA
caaucaccucacguuggcau

SEQ ID NO: 4351 - RNA, 20 nt, Artificial Sequence
  MKO10004351_A_Anks3
  gRNA
guggagccaaugccaacgug

SEQ ID NO: 4352 - RNA, 20 nt, Artificial Sequence
  MKO10004352_A_Anks3
  gRNA
agguaccugggcuacgguag

SEQ ID NO: 4353 - RNA, 20 nt, Artificial Sequence
  MKO10004353_A_Anks4b
  gRNA
ugagucuauucucaaccguc

SEQ ID NO: 4354 - RNA, 20 nt, Artificial Sequence
  MKO10004354_A_Anks4b
  gRNA
ugagagauucagaucacgcu

SEQ ID NO: 4355 - RNA, 20 nt, Artificial Sequence
  MKO10004355_A_Anks4b
  gRNA
agccuaccacggcaaccucg

SEQ ID NO: 4356 - RNA, 20 nt, Artificial Sequence
  MKO10004356_A_Anks6
  gRNA
cggggcgaccccacugaugc

SEQ ID NO: 4357 - RNA, 20 nt, Artificial Sequence
  MKO10004357_A_Anks6
  gRNA
ucgccccguccccguugacc

SEQ ID NO: 4358 - RNA, 20 nt, Artificial Sequence
  MKO10004358_A_Anks6
  gRNA
uugcucucgaccgcaaguac

SEQ ID NO: 4359 - RNA, 20 nt, Artificial Sequence
  MKO10004359_A_Ankzf1
  gRNA
uagaauccggggggccgguu

SEQ ID NO: 4360 - RNA, 20 nt, Artificial Sequence
  MKO10004360_A_Ankzf1
  gRNA
cccccggauucuacccacau

SEQ ID NO: 4361 - RNA, 20 nt, Artificial Sequence
  MKO10004361_A_Ankzf1
  gRNA
caugagcaccacguaguauc

SEQ ID NO: 4362 - RNA, 20 nt, Artificial Sequence
  MKO10004362_A_Ank
  gRNA
agaauacgccagcccguagc

SEQ ID NO: 4363 - RNA, 20 nt, Artificial Sequence
  MKO10004363_A_Ank
  gRNA
uccacgacaucauccccgac

SEQ ID NO: 4364 - RNA, 20 nt, Artificial Sequence
  MKO10004364_A_Ank
  gRNA
gagccuuaccuaucagggug

SEQ ID NO: 4365 - RNA, 20 nt, Artificial Sequence
  MKO10004365_A_Anln
  gRNA
uugcugagcagcggcgccau

SEQ ID NO: 4366 - RNA, 20 nt, Artificial Sequence
  MKO10004366_A_Anln
  gRNA
gcagaucucgcuacugccgu

SEQ ID NO: 4367 - RNA, 20 nt, Artificial Sequence
  MKO10004367_A_Anln
  gRNA
agucgcuuaccuucgccccc

SEQ ID NO: 4368 - RNA, 20 nt, Artificial Sequence
  MKO10004368_A_Ano10
  gRNA
aauguacggacgcugccaug

SEQ ID NO: 4369 - RNA, 20 nt, Artificial Sequence
  MKO10004369_A_Ano10
  gRNA
gucucuuguagcucgaguag

SEQ ID NO: 4370 - RNA, 20 nt, Artificial Sequence
  MKO10004370_A_Ano10
  gRNA
gugccaacaugaccuaucgc

SEQ ID NO: 4371 - RNA, 20 nt, Artificial Sequence
  MKO10004371_A_Ano1
  gRNA
cgagaaguacucgacgcucc

SEQ ID NO: 4372 - RNA, 20 nt, Artificial Sequence
  MKO10004372_A_Ano1
  gRNA
gaacucaccgugcccucgga

SEQ ID NO: 4373 - RNA, 20 nt, Artificial Sequence
  MKO10004373_A_Ano1
  gRNA
cccgacgccgaaugcaagua

SEQ ID NO: 4374 - RNA, 20 nt, Artificial Sequence
  MKO10004374_A_Ano2
  gRNA
uuguccggauccacgcccca

SEQ ID NO: 4375 - RNA, 20 nt, Artificial Sequence
  MKO10004375_A_Ano2
  gRNA
ugcacuuucacgacaaccag

SEQ ID NO: 4376 - RNA, 20 nt, Artificial Sequence
  MKO10004376_A_Ano2
  gRNA
guccgagaacucagccgacg

SEQ ID NO: 4377 - RNA, 20 nt, Artificial Sequence
  MKO10004377_A_Ano3
  gRNA
aaagcgaauugauuacaucc

SEQ ID NO: 4378 - RNA, 20 nt, Artificial Sequence
  MKO10004378_A_Ano3
  gRNA
uggcauguucagauucaucc

SEQ ID NO: 4379 - RNA, 20 nt, Artificial Sequence
  MKO10004379_A_Ano3
  gRNA
augaguuacauagcaucuag

SEQ ID NO: 4380 - RNA, 20 nt, Artificial Sequence
  MKO10004380_A_Ano4
  gRNA
ggcgacgacgugacccuggg

SEQ ID NO: 4381 - RNA, 20 nt, Artificial Sequence
  MKO10004381_A_Ano4
  gRNA
uugccacacuucgccguuga

SEQ ID NO: 4382 - RNA, 20 nt, Artificial Sequence
  MKO10004382_A_Ano4
  gRNA
aaaucugacgagcacuucgg

SEQ ID NO: 4383 - RNA, 20 nt, Artificial Sequence
  MKO10004383_A_Ano5
  gRNA
acaggacaaagucgaucugc

SEQ ID NO: 4384 - RNA, 20 nt, Artificial Sequence
  MKO10004384_A_Ano5
  gRNA
cgacuuuguccuguccuacg

SEQ ID NO: 4385 - RNA, 20 nt, Artificial Sequence
  MKO10004385_A_Ano5
  gRNA
uucgacuuaccucauucugu

SEQ ID NO: 4386 - RNA, 20 nt, Artificial Sequence
  MKO10004386_A_Ano6
  gRNA
ucguaaaagugcacgcgccc

SEQ ID NO: 4387 - RNA, 20 nt, Artificial Sequence
  MKO10004387_A_Ano6
  gRNA
uggacguacaaugcggcuuc

SEQ ID NO: 4388 - RNA, 20 nt, Artificial Sequence
  MKO10004388_A_Ano6
  gRNA
gucgauucgccucuggccau

SEQ ID NO: 4389 - RNA, 20 nt, Artificial Sequence
  MKO10004389_A_Ano7
  gRNA
uaauacucggggggcguguc

SEQ ID NO: 4390 - RNA, 20 nt, Artificial Sequence
  MKO10004390_A_Ano7
  gRNA
acauccuccuccgcgcaccc

SEQ ID NO: 4391 - RNA, 20 nt, Artificial Sequence
  MKO10004391_A_Ano7
  gRNA
gcgccugaagcugccucuac

SEQ ID NO: 4392 - RNA, 20 nt, Artificial Sequence
  MKO10004392_A_Ano8
  gRNA
gcuacgcuucuucacaucgc

SEQ ID NO: 4393 - RNA, 20 nt, Artificial Sequence
  MKO10004393_A_Ano8
  gRNA
uugucaccgccacauacgag

SEQ ID NO: 4394 - RNA, 20 nt, Artificial Sequence
  MKO10004394_A_Ano8
  gRNA
ucugcacaacgugcgcuucu

SEQ ID NO: 4395 - RNA, 20 nt, Artificial Sequence
  MKO10004395_A_Ano9
  gRNA
gugacgucauugacaaguac

SEQ ID NO: 4396 - RNA, 20 nt, Artificial Sequence
  MKO10004396_A_Ano9
  gRNA
guugaagcucugcucgucuc

SEQ ID NO: 4397 - RNA, 20 nt, Artificial Sequence
  MKO10004397_A_Ano9
  gRNA
aguggaagccauugcucucg

SEQ ID NO: 4398 - RNA, 20 nt, Artificial Sequence
  MKO10004398_A_Anp32a
  gRNA
ucucagcacaauagagccgc

SEQ ID NO: 4399 - RNA, 20 nt, Artificial Sequence
  MKO10004399_A_Anp32a
  gRNA
ggcccccgacuccgauguug

SEQ ID NO: 4400 - RNA, 20 nt, Artificial Sequence
  MKO10004400_A_Anp32a
  gRNA
uguaccucgauggcuaugac

SEQ ID NO: 4401 - RNA, 20 nt, Artificial Sequence
  MKO10004401_A_Anp32b
  gRNA
gaggaagcccccgacucaga

SEQ ID NO: 4402 - RNA, 20 nt, Artificial Sequence
  MKO10004402_A_Anp32b
  gRNA
accacucaccaacggcucca

SEQ ID NO: 4403 - RNA, 20 nt, Artificial Sequence
  MKO10004403_A_Anp32b
  gRNA
acagguucgagaacuugucu

SEQ ID NO: 4404 - RNA, 20 nt, Artificial Sequence
  MKO10004404_A_Anp32e
  gRNA
ccuccuggucgaauccgucc

SEQ ID NO: 4405 - RNA, 20 nt, Artificial Sequence
  MKO10004405_A_Anp32e
  gRNA
ggacaacgaagcucccgacu

SEQ ID NO: 4406 - RNA, 20 nt, Artificial Sequence
  MKO10004406_A_Anp32e
  gRNA
cccaccggaaggcuaugaag

SEQ ID NO: 4407 - RNA, 20 nt, Artificial Sequence
  MKO10004407_A_Anpep
  gRNA
uuugaacucgcucacgaugu

SEQ ID NO: 4408 - RNA, 20 nt, Artificial Sequence
  MKO10004408_A_Anpep
  gRNA
gauuacgcacugaacguuac

SEQ ID NO: 4409 - RNA, 20 nt, Artificial Sequence
  MKO10004409_A_Anpep
  gRNA
ucggcccagugccauugaug

SEQ ID NO: 4410 - RNA, 20 nt, Artificial Sequence
  MKO10004410_A_Antxr1
  gRNA
ggagacacuuacaugcacga

SEQ ID NO: 4411 - RNA, 20 nt, Artificial Sequence
  MKO10004411_A_Antxr1
  gRNA
cuacuacuucguggagcagu

SEQ ID NO: 4412 - RNA, 20 nt, Artificial Sequence
  MKO10004412_A_Antxr1
  gRNA
uucagggaacagauccgaca

SEQ ID NO: 4413 - RNA, 20 nt, Artificial Sequence
  MKO10004413_A_Antxr2
  gRNA
accucguucucugcauaaga

SEQ ID NO: 4414 - RNA, 20 nt, Artificial Sequence
  MKO10004414_A_Antxr2
  gRNA
accaucuuaugcagagaacg

SEQ ID NO: 4415 - RNA, 20 nt, Artificial Sequence
  MKO10004415_A_Antxr2
  gRNA
acuaaccugucuccaguuaa

SEQ ID NO: 4416 - RNA, 20 nt, Artificial Sequence
  MKO10004416_A_Antxrl
  gRNA
augauggagauccgcagguu

SEQ ID NO: 4417 - RNA, 20 nt, Artificial Sequence
  MKO10004417_A_Antxrl
  gRNA
cuauguucuuaagcacgaga

SEQ ID NO: 4418 - RNA, 20 nt, Artificial Sequence
  MKO10004418_A_Antxrl
  gRNA
acagauccgaaaaucuaccu

SEQ ID NO: 4419 - RNA, 20 nt, Artificial Sequence
  MKO10004419_A_Anxa10
  gRNA
ccggccauacaugcucugau

SEQ ID NO: 4420 - RNA, 20 nt, Artificial Sequence
  MKO10004420_A_Anxa10
  gRNA
ggagugcuccgccuagcauu

SEQ ID NO: 4421 - RNA, 20 nt, Artificial Sequence
  MKO10004421_A_Anxa10
  gRNA
uccaucaugggauugaaauu

SEQ ID NO: 4422 - RNA, 20 nt, Artificial Sequence
  MKO10004422_A_Anxa11
  gRNA
cuacguuauccagcccgaua

SEQ ID NO: 4423 - RNA, 20 nt, Artificial Sequence
  MKO10004423_A_Anxa11
  gRNA
guacuagaucccgaguaucc

SEQ ID NO: 4424 - RNA, 20 nt, Artificial Sequence
  MKO10004424_A_Anxa11
  gRNA
cuugccauaggccgucuuga

SEQ ID NO: 4425 - RNA, 20 nt, Artificial Sequence
  MKO10004425_A_Anxa13
  gRNA
ggcccaaugaguacgccgca

SEQ ID NO: 4426 - RNA, 20 nt, Artificial Sequence
  MKO10004426_A_Anxa13
  gRNA
acucauugggccgauccaga

SEQ ID NO: 4427 - RNA, 20 nt, Artificial Sequence
  MKO10004427_A_Anxa13
  gRNA
ucauugaagucuuauccagc

SEQ ID NO: 4428 - RNA, 20 nt, Artificial Sequence
  MKO10004428_A_Anxa1
  gRNA
uuugaugcagaugaacuccg

SEQ ID NO: 4429 - RNA, 20 nt, Artificial Sequence
  MKO10004429_A_Anxa1
  gRNA
uccauucuccuguaaguacg

SEQ ID NO: 4430 - RNA, 20 nt, Artificial Sequence
  MKO10004430_A_Anxa1
  gRNA
gaucugcuggcgcugagcau

SEQ ID NO: 4431 - RNA, 20 nt, Artificial Sequence
  MKO10004431_A_Anxa2
  gRNA
ggcccaaaaucaccgucucc

SEQ ID NO: 4432 - RNA, 20 nt, Artificial Sequence
  MKO10004432_A_Anxa2
  gRNA
guaggguuugacugacccgu

SEQ ID NO: 4433 - RNA, 20 nt, Artificial Sequence
  MKO10004433_A_Anxa2
  gRNA
ucuacacccccaagugccua

SEQ ID NO: 4434 - RNA, 20 nt, Artificial Sequence
  MKO10004434_A_Anxa3
  gRNA
gcuauccggaaagcgaucag

SEQ ID NO: 4435 - RNA, 20 nt, Artificial Sequence
  MKO10004435_A_Anxa3
  gRNA
ccaccaugacgugcucgaag

SEQ ID NO: 4436 - RNA, 20 nt, Artificial Sequence
  MKO10004436_A_Anxa3
  gRNA
uggccacuucgagcacguca

SEQ ID NO: 4437 - RNA, 20 nt, Artificial Sequence
  MKO10004437_A_Anxa4
  gRNA
acuuacgcugcugguauguc

SEQ ID NO: 4438 - RNA, 20 nt, Artificial Sequence
  MKO10004438_A_Anxa4
  gRNA
guaggcuaagauuccgauaa

SEQ ID NO: 4439 - RNA, 20 nt, Artificial Sequence
  MKO10004439_A_Anxa4
  gRNA
uugauucgacggaucuccuc

SEQ ID NO: 4440 - RNA, 20 nt, Artificial Sequence
  MKO10004440_A_Anxa5
  gRNA
cauugcuucgggaugucaac

SEQ ID NO: 4441 - RNA, 20 nt, Artificial Sequence
  MKO10004441_A_Anxa5
  gRNA
aucaauuucagguaccgaug

SEQ ID NO: 4442 - RNA, 20 nt, Artificial Sequence
  MKO10004442_A_Anxa5
  gRNA
ugaccgagauuauugcuuca

SEQ ID NO: 4443 - RNA, 20 nt, Artificial Sequence
  MKO10004443_A_Anxa6
  gRNA
cauacuucaagucuucgaug

SEQ ID NO: 4444 - RNA, 20 nt, Artificial Sequence
  MKO10004444_A_Anxa6
  gRNA
ccacagggugccauguaccg

SEQ ID NO: 4445 - RNA, 20 nt, Artificial Sequence
  MKO10004445_A_Anxa6
  gRNA
ggcugauagugaaccugaug

SEQ ID NO: 4446 - RNA, 20 nt, Artificial Sequence
  MKO10004446_A_Anxa7
  gRNA
guacggguacugacccgcag

SEQ ID NO: 4447 - RNA, 20 nt, Artificial Sequence
  MKO10004447_A_Anxa7
  gRNA
ucagcccgcuucgaugacuc

SEQ ID NO: 4448 - RNA, 20 nt, Artificial Sequence
  MKO10004448_A_Anxa7
  gRNA
ggucaguacccguacccuag

SEQ ID NO: 4449 - RNA, 20 nt, Artificial Sequence
  MKO10004449_A_Anxa8
  gRNA
guacccgccauacagcuacg

SEQ ID NO: 4450 - RNA, 20 nt, Artificial Sequence
  MKO10004450_A_Anxa8
  gRNA
caaauuugagagacucaucg

SEQ ID NO: 4451 - RNA, 20 nt, Artificial Sequence
  MKO10004451_A_Anxa8
  gRNA
uaacucaccaauccccuuca

SEQ ID NO: 4452 - RNA, 20 nt, Artificial Sequence
  MKO10004452_A_Anxa9
  gRNA
cuuucaagagcgcaccaaac

SEQ ID NO: 4453 - RNA, 20 nt, Artificial Sequence
  MKO10004453_A_Anxa9
  gRNA
cuguuuggugcgcucuugaa

SEQ ID NO: 4454 - RNA, 20 nt, Artificial Sequence
  MKO10004454_A_Anxa9
  gRNA
uggcaaucuggagaaaaucg

SEQ ID NO: 4455 - RNA, 20 nt, Artificial Sequence
  MKO10004455_A_Aoah
  gRNA
agagucucuccaucgccacc

SEQ ID NO: 4456 - RNA, 20 nt, Artificial Sequence
  MKO10004456_A_Aoah
  gRNA
agaaggcgagacaaguccuc

SEQ ID NO: 4457 - RNA, 20 nt, Artificial Sequence
  MKO10004457_A_Aoah
  gRNA
aguucacaacucuucagucc

SEQ ID NO: 4458 - RNA, 20 nt, Artificial Sequence
  MKO10004458_A_Aoc1
  gRNA
uuuacggauguagcgccgcg

SEQ ID NO: 4459 - RNA, 20 nt, Artificial Sequence
  MKO10004459_A_Aoc1
  gRNA
cgccuaagggguaccccugu

SEQ ID NO: 4460 - RNA, 20 nt, Artificial Sequence
  MKO10004460_A_Aoc1
  gRNA
gucucaaccauguucagcgc

SEQ ID NO: 4461 - RNA, 20 nt, Artificial Sequence
  MKO10004461_A_Aoc2
  gRNA
ucuggauucgguacccucgc

SEQ ID NO: 4462 - RNA, 20 nt, Artificial Sequence
  MKO10004462_A_Aoc2
  gRNA
agguagcucgaucgccugca

SEQ ID NO: 4463 - RNA, 20 nt, Artificial Sequence
  MKO10004463_A_Aoc2
  gRNA
cguguacuuugagagggacc

SEQ ID NO: 4464 - RNA, 20 nt, Artificial Sequence
  MKO10004464_A_Aoc3
  gRNA
aaagcuaccguccacguagc

SEQ ID NO: 4465 - RNA, 20 nt, Artificial Sequence
  MKO10004465_A_Aoc3
  gRNA
ucuucaaccagaacgacccg

SEQ ID NO: 4466 - RNA, 20 nt, Artificial Sequence
  MKO10004466_A_Aoc3
  gRNA
ugcucaauuacgacuacaua

SEQ ID NO: 4467 - RNA, 20 nt, Artificial Sequence
  MKO10004467_A_Aox1
  gRNA
aucaguuaacugaucuagag

SEQ ID NO: 4468 - RNA, 20 nt, Artificial Sequence
  MKO10004468_A_Aox1
  gRNA
guugccuaagccuucuaccg

SEQ ID NO: 4469 - RNA, 20 nt, Artificial Sequence
  MKO10004469_A_Aox1
  gRNA
guuccugagcagugcguaca

SEQ ID NO: 4470 - RNA, 20 nt, Artificial Sequence
  MKO10004470_A_Aox2
  gRNA
gagaggaucgccaagagcca

SEQ ID NO: 4471 - RNA, 20 nt, Artificial Sequence
  MKO10004471_A_Aox2
  gRNA
gugugcuuaccugcacgggg

SEQ ID NO: 4472 - RNA, 20 nt, Artificial Sequence
  MKO10004472_A_Aox2
  gRNA
acaaagacacuucuccguca

SEQ ID NO: 4473 - RNA, 20 nt, Artificial Sequence
  MKO10004473_A_Aox3
  gRNA
aaccaggauacacccugucc

SEQ ID NO: 4474 - RNA, 20 nt, Artificial Sequence
  MKO10004474_A_Aox3
  gRNA
ccucucuccaggucaccgag

SEQ ID NO: 4475 - RNA, 20 nt, Artificial Sequence
  MKO10004475_A_Aox3
  gRNA
gggcagguaccugauccuuu

SEQ ID NO: 4476 - RNA, 20 nt, Artificial Sequence
  MKO10004476_A_Aox4
  gRNA
uuaaaggauacgaacuuucc

SEQ ID NO: 4477 - RNA, 20 nt, Artificial Sequence
  MKO10004477_A_Aox4
  gRNA
gaacgacuugccaaguguca

SEQ ID NO: 4478 - RNA, 20 nt, Artificial Sequence
  MKO10004478_A_Aox4
  gRNA
guguggggagcaucaaaaag

SEQ ID NO: 4479 - RNA, 20 nt, Artificial Sequence
  MKO10004479_A_Ap1ar
  gRNA
gcgauuucgucuucagugag

SEQ ID NO: 4480 - RNA, 20 nt, Artificial Sequence
  MKO10004480_A_Ap1ar
  gRNA
agacgaaaucgcugacuuac

SEQ ID NO: 4481 - RNA, 20 nt, Artificial Sequence
  MKO10004481_A_Ap1ar
  gRNA
uuaccucaucacucuccacg

SEQ ID NO: 4482 - RNA, 20 nt, Artificial Sequence
  MKO10004482_A_Ap1b1
  gRNA
gccgcugucuugcgcacaua

SEQ ID NO: 4483 - RNA, 20 nt, Artificial Sequence
  MKO10004483_A_Ap1b1
  gRNA
caagucaagcagguugcuac

SEQ ID NO: 4484 - RNA, 20 nt, Artificial Sequence
  MKO10004484_A_Ap1b1
  gRNA
aguacuugugugaaccacuc

SEQ ID NO: 4485 - RNA, 20 nt, Artificial Sequence
  MKO10004485_A_Ap1g1
  gRNA
ucauagcacgcaguuugugc

SEQ ID NO: 4486 - RNA, 20 nt, Artificial Sequence
  MKO10004486_A_Ap1g1
  gRNA
ugugugcuguucacgucauc

SEQ ID NO: 4487 - RNA, 20 nt, Artificial Sequence
  MKO10004487_A_Ap1g1
  gRNA
acuuuguacccucggcugca

SEQ ID NO: 4488 - RNA, 20 nt, Artificial Sequence
  MKO10004488_A_Ap1g2
  gRNA
cugcuucgugagcgucauca

SEQ ID NO: 4489 - RNA, 20 nt, Artificial Sequence
  MKO10004489_A_Ap1g2
  gRNA
ccaccuugcgaaagugccug

SEQ ID NO: 4490 - RNA, 20 nt, Artificial Sequence
  MKO10004490_A_Ap1g2
  gRNA
ucucaccuucuuccgcacau

SEQ ID NO: 4491 - RNA, 20 nt, Artificial Sequence
  MKO10004491_A_Ap1m1
  gRNA
augguggcguucguuucaug

SEQ ID NO: 4492 - RNA, 20 nt, Artificial Sequence
  MKO10004492_A_Ap1m1
  gRNA
acaugaaacgaacgccacca

SEQ ID NO: 4493 - RNA, 20 nt, Artificial Sequence
  MKO10004493_A_Ap1m1
  gRNA
cuugaugccuucugaacgcc

SEQ ID NO: 4494 - RNA, 20 nt, Artificial Sequence
  MKO10004494_A_Ap1m2
  gRNA
acacgaugacgaaguugucc

SEQ ID NO: 4495 - RNA, 20 nt, Artificial Sequence
  MKO10004495_A_Ap1m2
  gRNA
cgucaucguguacgagcugc

SEQ ID NO: 4496 - RNA, 20 nt, Artificial Sequence
  MKO10004496_A_Ap1m2
  gRNA
gaagaacgcuaaugccucuc

SEQ ID NO: 4497 - RNA, 20 nt, Artificial Sequence
  MKO10004497_A_Ap1s1
  gRNA
ugagucgccgcgcagugucc

SEQ ID NO: 4498 - RNA, 20 nt, Artificial Sequence
  MKO10004498_A_Ap1s1
  gRNA
uauuucugcugcgccaucga

SEQ ID NO: 4499 - RNA, 20 nt, Artificial Sequence
  MKO10004499_A_Ap1s1
  gRNA
cacccaucagaaacucgucc

SEQ ID NO: 4500 - RNA, 20 nt, Artificial Sequence
  MKO10004500_A_Ap1s2
  gRNA
caaguaauuccacguaacga

SEQ ID NO: 4501 - RNA, 20 nt, Artificial Sequence
  MKO10004501_A_Ap1s2
  gRNA
cuuggguuuccgugcuaaaa

SEQ ID NO: 4502 - RNA, 20 nt, Artificial Sequence
  MKO10004502_A_Ap1s2
  gRNA
ucugcagucgaagcuuuccc

SEQ ID NO: 4503 - RNA, 20 nt, Artificial Sequence
  MKO10004503_A_Ap1s3
  gRNA
agacucugauauguuacaag

SEQ ID NO: 4504 - RNA, 20 nt, Artificial Sequence
  MKO10004504_A_Ap1s3
  gRNA
uucuuaccaggucugugagc

SEQ ID NO: 4505 - RNA, 20 nt, Artificial Sequence
  MKO10004505_A_Ap1s3
  gRNA
guacaccacacucccugaca

SEQ ID NO: 4506 - RNA, 20 nt, Artificial Sequence
  MKO10004506_A_Ap2a1
  gRNA
cuugcacuguaucgcuaacg

SEQ ID NO: 4507 - RNA, 20 nt, Artificial Sequence
  MKO10004507_A_Ap2a1
  gRNA
ugcagacauuccccgaaucc

SEQ ID NO: 4508 - RNA, 20 nt, Artificial Sequence
  MKO10004508_A_Ap2a1
  gRNA
cccacgcaugccaucgccuu

SEQ ID NO: 4509 - RNA, 20 nt, Artificial Sequence
  MKO10004509_A_Ap2a2
  gRNA
agggcgagacccauaaacgu

SEQ ID NO: 4510 - RNA, 20 nt, Artificial Sequence
  MKO10004510_A_Ap2a2
  gRNA
cuuggggaucucuccggcga

SEQ ID NO: 4511 - RNA, 20 nt, Artificial Sequence
  MKO10004511_A_Ap2a2
  gRNA
acgagauguccagucgccca

SEQ ID NO: 4512 - RNA, 20 nt, Artificial Sequence
  MKO10004512_A_Ap2b1
  gRNA
agaccccuauguucggaaaa

SEQ ID NO: 4513 - RNA, 20 nt, Artificial Sequence
  MKO10004513_A_Ap2b1
  gRNA
accccuccgcaagugcuuga

SEQ ID NO: 4514 - RNA, 20 nt, Artificial Sequence
  MKO10004514_A_Ap2b1
  gRNA
ccccuacucacccuucuuau

SEQ ID NO: 4515 - RNA, 20 nt, Artificial Sequence
  MKO10004515_A_Ap2m1
  gRNA
uucccuuaggaggaaugcug

SEQ ID NO: 4516 - RNA, 20 nt, Artificial Sequence
  MKO10004516_A_Ap2m1
  gRNA
uacccuguggggacauaagc

SEQ ID NO: 4517 - RNA, 20 nt, Artificial Sequence
  MKO10004517_A_Ap2m1
  gRNA
uuuacagagauucuggacuu

SEQ ID NO: 4518 - RNA, 20 nt, Artificial Sequence
  MKO10004518_A_Ap2s1
  gRNA
gacucacuucuacgaaguug

SEQ ID NO: 4519 - RNA, 20 nt, Artificial Sequence
  MKO10004519_A_Ap2s1
  gRNA
ugcacgccguggucaccguc

SEQ ID NO: 4520 - RNA, 20 nt, Artificial Sequence
  MKO10004520_A_Ap2s1
  gRNA
gcaagacgcgccuggccaag

SEQ ID NO: 4521 - RNA, 20 nt, Artificial Sequence
  MKO10004521_A_Ap3b1
  gRNA
gauuuaccuucaaagcucgc

SEQ ID NO: 4522 - RNA, 20 nt, Artificial Sequence
  MKO10004522_A_Ap3b1
  gRNA
gaugcuaugaagcgaauugu

SEQ ID NO: 4523 - RNA, 20 nt, Artificial Sequence
  MKO10004523_A_Ap3b1
  gRNA
ucgcuucauagcaucuagcu

SEQ ID NO: 4524 - RNA, 20 nt, Artificial Sequence
  MKO10004524_A_Ap3b2
  gRNA
ugauccgugccagugcgcuc

SEQ ID NO: 4525 - RNA, 20 nt, Artificial Sequence
  MKO10004525_A_Ap3b2
  gRNA
cggacaugucacccuacguu

SEQ ID NO: 4526 - RNA, 20 nt, Artificial Sequence
  MKO10004526_A_Ap3b2
  gRNA
gaagcuugucuacguguauc

SEQ ID NO: 4527 - RNA, 20 nt, Artificial Sequence
  MKO10004527_A_Ap3d1
  gRNA
cagggccuaccuuucggauc

SEQ ID NO: 4528 - RNA, 20 nt, Artificial Sequence
  MKO10004528_A_Ap3d1
  gRNA
gugccacuccagugucguac

SEQ ID NO: 4529 - RNA, 20 nt, Artificial Sequence
  MKO10004529_A_Ap3d1
  gRNA
gugcauugacgagaucaagc

SEQ ID NO: 4530 - RNA, 20 nt, Artificial Sequence
  MKO10004530_A_Ap3m1
  gRNA
guuagacaauggauucccac

SEQ ID NO: 4531 - RNA, 20 nt, Artificial Sequence
  MKO10004531_A_Ap3m1
  gRNA
cugacgucaucuaguagccu

SEQ ID NO: 4532 - RNA, 20 nt, Artificial Sequence
  MKO10004532_A_Ap3m1
  gRNA
uuucuaggcaguaguaaugu

SEQ ID NO: 4533 - RNA, 20 nt, Artificial Sequence
  MKO10004533_A_Ap3m2
  gRNA
agcaggcggaaguugccguc

SEQ ID NO: 4534 - RNA, 20 nt, Artificial Sequence
  MKO10004534_A_Ap3m2
  gRNA
caacgaggccuauuucgaug

SEQ ID NO: 4535 - RNA, 20 nt, Artificial Sequence
  MKO10004535_A_Ap3m2
  gRNA
uucaccccuguccgucgcca

SEQ ID NO: 4536 - RNA, 20 nt, Artificial Sequence
  MKO10004536_A_Ap3s1
  gRNA
aaaacaguaccuugucuaca

SEQ ID NO: 4537 - RNA, 20 nt, Artificial Sequence
  MKO10004537_A_Ap3s1
  gRNA
uugucauuuagauuaauugg

SEQ ID NO: 4538 - RNA, 20 nt, Artificial Sequence
  MKO10004538_A_Ap3s1
  gRNA
guacuuacaauccuccuucu

SEQ ID NO: 4539 - RNA, 20 nt, Artificial Sequence
  MKO10004539_A_Ap3s2
  gRNA
gaggaccuaccuuauccaua

SEQ ID NO: 4540 - RNA, 20 nt, Artificial Sequence
  MKO10004540_A_Ap3s2
  gRNA
agauguugucaucucgcuug

SEQ ID NO: 4541 - RNA, 20 nt, Artificial Sequence
  MKO10004541_A_Ap3s2
  gRNA
cuaggugcacuacauccugc

SEQ ID NO: 4542 - RNA, 20 nt, Artificial Sequence
  MKO10004542_A_Ap4b1
  gRNA
ggugauaccuaauaacucgc

SEQ ID NO: 4543 - RNA, 20 nt, Artificial Sequence
  MKO10004543_A_Ap4b1
  gRNA
ucacgcagaccguuaacaac

SEQ ID NO: 4544 - RNA, 20 nt, Artificial Sequence
  MKO10004544_A_Ap4b1
  gRNA
agugccaguccucgaaccau

SEQ ID NO: 4545 - RNA, 20 nt, Artificial Sequence
  MKO10004545_A_Ap4e1
  gRNA
acacguaccagugucguggu

SEQ ID NO: 4546 - RNA, 20 nt, Artificial Sequence
  MKO10004546_A_Ap4e1
  gRNA
uucugcuccgaccacgacac

SEQ ID NO: 4547 - RNA, 20 nt, Artificial Sequence
  MKO10004547_A_Ap4e1
  gRNA
acggcuggaaucauuucucg

SEQ ID NO: 4548 - RNA, 20 nt, Artificial Sequence
  MKO10004548_A_Ap4m1
  gRNA
aagcgccacauugcgugaga

SEQ ID NO: 4549 - RNA, 20 nt, Artificial Sequence
  MKO10004549_A_Ap4m1
  gRNA
ggcgcuugucuacgaacucc

SEQ ID NO: 4550 - RNA, 20 nt, Artificial Sequence
  MKO10004550_A_Ap4m1
  gRNA
uggcuaguccgcggggacag

SEQ ID NO: 4551 - RNA, 20 nt, Artificial Sequence
  MKO10004551_A_Ap4s1
  gRNA
agauggguacuucagccgag

SEQ ID NO: 4552 - RNA, 20 nt, Artificial Sequence
  MKO10004552_A_Ap4s1
  gRNA
caaagagagcugcauauugc

SEQ ID NO: 4553 - RNA, 20 nt, Artificial Sequence
  MKO10004553_A_Ap4s1
  gRNA
gcugauucuugacaagcugu

SEQ ID NO: 4554 - RNA, 20 nt, Artificial Sequence
  MKO10004554_A_Ap5b1
  gRNA
ugcguuucuucgaugagcuc

SEQ ID NO: 4555 - RNA, 20 nt, Artificial Sequence
  MKO10004555_A_Ap5b1
  gRNA
agguugucccggacgcaagc

SEQ ID NO: 4556 - RNA, 20 nt, Artificial Sequence
  MKO10004556_A_Ap5b1
  gRNA
gcgaccuguugagugaccua

SEQ ID NO: 4557 - RNA, 20 nt, Artificial Sequence
  MKO10004557_A_Ap5m1
  gRNA
caccuugcaagcgacuguuc

SEQ ID NO: 4558 - RNA, 20 nt, Artificial Sequence
  MKO10004558_A_Ap5m1
  gRNA
aagagguccaauuacccauu

SEQ ID NO: 4559 - RNA, 20 nt, Artificial Sequence
  MKO10004559_A_Ap5m1
  gRNA
gguuccugucccaccaauac

SEQ ID NO: 4560 - RNA, 20 nt, Artificial Sequence
  MKO10004560_A_Ap5s1
  gRNA
ugagcgcacgcuccggcucu

SEQ ID NO: 4561 - RNA, 20 nt, Artificial Sequence
  MKO10004561_A_Ap5s1
  gRNA
caauccguauguccugagcg

SEQ ID NO: 4562 - RNA, 20 nt, Artificial Sequence
  MKO10004562_A_Ap5s1
  gRNA
cuuucugcaccaugugaccg

SEQ ID NO: 4563 - RNA, 20 nt, Artificial Sequence
  MKO10004563_A_Ap5z1
  gRNA
cagccaccaaguacccccgu

SEQ ID NO: 4564 - RNA, 20 nt, Artificial Sequence
  MKO10004564_A_Ap5z1
  gRNA
ccucaggcugccgguucucg

SEQ ID NO: 4565 - RNA, 20 nt, Artificial Sequence
  MKO10004565_A_Ap5z1
  gRNA
ucgcuacgccagcauccagc

SEQ ID NO: 4566 - RNA, 20 nt, Artificial Sequence
  MKO10004566_A_Apaf1
  gRNA
cuacaacgcucugcuacacg

SEQ ID NO: 4567 - RNA, 20 nt, Artificial Sequence
  MKO10004567_A_Apaf1
  gRNA
cgagaucacucccucuuaga

SEQ ID NO: 4568 - RNA, 20 nt, Artificial Sequence
  MKO10004568_A_Apaf1
  gRNA
guuugcgcagcaucagaaca

SEQ ID NO: 4569 - RNA, 20 nt, Artificial Sequence
  MKO10004569_A_Apba1
  gRNA
ucauucccaaccuacguuga

SEQ ID NO: 4570 - RNA, 20 nt, Artificial Sequence
  MKO10004570_A_Apba1
  gRNA
ggaagcaguaagccggauca

SEQ ID NO: 4571 - RNA, 20 nt, Artificial Sequence
  MKO10004571_A_Apba1
  gRNA
gacccugaagacuugaucga

SEQ ID NO: 4572 - RNA, 20 nt, Artificial Sequence
  MKO10004572_A_Apba2
  gRNA
caaagaugauuccaucgaug

SEQ ID NO: 4573 - RNA, 20 nt, Artificial Sequence
  MKO10004573_A_Apba2
  gRNA
caaaaacauccgaaugaugc

SEQ ID NO: 4574 - RNA, 20 nt, Artificial Sequence
  MKO10004574_A_Apba2
  gRNA
cacuuaccagccacaaagcu

SEQ ID NO: 4575 - RNA, 20 nt, Artificial Sequence
  MKO10004575_A_Apba3
  gRNA
gcaucuuguagagucgccgc

SEQ ID NO: 4576 - RNA, 20 nt, Artificial Sequence
  MKO10004576_A_Apba3
  gRNA
ggaggccauggaccgcguca

SEQ ID NO: 4577 - RNA, 20 nt, Artificial Sequence
  MKO10004577_A_Apba3
  gRNA
cucgugcccugccgucaccg

SEQ ID NO: 4578 - RNA, 20 nt, Artificial Sequence
  MKO10004578_A_Apbb1ip
  gRNA
guagcuuaccuucuuaaccu

SEQ ID NO: 4579 - RNA, 20 nt, Artificial Sequence
  MKO10004579_A_Apbb1ip
  gRNA
agccgaacagagaaccaucc

SEQ ID NO: 4580 - RNA, 20 nt, Artificial Sequence
  MKO10004580_A_Apbb1ip
  gRNA
uuggucuuccagugcauuua

SEQ ID NO: 4581 - RNA, 20 nt, Artificial Sequence
  MKO10004581_A_Apbb1
  gRNA
cgagacggauuccgaucuac

SEQ ID NO: 4582 - RNA, 20 nt, Artificial Sequence
  MKO10004582_A_Apbb1
  gRNA
ggaauccgucucgaaagcgu

SEQ ID NO: 4583 - RNA, 20 nt, Artificial Sequence
  MKO10004583_A_Apbb1
  gRNA
gaaggacaaugucgccuccu

SEQ ID NO: 4584 - RNA, 20 nt, Artificial Sequence
  MKO10004584_A_Apbb2
  gRNA
gacagaucccgauuugccgc

SEQ ID NO: 4585 - RNA, 20 nt, Artificial Sequence
  MKO10004585_A_Apbb2
  gRNA
gaugugccaguaauaggucc

SEQ ID NO: 4586 - RNA, 20 nt, Artificial Sequence
  MKO10004586_A_Apbb2
  gRNA
gaaccuggcaccaagugacg

SEQ ID NO: 4587 - RNA, 20 nt, Artificial Sequence
  MKO10004587_A_Apbb3
  gRNA
cuggcuccgguuucgggucu

SEQ ID NO: 4588 - RNA, 20 nt, Artificial Sequence
  MKO10004588_A_Apbb3
  gRNA
uugggaacugcgacccccca

SEQ ID NO: 4589 - RNA, 20 nt, Artificial Sequence
  MKO10004589_A_Apbb3
  gRNA
ccaaucacuaccuuagcucc

SEQ ID NO: 4590 - RNA, 20 nt, Artificial Sequence
  MKO10004590_A_Apc2
  gRNA
cuuggaugagcugccgcacg

SEQ ID NO: 4591 - RNA, 20 nt, Artificial Sequence
  MKO10004591_A_Apc2
  gRNA
cuucgguaccuccgacgaga

SEQ ID NO: 4592 - RNA, 20 nt, Artificial Sequence
  MKO10004592_A_Apc2
  gRNA
gagcucaccguguccacgug

SEQ ID NO: 4593 - RNA, 20 nt, Artificial Sequence
  MKO10004593_A_Apcdd1
  gRNA
guagcggccucgagcguaga

SEQ ID NO: 4594 - RNA, 20 nt, Artificial Sequence
  MKO10004594_A_Apcdd1
  gRNA
ugacuuggacgccgugaagc

SEQ ID NO: 4595 - RNA, 20 nt, Artificial Sequence
  MKO10004595_A_Apcdd1
  gRNA
acauucaccaucuacgcucg

SEQ ID NO: 4596 - RNA, 20 nt, Artificial Sequence
  MKO10004596_A_Apcs
  gRNA
caggagcaggauaacuacgg

SEQ ID NO: 4597 - RNA, 20 nt, Artificial Sequence
  MKO10004597_A_Apcs
  gRNA
uagucaucaggccccguguc

SEQ ID NO: 4598 - RNA, 20 nt, Artificial Sequence
  MKO10004598_A_Apcs
  gRNA
gcauggacaagcuacugcuu

SEQ ID NO: 4599 - RNA, 20 nt, Artificial Sequence
  MKO10004599_A_Apc
  gRNA
ggaucuguauccagccguuc

SEQ ID NO: 4600 - RNA, 20 nt, Artificial Sequence
  MKO10004600_A_Apc
  gRNA
gacuuacuagagcgucuuaa

SEQ ID NO: 4601 - RNA, 20 nt, Artificial Sequence
  MKO10004601_A_Apc
  gRNA
agauccuucccgacuuccgu

SEQ ID NO: 4602 - RNA, 20 nt, Artificial Sequence
  MKO10004602_A_Apeh
  gRNA
ccggaggucaccacgcagua

SEQ ID NO: 4603 - RNA, 20 nt, Artificial Sequence
  MKO10004603_A_Apeh
  gRNA
guuuccacacuguugcccgc

SEQ ID NO: 4604 - RNA, 20 nt, Artificial Sequence
  MKO10004604_A_Apeh
  gRNA
uucgcugagcgccgccugcc

SEQ ID NO: 4605 - RNA, 20 nt, Artificial Sequence
  MKO10004605_A_Apex1
  gRNA
aagaaagcggcggccgacga

SEQ ID NO: 4606 - RNA, 20 nt, Artificial Sequence
  MKO10004606_A_Apex1
  gRNA
gacuggaauaccgacagcgu

SEQ ID NO: 4607 - RNA, 20 nt, Artificial Sequence
  MKO10004607_A_Apex1
  gRNA
cuuggguucuuccccgucgu

SEQ ID NO: 4608 - RNA, 20 nt, Artificial Sequence
  MKO10004608_A_Apex2
  gRNA
ccacugcgaugcaaguaguc

SEQ ID NO: 4609 - RNA, 20 nt, Artificial Sequence
  MKO10004609_A_Apex2
  gRNA
caauguguacugcccucacg

SEQ ID NO: 4610 - RNA, 20 nt, Artificial Sequence
  MKO10004610_A_Apex2
  gRNA
ccagacuacuugcaucgcag

SEQ ID NO: 4611 - RNA, 20 nt, Artificial Sequence
  MKO10004611_A_Aph1a
  gRNA
ucgacacucaccccgccacc

SEQ ID NO: 4612 - RNA, 20 nt, Artificial Sequence
  MKO10004612_A_Aph1a
  gRNA
gcucaccauaggccaucugu

SEQ ID NO: 4613 - RNA, 20 nt, Artificial Sequence
  MKO10004613_A_Aph1a
  gRNA
accugaagucaggaaguaau

SEQ ID NO: 4614 - RNA, 20 nt, Artificial Sequence
  MKO10004614_A_Aph1b
  gRNA
gcaacacuccgaagaugagc

SEQ ID NO: 4615 - RNA, 20 nt, Artificial Sequence
  MKO10004615_A_Aph1b
  gRNA
accaaaaaacggaugacagc

SEQ ID NO: 4616 - RNA, 20 nt, Artificial Sequence
  MKO10004616_A_Aph1b
  gRNA
auaggccaacagucgcaucg

SEQ ID NO: 4617 - RNA, 20 nt, Artificial Sequence
  MKO10004617_A_Aph1c
  gRNA
accaaaacauggacgaaagc

SEQ ID NO: 4618 - RNA, 20 nt, Artificial Sequence
  MKO10004618_A_Aph1c
  gRNA
uccugcuuucguccauguuu

SEQ ID NO: 4619 - RNA, 20 nt, Artificial Sequence
  MKO10004619_A_Aph1c
  gRNA
uuugaaaagcauaaacccgg

SEQ ID NO: 4620 - RNA, 20 nt, Artificial Sequence
  MKO10004620_A_Api5
  gRNA
ugugucacaggaacguuagg

SEQ ID NO: 4621 - RNA, 20 nt, Artificial Sequence
  MKO10004621_A_Api5
  gRNA
cugacccagcuucugcagac

SEQ ID NO: 4622 - RNA, 20 nt, Artificial Sequence
  MKO10004622_A_Api5
  gRNA
ucucaccugucugcagaagc

SEQ ID NO: 4623 - RNA, 20 nt, Artificial Sequence
  MKO10004623_A_Apip
  gRNA
cgugcaaaaggaacgcauuc

SEQ ID NO: 4624 - RNA, 20 nt, Artificial Sequence
  MKO10004624_A_Apip
  gRNA
gaaaucuacauugcucccuc

SEQ ID NO: 4625 - RNA, 20 nt, Artificial Sequence
  MKO10004625_A_Apip
  gRNA
augaaugcuuauaccaugag

SEQ ID NO: 4626 - RNA, 20 nt, Artificial Sequence
  MKO10004626_A_Apitd1
  gRNA
caccagugaauuauuucgcc

SEQ ID NO: 4627 - RNA, 20 nt, Artificial Sequence
  MKO10004627_A_Apitd1
  gRNA
gcacugucgaaaagucaccu

SEQ ID NO: 4628 - RNA, 20 nt, Artificial Sequence
  MKO10004628_A_Apitd1
  gRNA
cuucagcaaacagaccaucg

SEQ ID NO: 4629 - RNA, 20 nt, Artificial Sequence
  MKO10004629_A_Aplf
  gRNA
aagcguacuugucaaguaac

SEQ ID NO: 4630 - RNA, 20 nt, Artificial Sequence
  MKO10004630_A_Aplf
  gRNA
agcuauccccgggaugcaac

SEQ ID NO: 4631 - RNA, 20 nt, Artificial Sequence
  MKO10004631_A_Aplf
  gRNA
cuuuccgccaacauccaagc

SEQ ID NO: 4632 - RNA, 20 nt, Artificial Sequence
  MKO10004632_A_Aplnr
  gRNA
ccggcugcucagcauuaucg

SEQ ID NO: 4633 - RNA, 20 nt, Artificial Sequence
  MKO10004633_A_Aplnr
  gRNA
ucgcagccuuagccgagcau

SEQ ID NO: 4634 - RNA, 20 nt, Artificial Sequence
  MKO10004634_A_Aplnr
  gRNA
cugcguagucgcauucagac

SEQ ID NO: 4635 - RNA, 20 nt, Artificial Sequence
  MKO10004635_A_Apln
  gRNA
aauuucgcagacagcgcccc

SEQ ID NO: 4636 - RNA, 20 nt, Artificial Sequence
  MKO10004636_A_Apln
  gRNA
ugguccaguccucgaaguuc

SEQ ID NO: 4637 - RNA, 20 nt, Artificial Sequence
  MKO10004637_A_Apln
  gRNA
cgaguugcagcaugaaucug

SEQ ID NO: 4638 - RNA, 20 nt, Artificial Sequence
  MKO10004638_A_Aplp1
  gRNA
gcgaucacgacgcugucuuc

SEQ ID NO: 4639 - RNA, 20 nt, Artificial Sequence
  MKO10004639_A_Aplp1
  gRNA
cgagcugcacauagcacgcg

SEQ ID NO: 4640 - RNA, 20 nt, Artificial Sequence
  MKO10004640_A_Aplp1
  gRNA
agacagcgucgugaucgcug

SEQ ID NO: 4641 - RNA, 20 nt, Artificial Sequence
  MKO10004641_A_Aplp2
  gRNA
aagcuugccgguggccgcag

SEQ ID NO: 4642 - RNA, 20 nt, Artificial Sequence
  MKO10004642_A_Aplp2
  gRNA
ugacuaacgugugccagcgc

SEQ ID NO: 4643 - RNA, 20 nt, Artificial Sequence
  MKO10004643_A_Aplp2
  gRNA
caccaacuaucaauauugac

SEQ ID NO: 4644 - RNA, 20 nt, Artificial Sequence
  MKO10004644_A_Apmap
  gRNA
gccugaaccgaaccgagcga

SEQ ID NO: 4645 - RNA, 20 nt, Artificial Sequence
  MKO10004645_A_Apmap
  gRNA
gcuugccgcaacuucguauu

SEQ ID NO: 4646 - RNA, 20 nt, Artificial Sequence
  MKO10004646_A_Apmap
  gRNA
auagagaccaucgcucgguu

SEQ ID NO: 4647 - RNA, 20 nt, Artificial Sequence
  MKO10004647_A_Apoa1bp
  gRNA
gggaaugucgaugcuagcaa

SEQ ID NO: 4648 - RNA, 20 nt, Artificial Sequence
  MKO10004648_A_Apoa1bp
  gRNA
aucuguggccccggaaauaa

SEQ ID NO: 4649 - RNA, 20 nt, Artificial Sequence
  MKO10004649_A_Apoa1bp
  gRNA
uaacgaguaucaguucagcg

SEQ ID NO: 4650 - RNA, 20 nt, Artificial Sequence
  MKO10004650_A_Apoa1
  gRNA
cgaacagaugcgcgagagcc

SEQ ID NO: 4651 - RNA, 20 nt, Artificial Sequence
  MKO10004651_A_Apoa1
  gRNA
ucucgcgcaucuguucgcug

SEQ ID NO: 4652 - RNA, 20 nt, Artificial Sequence
  MKO10004652_A_Apoa1
  gRNA
gcugccauacgugccaagcc

SEQ ID NO: 4653 - RNA, 20 nt, Artificial Sequence
  MKO10004653_A_Apoa2
  gRNA
caucaugaagcugcucgcaa

SEQ ID NO: 4654 - RNA, 20 nt, Artificial Sequence
  MKO10004654_A_Apoa2
  gRNA
agcagcugacaccccuuguc

SEQ ID NO: 4655 - RNA, 20 nt, Artificial Sequence
  MKO10004655_A_Apoa2
  gRNA
uaguuccugcugaccugaca

SEQ ID NO: 4656 - RNA, 20 nt, Artificial Sequence
  MKO10004656_A_Apoa4
  gRNA
gcauguucuccccgaacguc

SEQ ID NO: 4657 - RNA, 20 nt, Artificial Sequence
  MKO10004657_A_Apoa4
  gRNA
guccacauucuccuugaucg

SEQ ID NO: 4658 - RNA, 20 nt, Artificial Sequence
  MKO10004658_A_Apoa4
  gRNA
acucaccggugauggccacc

SEQ ID NO: 4659 - RNA, 20 nt, Artificial Sequence
  MKO10004659_A_Apoa5
  gRNA
cacgcagcgacugagucgcg

SEQ ID NO: 4660 - RNA, 20 nt, Artificial Sequence
  MKO10004660_A_Apoa5
  gRNA
gucaccaagcguucugcgua

SEQ ID NO: 4661 - RNA, 20 nt, Artificial Sequence
  MKO10004661_A_Apoa5
  gRNA
ugcaguguucgcaagcacuc

SEQ ID NO: 4662 - RNA, 20 nt, Artificial Sequence
  MKO10004662_A_Apobec1
  gRNA
acggaucagcgaaaccgcca

SEQ ID NO: 4663 - RNA, 20 nt, Artificial Sequence
  MKO10004663_A_Apobec1
  gRNA
ggcgguuucgcugauccgug

SEQ ID NO: 4664 - RNA, 20 nt, Artificial Sequence
  MKO10004664_A_Apobec1
  gRNA
ccccuucaaacgaagcuuau

SEQ ID NO: 4665 - RNA, 20 nt, Artificial Sequence
  MKO10004665_A_Apobec2
  gRNA
cggaacuguauuccacguuc

SEQ ID NO: 4666 - RNA, 20 nt, Artificial Sequence
  MKO10004666_A_Apobec2
  gRNA
ucaccagaaugagcagacga

SEQ ID NO: 4667 - RNA, 20 nt, Artificial Sequence
  MKO10004667_A_Apobec2
  gRNA
uuacccagugacaaucucga

SEQ ID NO: 4668 - RNA, 20 nt, Artificial Sequence
  MKO10004668_A_Apobec3
  gRNA
cucccgccucuacaacguac

SEQ ID NO: 4669 - RNA, 20 nt, Artificial Sequence
  MKO10004669_A_Apobec3
  gRNA
cuggguccuguacguuguag

SEQ ID NO: 4670 - RNA, 20 nt, Artificial Sequence
  MKO10004670_A_Apobec3
  gRNA
gcaaaugcuauucaccgauc

SEQ ID NO: 4671 - RNA, 20 nt, Artificial Sequence
  MKO10004671_A_Apobec4
  gRNA
cuuccucgccuguccgaaug

SEQ ID NO: 4672 - RNA, 20 nt, Artificial Sequence
  MKO10004672_A_Apobec4
  gRNA
caauagucaaaccuuacuac

SEQ ID NO: 4673 - RNA, 20 nt, Artificial Sequence
  MKO10004673_A_Apobec4
  gRNA
caacaacuccccuuguaacg

SEQ ID NO: 4674 - RNA, 20 nt, Artificial Sequence
  MKO10004674_A_Apobr
  gRNA
gccuacgcuaguccuagaca

SEQ ID NO: 4675 - RNA, 20 nt, Artificial Sequence
  MKO10004675_A_Apobr
  gRNA
uucaagcuuagcacccgcuc

SEQ ID NO: 4676 - RNA, 20 nt, Artificial Sequence
  MKO10004676_A_Apobr
  gRNA
cagggaccggccgcuccgcc

SEQ ID NO: 4677 - RNA, 20 nt, Artificial Sequence
  MKO10004677_A_Apob
  gRNA
cauaguuguacacguacuuu

SEQ ID NO: 4678 - RNA, 20 nt, Artificial Sequence
  MKO10004678_A_Apob
  gRNA
uauuuagguucauccuuguc

SEQ ID NO: 4679 - RNA, 20 nt, Artificial Sequence
  MKO10004679_A_Apob
  gRNA
ugaugccccucuugauguuc

SEQ ID NO: 4680 - RNA, 20 nt, Artificial Sequence
  MKO10004680_A_Apoc1
  gRNA
cccggauuuguccggaacau

SEQ ID NO: 4681 - RNA, 20 nt, Artificial Sequence
  MKO10004681_A_Apoc1
  gRNA
uccaauguuccggacaaauc

SEQ ID NO: 4682 - RNA, 20 nt, Artificial Sequence
  MKO10004682_A_Apoc1
  gRNA
gccaaaugccucugagaacc

SEQ ID NO: 4683 - RNA, 20 nt, Artificial Sequence
  MKO10004683_A_Apoc2
  gRNA
agggcucccucuuaaguuac

SEQ ID NO: 4684 - RNA, 20 nt, Artificial Sequence
  MKO10004684_A_Apoc2
  gRNA
gaagacauacccgaucagca

SEQ ID NO: 4685 - RNA, 20 nt, Artificial Sequence
  MKO10004685_A_Apoc2
  gRNA
aaugccugcguaagugcuca

SEQ ID NO: 4686 - RNA, 20 nt, Artificial Sequence
  MKO10004686_A_Apoc3
  gRNA
ggaugcgcuaaguagcgugc

SEQ ID NO: 4687 - RNA, 20 nt, Artificial Sequence
  MKO10004687_A_Apoc3
  gRNA
gcacgcuacuuagcgcaucc

SEQ ID NO: 4688 - RNA, 20 nt, Artificial Sequence
  MKO10004688_A_Apoc3
  gRNA
aagucucacgacucaauagc

SEQ ID NO: 4689 - RNA, 20 nt, Artificial Sequence
  MKO10004689_A_Apoc4
  gRNA
uggcacuuuaacccugaguc

SEQ ID NO: 4690 - RNA, 20 nt, Artificial Sequence
  MKO10004690_A_Apoc4
  gRNA
uuucaggugaucuucauagu

SEQ ID NO: 4691 - RNA, 20 nt, Artificial Sequence
  MKO10004691_A_Apoc4
  gRNA
ccccagaaaugucccugcug

SEQ ID NO: 4692 - RNA, 20 nt, Artificial Sequence
  MKO10004692_A_Apod
  gRNA
ggugaagagacccgccagcg

SEQ ID NO: 4693 - RNA, 20 nt, Artificial Sequence
  MKO10004693_A_Apod
  gRNA
ugucgaugccauuagaagua

SEQ ID NO: 4694 - RNA, 20 nt, Artificial Sequence
  MKO10004694_A_Apod
  gRNA
ucaagccaacuacucgcuga

SEQ ID NO: 4695 - RNA, 20 nt, Artificial Sequence
  MKO10004695_A_Apoe
  gRNA
gccucugcgcgaucgcgccc

SEQ ID NO: 4696 - RNA, 20 nt, Artificial Sequence
  MKO10004696_A_Apoe
  gRNA
ccgacucggagccgacaugg

SEQ ID NO: 4697 - RNA, 20 nt, Artificial Sequence
  MKO10004697_A_Apoe
  gRNA
cuacacaggaugccuagccg

SEQ ID NO: 4698 - RNA, 20 nt, Artificial Sequence
  MKO10004698_A_Apof
  gRNA
gcccccugacgcgccuacca

SEQ ID NO: 4699 - RNA, 20 nt, Artificial Sequence
  MKO10004699_A_Apof
  gRNA
uucucaauggccggacugua

SEQ ID NO: 4700 - RNA, 20 nt, Artificial Sequence
  MKO10004700_A_Apof
  gRNA
gccgugaucaccgcaccagc

SEQ ID NO: 4701 - RNA, 20 nt, Artificial Sequence
  MKO10004701_A_Apoh
  gRNA
gacccgauugccagaaugcc

SEQ ID NO: 4702 - RNA, 20 nt, Artificial Sequence
  MKO10004702_A_Apoh
  gRNA
guguucagucuguccgaagc

SEQ ID NO: 4703 - RNA, 20 nt, Artificial Sequence
  MKO10004703_A_Apoh
  gRNA
uuaaagacauccuacgaccc

SEQ ID NO: 4704 - RNA, 20 nt, Artificial Sequence
  MKO10004704_A_Apol10a
  gRNA
ggaccuugcgcaacaauucg

SEQ ID NO: 4705 - RNA, 20 nt, Artificial Sequence
  MKO10004705_A_Apol10a
  gRNA
aaaccucgaauuguugcgca

SEQ ID NO: 4706 - RNA, 20 nt, Artificial Sequence
  MKO10004706_A_Apol10a
  gRNA
uguuuccaaaaauccauucc

SEQ ID NO: 4707 - RNA, 20 nt, Artificial Sequence
  MKO10004707_A_Apol10b
  gRNA
ggaguagcucgaaguguuga

SEQ ID NO: 4708 - RNA, 20 nt, Artificial Sequence
  MKO10004708_A_Apol10b
  gRNA
agucauacacaucccacgca

SEQ ID NO: 4709 - RNA, 20 nt, Artificial Sequence
  MKO10004709_A_Apol10b
  gRNA
uuacaaguuuguuccuugcg

SEQ ID NO: 4710 - RNA, 20 nt, Artificial Sequence
  MKO10004710_A_Apol11a
  gRNA
uagcuuuacgaccaccgcug

SEQ ID NO: 4711 - RNA, 20 nt, Artificial Sequence
  MKO10004711_A_Apol11a
  gRNA
ugaccuugugaaccaaucaa

SEQ ID NO: 4712 - RNA, 20 nt, Artificial Sequence
  MKO10004712_A_Apol11a
  gRNA
aaaagccauugauaacuuca

SEQ ID NO: 4713 - RNA, 20 nt, Artificial Sequence
  MKO10004713_A_Apol11b
  gRNA
caucaugcagauccguugcu

SEQ ID NO: 4714 - RNA, 20 nt, Artificial Sequence
  MKO10004714_A_Apol11b
  gRNA
aaaagucauugauaacgcca

SEQ ID NO: 4715 - RNA, 20 nt, Artificial Sequence
  MKO10004715_A_Apol11b
  gRNA
aucuguuauuaaaucuuccg

SEQ ID NO: 4716 - RNA, 20 nt, Artificial Sequence
  MKO10004716_A_Apol6
  gRNA
acguaucagcucgaaguggc

SEQ ID NO: 4717 - RNA, 20 nt, Artificial Sequence
  MKO10004717_A_Apol6
  gRNA
ugccacuucgagcugauacg

SEQ ID NO: 4718 - RNA, 20 nt, Artificial Sequence
  MKO10004718_A_Apol6
  gRNA
aaccccgagccaucagacag

SEQ ID NO: 4719 - RNA, 20 nt, Artificial Sequence
  MKO10004719_A_Apol7a
  gRNA
aucugcccgaaacacuaaac

SEQ ID NO: 4720 - RNA, 20 nt, Artificial Sequence
  MKO10004720_A_Apol7a
  gRNA
augcauuaaugccauuccgc

SEQ ID NO: 4721 - RNA, 20 nt, Artificial Sequence
  MKO10004721_A_Apol7a
  gRNA
ccgcuuaccuggggugucca

SEQ ID NO: 4722 - RNA, 20 nt, Artificial Sequence
  MKO10004722_A_Apol7b
  gRNA
ggcgcuuagcauuaguuaca

SEQ ID NO: 4723 - RNA, 20 nt, Artificial Sequence
  MKO10004723_A_Apol7b
  gRNA
ccuugucaaccuuaucugcc

SEQ ID NO: 4724 - RNA, 20 nt, Artificial Sequence
  MKO10004724_A_Apol7b
  gRNA
cugcuuaccuggagugccca

SEQ ID NO: 4725 - RNA, 20 nt, Artificial Sequence
  MKO10004725_A_Apol7c
  gRNA
aguccugaccauccuugguc

SEQ ID NO: 4726 - RNA, 20 nt, Artificial Sequence
  MKO10004726_A_Apol7c
  gRNA
cucagcaagagacucucgca

SEQ ID NO: 4727 - RNA, 20 nt, Artificial Sequence
  MKO10004727_A_Apol7c
  gRNA
ucugcaccuguuuagugguu

SEQ ID NO: 4728 - RNA, 20 nt, Artificial Sequence
  MKO10004728_A_Apol7e
  gRNA
ggcgcuuagcauuaguuacu

SEQ ID NO: 4729 - RNA, 20 nt, Artificial Sequence
  MKO10004729_A_Apol7e
  gRNA
cugcuuaccuggggugccca

SEQ ID NO: 4730 - RNA, 20 nt, Artificial Sequence
  MKO10004730_A_Apol7e
  gRNA
caaagcuaacuauauccagc

SEQ ID NO: 4731 - RNA, 20 nt, Artificial Sequence
  MKO10004731_A_Apol8
  gRNA
cauggacccuucagacugcg

SEQ ID NO: 4732 - RNA, 20 nt, Artificial Sequence
  MKO10004732_A_Apol8
  gRNA
uguguaguccacgaucccag

SEQ ID NO: 4733 - RNA, 20 nt, Artificial Sequence
  MKO10004733_A_Apol8
  gRNA
agaauugcugccguguccua

SEQ ID NO: 4734 - RNA, 20 nt, Artificial Sequence
  MKO10004734_A_Apol9a
  gRNA
auccaacgugccaccgccgc

SEQ ID NO: 4735 - RNA, 20 nt, Artificial Sequence
  MKO10004735_A_Apol9a
  gRNA
caccugcggcgguggcacgu

SEQ ID NO: 4736 - RNA, 20 nt, Artificial Sequence
  MKO10004736_A_Apol9a
  gRNA
uagcacugaccuggacaacu

SEQ ID NO: 4737 - RNA, 20 nt, Artificial Sequence
  MKO10004737_A_Apol9b
  gRNA
auccaacgugccgccaccgc

SEQ ID NO: 4738 - RNA, 20 nt, Artificial Sequence
  MKO10004738_A_Apol9b
  gRNA
cuuggauacaaacgccugcc

SEQ ID NO: 4739 - RNA, 20 nt, Artificial Sequence
  MKO10004739_A_Apol9b
  gRNA
caccugcgguggcggcacgu

SEQ ID NO: 4740 - RNA, 20 nt, Artificial Sequence
  MKO10004740_A_Apold1
  gRNA
cgcagcgcaucggcgcccug

SEQ ID NO: 4741 - RNA, 20 nt, Artificial Sequence
  MKO10004741_A_Apold1
  gRNA
cgcagggcgccgaugcgcug

SEQ ID NO: 4742 - RNA, 20 nt, Artificial Sequence
  MKO10004742_A_Apold1
  gRNA
agcucagaagcucgcgcauc

SEQ ID NO: 4743 - RNA, 20 nt, Artificial Sequence
  MKO10004743_A_Apom
  gRNA
uggacauaccgauugacuga

SEQ ID NO: 4744 - RNA, 20 nt, Artificial Sequence
  MKO10004744_A_Apom
  gRNA
cucccgcaauaaaguaccac

SEQ ID NO: 4745 - RNA, 20 nt, Artificial Sequence
  MKO10004745_A_Apom
  gRNA
aaaaguugccaacucuuccg

SEQ ID NO: 4746 - RNA, 20 nt, Artificial Sequence
  MKO10004746_A_Apon
  gRNA
ccccggugaccgccuuuccg

SEQ ID NO: 4747 - RNA, 20 nt, Artificial Sequence
  MKO10004747_A_Apon
  gRNA
cggggagcaccguguacaag

SEQ ID NO: 4748 - RNA, 20 nt, Artificial Sequence
  MKO10004748_A_Apon
  gRNA
ucgaucuucaacgggaaucu

SEQ ID NO: 4749 - RNA, 20 nt, Artificial Sequence
  MKO10004749_A_Apool
  gRNA
agugauuacagcuucgggac

SEQ ID NO: 4750 - RNA, 20 nt, Artificial Sequence
  MKO10004750_A_Apool
  gRNA
gaugcauauaucagaccugc

SEQ ID NO: 4751 - RNA, 20 nt, Artificial Sequence
  MKO10004751_A_Apool
  gRNA
acuacaaccguguauuauau

SEQ ID NO: 4752 - RNA, 20 nt, Artificial Sequence
  MKO10004752_A_Apoo
  gRNA
ugcaccuaccucuagcaaaa

SEQ ID NO: 4753 - RNA, 20 nt, Artificial Sequence
  MKO10004753_A_Apoo
  gRNA
ucaacuuaccuacuccccac

SEQ ID NO: 4754 - RNA, 20 nt, Artificial Sequence
  MKO10004754_A_Apoo
  gRNA
cacuuuguccaguggggagu

SEQ ID NO: 4755 - RNA, 20 nt, Artificial Sequence
  MKO10004755_A_Apopt1
  gRNA
uccgggccgcaaagccgcca

SEQ ID NO: 4756 - RNA, 20 nt, Artificial Sequence
  MKO10004756_A_Apopt1
  gRNA
guuggcccgugagcgcccua

SEQ ID NO: 4757 - RNA, 20 nt, Artificial Sequence
  MKO10004757_A_Apopt1
  gRNA
cgaagguuugagcauuuguc

SEQ ID NO: 4758 - RNA, 20 nt, Artificial Sequence
  MKO10004758_A_Appbp2
  gRNA
cggaagcuaccuuaacgcca

SEQ ID NO: 4759 - RNA, 20 nt, Artificial Sequence
  MKO10004759_A_Appbp2
  gRNA
ucugauggaccauggcguua

SEQ ID NO: 4760 - RNA, 20 nt, Artificial Sequence
  MKO10004760_A_Appbp2
  gRNA
agguugcuucaugugcgaaa

SEQ ID NO: 4761 - RNA, 20 nt, Artificial Sequence
  MKO10004761_A_Appl1
  gRNA
aauuguaucaagcuaugcau

SEQ ID NO: 4762 - RNA, 20 nt, Artificial Sequence
  MKO10004762_A_Appl1
  gRNA
gaugcauagcuugauacaau

SEQ ID NO: 4763 - RNA, 20 nt, Artificial Sequence
  MKO10004763_A_Appl1
  gRNA
cuuucaaaaguuucgaaguc

SEQ ID NO: 4764 - RNA, 20 nt, Artificial Sequence
  MKO10004764_A_Appl2
  gRNA
gcagcgugucuauggcgcac

SEQ ID NO: 4765 - RNA, 20 nt, Artificial Sequence
  MKO10004765_A_Appl2
  gRNA
uguuauacaguuucgagaga

SEQ ID NO: 4766 - RNA, 20 nt, Artificial Sequence
  MKO10004766_A_Appl2
  gRNA
ugcgccauagacacgcugca

SEQ ID NO: 4767 - RNA, 20 nt, Artificial Sequence
  MKO10004767_A_App
  gRNA
agaguuuguaugcugcccgu

SEQ ID NO: 4768 - RNA, 20 nt, Artificial Sequence
  MKO10004768_A_App
  gRNA
agcacuaacuugcacgacua

SEQ ID NO: 4769 - RNA, 20 nt, Artificial Sequence
  MKO10004769_A_App
  gRNA
ggcucaccuaggcaacggua

SEQ ID NO: 4770 - RNA, 20 nt, Artificial Sequence
  MKO10004770_A_Aprt
  gRNA
gucgaucuugccgcugugcg

SEQ ID NO: 4771 - RNA, 20 nt, Artificial Sequence
  MKO10004771_A_Aprt
  gRNA
ccgagcuuccauccgccucu

SEQ ID NO: 4772 - RNA, 20 nt, Artificial Sequence
  MKO10004772_A_Aprt
  gRNA
cccuaacaggucuagacucc

SEQ ID NO: 4773 - RNA, 20 nt, Artificial Sequence
  MKO10004773_A_Aptx
  gRNA
gaugacgcccgagucaaugc

SEQ ID NO: 4774 - RNA, 20 nt, Artificial Sequence
  MKO10004774_A_Aptx
  gRNA
gagcuaagaugcgagugugc

SEQ ID NO: 4775 - RNA, 20 nt, Artificial Sequence
  MKO10004775_A_Aptx
  gRNA
uccucaaacucuacgaugua

SEQ ID NO: 4776 - RNA, 20 nt, Artificial Sequence
  MKO10004776_A_Aqp11
  gRNA
gggagccauguccgcgcuac

SEQ ID NO: 4777 - RNA, 20 nt, Artificial Sequence
  MKO10004777_A_Aqp11
  gRNA
cuaagauccuuucgucguaa

SEQ ID NO: 4778 - RNA, 20 nt, Artificial Sequence
  MKO10004778_A_Aqp11
  gRNA
agcauuguuuaacccagcgc

SEQ ID NO: 4779 - RNA, 20 nt, Artificial Sequence
  MKO10004779_A_Aqp12
  gRNA
guuggcagaggccccaucga

SEQ ID NO: 4780 - RNA, 20 nt, Artificial Sequence
  MKO10004780_A_Aqp12
  gRNA
ccugcguacauccgugcugc

SEQ ID NO: 4781 - RNA, 20 nt, Artificial Sequence
  MKO10004781_A_Aqp12
  gRNA
aaagcaaauaccgaacuccc

SEQ ID NO: 4782 - RNA, 20 nt, Artificial Sequence
  MKO10004782_A_Aqp1
  gRNA
gcgacaccuucacguugucc

SEQ ID NO: 4783 - RNA, 20 nt, Artificial Sequence
  MKO10004783_A_Aqp1
  gRNA
cgacuucacagaccgcauga

SEQ ID NO: 4784 - RNA, 20 nt, Artificial Sequence
  MKO10004784_A_Aqp1
  gRNA
cgcuacucuggcccaaagug

SEQ ID NO: 4785 - RNA, 20 nt, Artificial Sequence
  MKO10004785_A_Aqp2
  gRNA
aaccgaugacggcgcccacc

SEQ ID NO: 4786 - RNA, 20 nt, Artificial Sequence
  MKO10004786_A_Aqp2
  gRNA
agcguucucccgagcggugc

SEQ ID NO: 4787 - RNA, 20 nt, Artificial Sequence
  MKO10004787_A_Aqp2
  gRNA
ccccuggugggcgccgucau

SEQ ID NO: 4788 - RNA, 20 nt, Artificial Sequence
  MKO10004788_A_Aqp3
  gRNA
guuguuauaagggucaacga

SEQ ID NO: 4789 - RNA, 20 nt, Artificial Sequence
  MKO10004789_A_Aqp3
  gRNA
accucgccucuucaccgccc

SEQ ID NO: 4790 - RNA, 20 nt, Artificial Sequence
  MKO10004790_A_Aqp3
  gRNA
aaagauuccagcugugccgu

SEQ ID NO: 4791 - RNA, 20 nt, Artificial Sequence
  MKO10004791_A_Aqp4
  gRNA
caugugauugacauugaccg

SEQ ID NO: 4792 - RNA, 20 nt, Artificial Sequence
  MKO10004792_A_Aqp4
  gRNA
cgacguuugagcuccacauc

SEQ ID NO: 4793 - RNA, 20 nt, Artificial Sequence
  MKO10004793_A_Aqp4
  gRNA
guucauggaaaccucaccgc

SEQ ID NO: 4794 - RNA, 20 nt, Artificial Sequence
  MKO10004794_A_Aqp5
  gRNA
accgaucgugggggccgucc

SEQ ID NO: 4795 - RNA, 20 nt, Artificial Sequence
  MKO10004795_A_Aqp5
  gRNA
aaccgauucaugaccaccgc

SEQ ID NO: 4796 - RNA, 20 nt, Artificial Sequence
  MKO10004796_A_Aqp5
  gRNA
gcugagccuccacgaccgug

SEQ ID NO: 4797 - RNA, 20 nt, Artificial Sequence
  MKO10004797_A_Aqp6
  gRNA
ccacaaggauggccaaucgc

SEQ ID NO: 4798 - RNA, 20 nt, Artificial Sequence
  MKO10004798_A_Aqp6
  gRNA
caagacuguagcccagcgau

SEQ ID NO: 4799 - RNA, 20 nt, Artificial Sequence
  MKO10004799_A_Aqp6
  gRNA
augaacccagcccgcuccuu

SEQ ID NO: 4800 - RNA, 20 nt, Artificial Sequence
  MKO10004800_A_Aqp7
  gRNA
acuccccaggcauucgugac

SEQ ID NO: 4801 - RNA, 20 nt, Artificial Sequence
  MKO10004801_A_Aqp7
  gRNA
ggcauccuuguuaccguccu

SEQ ID NO: 4802 - RNA, 20 nt, Artificial Sequence
  MKO10004802_A_Aqp7
  gRNA
cauucggccuagugcacaau

SEQ ID NO: 4803 - RNA, 20 nt, Artificial Sequence
  MKO10004803_A_Aqp8
  gRNA
auugagaauaguccgaauac

SEQ ID NO: 4804 - RNA, 20 nt, Artificial Sequence
  MKO10004804_A_Aqp8
  gRNA
agauccgagccagagcuacc

SEQ ID NO: 4805 - RNA, 20 nt, Artificial Sequence
  MKO10004805_A_Aqp8
  gRNA
gcagacaccaauguguagua

SEQ ID NO: 4806 - RNA, 20 nt, Artificial Sequence
  MKO10004806_A_Aqp9
  gRNA
gacaguugcagccccgacaa

SEQ ID NO: 4807 - RNA, 20 nt, Artificial Sequence
  MKO10004807_A_Aqp9
  gRNA
gggaucaucacuaucaauau

SEQ ID NO: 4808 - RNA, 20 nt, Artificial Sequence
  MKO10004808_A_Aqp9
  gRNA
auuugcaacggcaguuguga

SEQ ID NO: 4809 - RNA, 20 nt, Artificial Sequence
  MKO10004809_A_Aqr
  gRNA
uucuccggaaguuuccagca

SEQ ID NO: 4810 - RNA, 20 nt, Artificial Sequence
  MKO10004810_A_Aqr
  gRNA
ugcagcuagcauguaaauac

SEQ ID NO: 4811 - RNA, 20 nt, Artificial Sequence
  MKO10004811_A_Aqr
  gRNA
cucauucaccauacagcaga

SEQ ID NO: 4812 - RNA, 20 nt, Artificial Sequence
  MKO10004812_A_Araf
  gRNA
acucaugucaacgcagacgg

SEQ ID NO: 4813 - RNA, 20 nt, Artificial Sequence
  MKO10004813_A_Araf
  gRNA
gccuaacaagcaacgcacag

SEQ ID NO: 4814 - RNA, 20 nt, Artificial Sequence
  MKO10004814_A_Araf
  gRNA
cugggcucacugucggcggu

SEQ ID NO: 4815 - RNA, 20 nt, Artificial Sequence
  MKO10004815_A_Arap1
  gRNA
gcuucacugaguccaaccga

SEQ ID NO: 4816 - RNA, 20 nt, Artificial Sequence
  MKO10004816_A_Arap1
  gRNA
cucugcaggaccgccgugcc

SEQ ID NO: 4817 - RNA, 20 nt, Artificial Sequence
  MKO10004817_A_Arap1
  gRNA
ccacagaguucagccggcgc

SEQ ID NO: 4818 - RNA, 20 nt, Artificial Sequence
  MKO10004818_A_Arap2
  gRNA
cagcguaccuugacuggguu

SEQ ID NO: 4819 - RNA, 20 nt, Artificial Sequence
  MKO10004819_A_Arap2
  gRNA
acucuauccuaacccaguca

SEQ ID NO: 4820 - RNA, 20 nt, Artificial Sequence
  MKO10004820_A_Arap2
  gRNA
cgguucaguauuuccacucg

SEQ ID NO: 4821 - RNA, 20 nt, Artificial Sequence
  MKO10004821_A_Arap3
  gRNA
agcuggcauagggcgaaaug

SEQ ID NO: 4822 - RNA, 20 nt, Artificial Sequence
  MKO10004822_A_Arap3
  gRNA
ugaacugcacaaaacgucuc

SEQ ID NO: 4823 - RNA, 20 nt, Artificial Sequence
  MKO10004823_A_Arap3
  gRNA
cacgggacgaucugcugugg

SEQ ID NO: 4824 - RNA, 20 nt, Artificial Sequence
  MKO10004824_A_Arcn1
  gRNA
uccauagacucaagaacgug

SEQ ID NO: 4825 - RNA, 20 nt, Artificial Sequence
  MKO10004825_A_Arcn1
  gRNA
agcagcagucugcacgaaag

SEQ ID NO: 4826 - RNA, 20 nt, Artificial Sequence
  MKO10004826_A_Arcn1
  gRNA
gcaugcuccaccuauuaaua

SEQ ID NO: 4827 - RNA, 20 nt, Artificial Sequence
  MKO10004827_A_Arc
  gRNA
ccaccggcgacucacagcgc

SEQ ID NO: 4828 - RNA, 20 nt, Artificial Sequence
  MKO10004828_A_Arc
  gRNA
acaggucccgcuugcgccag

SEQ ID NO: 4829 - RNA, 20 nt, Artificial Sequence
  MKO10004829_A_Arc
  gRNA
aggucuucuaccgucuggag

SEQ ID NO: 4830 - RNA, 20 nt, Artificial Sequence
  MKO10004830_A_Areg
  gRNA
gccagaaggcauuucgcuua

SEQ ID NO: 4831 - RNA, 20 nt, Artificial Sequence
  MKO10004831_A_Areg
  gRNA
aggggacuacgacuacucag

SEQ ID NO: 4832 - RNA, 20 nt, Artificial Sequence
  MKO10004832_A_Areg
  gRNA
ugccgaugccaauagcugcg

SEQ ID NO: 4833 - RNA, 20 nt, Artificial Sequence
  MKO10004833_A_Arel1
  gRNA
uuucccugcacaucggcccg

SEQ ID NO: 4834 - RNA, 20 nt, Artificial Sequence
  MKO10004834_A_Arel1
  gRNA
gccgaauucuaacgugguga

SEQ ID NO: 4835 - RNA, 20 nt, Artificial Sequence
  MKO10004835_A_Arel1
  gRNA
aaugaagaccgugagcgccg

SEQ ID NO: 4836 - RNA, 20 nt, Artificial Sequence
  MKO10004836_A_Arf1
  gRNA
uucaggcuugaucuucguag

SEQ ID NO: 4837 - RNA, 20 nt, Artificial Sequence
  MKO10004837_A_Arf1
  gRNA
cugccccccagguuucaaug

SEQ ID NO: 4838 - RNA, 20 nt, Artificial Sequence
  MKO10004838_A_Arf1
  gRNA
cuucucaccaauggugggaa

SEQ ID NO: 4839 - RNA, 20 nt, Artificial Sequence
  MKO10004839_A_Arf2
  gRNA
gggccucauugacccgcucu

SEQ ID NO: 4840 - RNA, 20 nt, Artificial Sequence
  MKO10004840_A_Arf2
  gRNA
uugacaguaaugaccgagag

SEQ ID NO: 4841 - RNA, 20 nt, Artificial Sequence
  MKO10004841_A_Arf2
  gRNA
ggauauaccuaugguaggga

SEQ ID NO: 4842 - RNA, 20 nt, Artificial Sequence
  MKO10004842_A_Arf3
  gRNA
ugaucgggagcgagugaacg

SEQ ID NO: 4843 - RNA, 20 nt, Artificial Sequence
  MKO10004843_A_Arf3
  gRNA
gcccuuaccaauggucggga

SEQ ID NO: 4844 - RNA, 20 nt, Artificial Sequence
  MKO10004844_A_Arf3
  gRNA
acucccugcgucaccgcaau

SEQ ID NO: 4845 - RNA, 20 nt, Artificial Sequence
  MKO10004845_A_Arf4
  gRNA
cuaguuggauuggaugcugc

SEQ ID NO: 4846 - RNA, 20 nt, Artificial Sequence
  MKO10004846_A_Arf4
  gRNA
caaugaucgugaaagaaucc

SEQ ID NO: 4847 - RNA, 20 nt, Artificial Sequence
  MKO10004847_A_Arf4
  gRNA
cauuucucaccuggguauuc

SEQ ID NO: 4848 - RNA, 20 nt, Artificial Sequence
  MKO10004848_A_Arf5
  gRNA
gccuuaccgugcggcuacgc

SEQ ID NO: 4849 - RNA, 20 nt, Artificial Sequence
  MKO10004849_A_Arf5
  gRNA
ucagcaccugcguagccgca

SEQ ID NO: 4850 - RNA, 20 nt, Artificial Sequence
  MKO10004850_A_Arf5
  gRNA
uagacagcaacgaccgggag

SEQ ID NO: 4851 - RNA, 20 nt, Artificial Sequence
  MKO10004851_A_Arf6
  gRNA
gggccucgucgaugcggucg

SEQ ID NO: 4852 - RNA, 20 nt, Artificial Sequence
  MKO10004852_A_Arf6
  gRNA
accaguuccugucccgaauc

SEQ ID NO: 4853 - RNA, 20 nt, Artificial Sequence
  MKO10004853_A_Arf6
  gRNA
cgaccgcgaccgcaucgacg

SEQ ID NO: 4854 - RNA, 20 nt, Artificial Sequence
  MKO10004854_A_Arfgap1
  gRNA
cuuaucccugaagagcgccg

SEQ ID NO: 4855 - RNA, 20 nt, Artificial Sequence
  MKO10004855_A_Arfgap1
  gRNA
agucaucgccugcacagaac

SEQ ID NO: 4856 - RNA, 20 nt, Artificial Sequence
  MKO10004856_A_Arfgap1
  gRNA
ugcuaaguuccgagaguucc

SEQ ID NO: 4857 - RNA, 20 nt, Artificial Sequence
  MKO10004857_A_Arfgap2
  gRNA
ggucggcgggaaugccaaug

SEQ ID NO: 4858 - RNA, 20 nt, Artificial Sequence
  MKO10004858_A_Arfgap2
  gRNA
acuuaggccuguuucgauug

SEQ ID NO: 4859 - RNA, 20 nt, Artificial Sequence
  MKO10004859_A_Arfgap2
  gRNA
cgcucaagcaccuuguuggu

SEQ ID NO: 4860 - RNA, 20 nt, Artificial Sequence
  MKO10004860_A_Arfgap3
  gRNA
ucaagugaaccccgagcgac

SEQ ID NO: 4861 - RNA, 20 nt, Artificial Sequence
  MKO10004861_A_Arfgap3
  gRNA
cagcuucgaugcaugcaagu

SEQ ID NO: 4862 - RNA, 20 nt, Artificial Sequence
  MKO10004862_A_Arfgap3
  gRNA
caacuugcaugcaucgaagc

SEQ ID NO: 4863 - RNA, 20 nt, Artificial Sequence
  MKO10004863_A_Arfgef1
  gRNA
gcuccagauaguacgacacc

SEQ ID NO: 4864 - RNA, 20 nt, Artificial Sequence
  MKO10004864_A_Arfgef1
  gRNA
gaacguuaucuuugcacgca

SEQ ID NO: 4865 - RNA, 20 nt, Artificial Sequence
  MKO10004865_A_Arfgef1
  gRNA
cuagagauguacuaacuaug

SEQ ID NO: 4866 - RNA, 20 nt, Artificial Sequence
  MKO10004866_A_Arfgef2
  gRNA
uggcggugguuugauugaug

SEQ ID NO: 4867 - RNA, 20 nt, Artificial Sequence
  MKO10004867_A_Arfgef2
  gRNA
caucaaucaaaccaccgcca

SEQ ID NO: 4868 - RNA, 20 nt, Artificial Sequence
  MKO10004868_A_Arfgef2
  gRNA
cugucgaucagccgcuuccc

SEQ ID NO: 4869 - RNA, 20 nt, Artificial Sequence
  MKO10004869_A_Arfip1
  gRNA
cuggaaaagcugcgucgaca

SEQ ID NO: 4870 - RNA, 20 nt, Artificial Sequence
  MKO10004870_A_Arfip1
  gRNA
cuuacuagcugccacccugc

SEQ ID NO: 4871 - RNA, 20 nt, Artificial Sequence
  MKO10004871_A_Arfip1
  gRNA
uugaagcauucauuaccauc

SEQ ID NO: 4872 - RNA, 20 nt, Artificial Sequence
  MKO10004872_A_Arfip2
  gRNA
ucucacagcacgucacccuc

SEQ ID NO: 4873 - RNA, 20 nt, Artificial Sequence
  MKO10004873_A_Arfip2
  gRNA
ugaccuauaggaccuccagc

SEQ ID NO: 4874 - RNA, 20 nt, Artificial Sequence
  MKO10004874_A_Arfip2
  gRNA
aaugaaacuagcauuguguc

SEQ ID NO: 4875 - RNA, 20 nt, Artificial Sequence
  MKO10004875_A_Arfrp1
  gRNA
ggugguuucgagugaagcac

SEQ ID NO: 4876 - RNA, 20 nt, Artificial Sequence
  MKO10004876_A_Arfrp1
  gRNA
auccaaaaucaccacuaccg

SEQ ID NO: 4877 - RNA, 20 nt, Artificial Sequence
  MKO10004877_A_Arfrp1
  gRNA
ccccuuacuguuuagaccca

SEQ ID NO: 4878 - RNA, 20 nt, Artificial Sequence
  MKO10004878_A_Arg1
  gRNA
cuugcgagacguagacccug

SEQ ID NO: 4879 - RNA, 20 nt, Artificial Sequence
  MKO10004879_A_Arg1
  gRNA
aagcaucucuggccacgcca

SEQ ID NO: 4880 - RNA, 20 nt, Artificial Sequence
  MKO10004880_A_Arg1
  gRNA
gccaauguacacgaugucuu

SEQ ID NO: 4881 - RNA, 20 nt, Artificial Sequence
  MKO10004881_A_Arg2
  gRNA
gugccgggcgugaccgauaa

SEQ ID NO: 4882 - RNA, 20 nt, Artificial Sequence
  MKO10004882_A_Arg2
  gRNA
cccccaaauauuguguacau

SEQ ID NO: 4883 - RNA, 20 nt, Artificial Sequence
  MKO10004883_A_Arg2
  gRNA
uucagugggccuugccaacc

SEQ ID NO: 4884 - RNA, 20 nt, Artificial Sequence
  MKO10004884_A_Arglu1
  gRNA
cccgaccgcaucgacaucuu

SEQ ID NO: 4885 - RNA, 20 nt, Artificial Sequence
  MKO10004885_A_Arglu1
  gRNA
uugagcgagaaguucuccga

SEQ ID NO: 4886 - RNA, 20 nt, Artificial Sequence
  MKO10004886_A_Arglu1
  gRNA
gcgcgaggaugggccggucg

SEQ ID NO: 4887 - RNA, 20 nt, Artificial Sequence
  MKO10004887_A_Arhgap10
  gRNA
aaaguuagaaaauucccgua

SEQ ID NO: 4888 - RNA, 20 nt, Artificial Sequence
  MKO10004888_A_Arhgap10
  gRNA
gcgagugagcgaacuuccuc

SEQ ID NO: 4889 - RNA, 20 nt, Artificial Sequence
  MKO10004889_A_Arhgap10
  gRNA
agcacuugacgcugucugcc

SEQ ID NO: 4890 - RNA, 20 nt, Artificial Sequence
  MKO10004890_A_Arhgap11a
  gRNA
ggggucuguuguucgucuaa

SEQ ID NO: 4891 - RNA, 20 nt, Artificial Sequence
  MKO10004891_A_Arhgap11a
  gRNA
agagaagaagcuacgucugc

SEQ ID NO: 4892 - RNA, 20 nt, Artificial Sequence
  MKO10004892_A_Arhgap11a
  gRNA
gcacuuccgugugauguugc

SEQ ID NO: 4893 - RNA, 20 nt, Artificial Sequence
  MKO10004893_A_Arhgap12
  gRNA
cucacaucucgagcccaucg

SEQ ID NO: 4894 - RNA, 20 nt, Artificial Sequence
  MKO10004894_A_Arhgap12
  gRNA
ugcaggacaagcguauauug

SEQ ID NO: 4895 - RNA, 20 nt, Artificial Sequence
  MKO10004895_A_Arhgap12
  gRNA
guuccuugaacagaugacga

SEQ ID NO: 4896 - RNA, 20 nt, Artificial Sequence
  MKO10004896_A_Arhgap15
  gRNA
uccaugauccucaccgaugc

SEQ ID NO: 4897 - RNA, 20 nt, Artificial Sequence
  MKO10004897_A_Arhgap15
  gRNA
ucgaccagaaagaacaaucc

SEQ ID NO: 4898 - RNA, 20 nt, Artificial Sequence
  MKO10004898_A_Arhgap15
  gRNA
ggaaaaacuggucuacuucc

SEQ ID NO: 4899 - RNA, 20 nt, Artificial Sequence
  MKO10004899_A_Arhgap17
  gRNA
uuggcagauugaacgucgcc

SEQ ID NO: 4900 - RNA, 20 nt, Artificial Sequence
  MKO10004900_A_Arhgap17
  gRNA
ucgccugccgacagucugau

SEQ ID NO: 4901 - RNA, 20 nt, Artificial Sequence
  MKO10004901_A_Arhgap17
  gRNA
agcauggcacugaugccgag

SEQ ID NO: 4902 - RNA, 20 nt, Artificial Sequence
  MKO10004902_A_Arhgap18
  gRNA
agagucuauugaugacccgc

SEQ ID NO: 4903 - RNA, 20 nt, Artificial Sequence
  MKO10004903_A_Arhgap18
  gRNA
ugagaacucgaucgaucaaa

SEQ ID NO: 4904 - RNA, 20 nt, Artificial Sequence
  MKO10004904_A_Arhgap18
  gRNA
auuugaucgaucgaguucuc

SEQ ID NO: 4905 - RNA, 20 nt, Artificial Sequence
  MKO10004905_A_Arhgap19
  gRNA
auuuggaucuccguugacgg

SEQ ID NO: 4906 - RNA, 20 nt, Artificial Sequence
  MKO10004906_A_Arhgap19
  gRNA
agauaauaggcugaccucga

SEQ ID NO: 4907 - RNA, 20 nt, Artificial Sequence
  MKO10004907_A_Arhgap19
  gRNA
cuccggccagagucgcagac

SEQ ID NO: 4908 - RNA, 20 nt, Artificial Sequence
  MKO10004908_A_Arhgap1
  gRNA
cacucaggugaugauaagua

SEQ ID NO: 4909 - RNA, 20 nt, Artificial Sequence
  MKO10004909_A_Arhgap1
  gRNA
uaccggcuacuuccacaauc

SEQ ID NO: 4910 - RNA, 20 nt, Artificial Sequence
  MKO10004910_A_Arhgap1
  gRNA
cccacuugcggucaaacucu

SEQ ID NO: 4911 - RNA, 20 nt, Artificial Sequence
  MKO10004911_A_Arhgap20
  gRNA
aagcgccccgucccucaucc

SEQ ID NO: 4912 - RNA, 20 nt, Artificial Sequence
  MKO10004912_A_Arhgap20
  gRNA
ggugcucggccgcuucugua

SEQ ID NO: 4913 - RNA, 20 nt, Artificial Sequence
  MKO10004913_A_Arhgap20
  gRNA
agacaaacagaucguugaau

SEQ ID NO: 4914 - RNA, 20 nt, Artificial Sequence
  MKO10004914_A_Arhgap21
  gRNA
ggagggccggccuucgaggc

SEQ ID NO: 4915 - RNA, 20 nt, Artificial Sequence
  MKO10004915_A_Arhgap21
  gRNA
ugugcauaagccagccucga

SEQ ID NO: 4916 - RNA, 20 nt, Artificial Sequence
  MKO10004916_A_Arhgap21
  gRNA
augaaaugauggccacacau

SEQ ID NO: 4917 - RNA, 20 nt, Artificial Sequence
  MKO10004917_A_Arhgap22
  gRNA
uccagcucgcucgaagagcc

SEQ ID NO: 4918 - RNA, 20 nt, Artificial Sequence
  MKO10004918_A_Arhgap22
  gRNA
ggcccagaugacacggcgga

SEQ ID NO: 4919 - RNA, 20 nt, Artificial Sequence
  MKO10004919_A_Arhgap22
  gRNA
caccuguuugagauuacgcc

SEQ ID NO: 4920 - RNA, 20 nt, Artificial Sequence
  MKO10004920_A_Arhgap23
  gRNA
cuuggagcgcuccgugguga

SEQ ID NO: 4921 - RNA, 20 nt, Artificial Sequence
  MKO10004921_A_Arhgap23
  gRNA
caugggcuuaccggagcacu

SEQ ID NO: 4922 - RNA, 20 nt, Artificial Sequence
  MKO10004922_A_Arhgap23
  gRNA
agaagcuccgcagcacucgu

SEQ ID NO: 4923 - RNA, 20 nt, Artificial Sequence
  MKO10004923_A_Arhgap24
  gRNA
uccccauaugacucggcgga

SEQ ID NO: 4924 - RNA, 20 nt, Artificial Sequence
  MKO10004924_A_Arhgap24
  gRNA
uccaacauaccugucgaagg

SEQ ID NO: 4925 - RNA, 20 nt, Artificial Sequence
  MKO10004925_A_Arhgap24
  gRNA
guguggacuucauccgacag

SEQ ID NO: 4926 - RNA, 20 nt, Artificial Sequence
  MKO10004926_A_Arhgap25
  gRNA
cguaggagucuuguccaaug

SEQ ID NO: 4927 - RNA, 20 nt, Artificial Sequence
  MKO10004927_A_Arhgap25
  gRNA
ucaagugaccagaaccgcau

SEQ ID NO: 4928 - RNA, 20 nt, Artificial Sequence
  MKO10004928_A_Arhgap25
  gRNA
agcgguguuuggccagcguc

SEQ ID NO: 4929 - RNA, 20 nt, Artificial Sequence
  MKO10004929_A_Arhgap26
  gRNA
ugaagacgagcggagucgaa

SEQ ID NO: 4930 - RNA, 20 nt, Artificial Sequence
  MKO10004930_A_Arhgap26
  gRNA
acccuuggagaaguuucgaa

SEQ ID NO: 4931 - RNA, 20 nt, Artificial Sequence
  MKO10004931_A_Arhgap26
  gRNA
ucagaucgagaaugccagcg

SEQ ID NO: 4932 - RNA, 20 nt, Artificial Sequence
  MKO10004932_A_Arhgap27
  gRNA
cccgcagguggacgaccccc

SEQ ID NO: 4933 - RNA, 20 nt, Artificial Sequence
  MKO10004933_A_Arhgap27
  gRNA
aacagacuaccccgaauuac

SEQ ID NO: 4934 - RNA, 20 nt, Artificial Sequence
  MKO10004934_A_Arhgap27
  gRNA
ccgagguugccucucuacau

SEQ ID NO: 4935 - RNA, 20 nt, Artificial Sequence
  MKO10004935_A_Arhgap28
  gRNA
cucgcugccgacgaaucaac

SEQ ID NO: 4936 - RNA, 20 nt, Artificial Sequence
  MKO10004936_A_Arhgap28
  gRNA
aguaguaccacccuauccaa

SEQ ID NO: 4937 - RNA, 20 nt, Artificial Sequence
  MKO10004937_A_Arhgap28
  gRNA
agagcauccuguugauucgu

SEQ ID NO: 4938 - RNA, 20 nt, Artificial Sequence
  MKO10004938_A_Arhgap29
  gRNA
agaagucauucauauccguc

SEQ ID NO: 4939 - RNA, 20 nt, Artificial Sequence
  MKO10004939_A_Arhgap29
  gRNA
accuuacuuucucgagaaau

SEQ ID NO: 4940 - RNA, 20 nt, Artificial Sequence
  MKO10004940_A_Arhgap29
  gRNA
ugcagcgcucugaagaucua

SEQ ID NO: 4941 - RNA, 20 nt, Artificial Sequence
  MKO10004941_A_Arhgap30
  gRNA
ggaauuccuuaugcgccacu

SEQ ID NO: 4942 - RNA, 20 nt, Artificial Sequence
  MKO10004942_A_Arhgap30
  gRNA
uaaacaucccggcgcagguc

SEQ ID NO: 4943 - RNA, 20 nt, Artificial Sequence
  MKO10004943_A_Arhgap30
  gRNA
aguggcgcauaaggaauucc

SEQ ID NO: 4944 - RNA, 20 nt, Artificial Sequence
  MKO10004944_A_Arhgap31
  gRNA
ggaauaccugauucgacacc

SEQ ID NO: 4945 - RNA, 20 nt, Artificial Sequence
  MKO10004945_A_Arhgap31
  gRNA
ggauggaaucuaucgccucu

SEQ ID NO: 4946 - RNA, 20 nt, Artificial Sequence
  MKO10004946_A_Arhgap31
  gRNA
auuuagcuuaccucagccgc

SEQ ID NO: 4947 - RNA, 20 nt, Artificial Sequence
  MKO10004947_A_Arhgap32
  gRNA
gcugcacagcguucaucgag

SEQ ID NO: 4948 - RNA, 20 nt, Artificial Sequence
  MKO10004948_A_Arhgap32
  gRNA
cagagaacuucucguauagc

SEQ ID NO: 4949 - RNA, 20 nt, Artificial Sequence
  MKO10004949_A_Arhgap32
  gRNA
gaugggauauaucgucucuc

SEQ ID NO: 4950 - RNA, 20 nt, Artificial Sequence
  MKO10004950_A_Arhgap33
  gRNA
gugcagcccguacccacuac

SEQ ID NO: 4951 - RNA, 20 nt, Artificial Sequence
  MKO10004951_A_Arhgap33
  gRNA
uccaccggugcauauuugac

SEQ ID NO: 4952 - RNA, 20 nt, Artificial Sequence
  MKO10004952_A_Arhgap33
  gRNA
cuaugacgauuuccguucuc

SEQ ID NO: 4953 - RNA, 20 nt, Artificial Sequence
  MKO10004953_A_Arhgap36
  gRNA
ucaguucacgcugcuugcga

SEQ ID NO: 4954 - RNA, 20 nt, Artificial Sequence
  MKO10004954_A_Arhgap36
  gRNA
ccuagagaguucacucgccg

SEQ ID NO: 4955 - RNA, 20 nt, Artificial Sequence
  MKO10004955_A_Arhgap36
  gRNA
aaugucuggccacgaguucg

SEQ ID NO: 4956 - RNA, 20 nt, Artificial Sequence
  MKO10004956_A_Arhgap39
  gRNA
gcgcaucaagcgcaccagcg

SEQ ID NO: 4957 - RNA, 20 nt, Artificial Sequence
  MKO10004957_A_Arhgap39
  gRNA
gcuccugcucaucgacauga

SEQ ID NO: 4958 - RNA, 20 nt, Artificial Sequence
  MKO10004958_A_Arhgap39
  gRNA
cgaacguauguaugccaacc

SEQ ID NO: 4959 - RNA, 20 nt, Artificial Sequence
  MKO10004959_A_Arhgap40
  gRNA
cucagcccgaagacgacaaa

SEQ ID NO: 4960 - RNA, 20 nt, Artificial Sequence
  MKO10004960_A_Arhgap40
  gRNA
uuugucgucuucgggcugag

SEQ ID NO: 4961 - RNA, 20 nt, Artificial Sequence
  MKO10004961_A_Arhgap40
  gRNA
cggcaggggucccuugcccc

SEQ ID NO: 4962 - RNA, 20 nt, Artificial Sequence
  MKO10004962_A_Arhgap42
  gRNA
agucacugaaagaauucgca

SEQ ID NO: 4963 - RNA, 20 nt, Artificial Sequence
  MKO10004963_A_Arhgap42
  gRNA
gacuuccaguuugaguguau

SEQ ID NO: 4964 - RNA, 20 nt, Artificial Sequence
  MKO10004964_A_Arhgap42
  gRNA
caucuccaauacacucaaac

SEQ ID NO: 4965 - RNA, 20 nt, Artificial Sequence
  MKO10004965_A_Arhgap44
  gRNA
gguggagggguccgcgaucc

SEQ ID NO: 4966 - RNA, 20 nt, Artificial Sequence
  MKO10004966_A_Arhgap44
  gRNA
caagaagcgugucaucgccc

SEQ ID NO: 4967 - RNA, 20 nt, Artificial Sequence
  MKO10004967_A_Arhgap44
  gRNA
gguacuuacugaucgcuugu

SEQ ID NO: 4968 - RNA, 20 nt, Artificial Sequence
  MKO10004968_A_Arhgap4
  gRNA
caacuucccgugcgccgcca

SEQ ID NO: 4969 - RNA, 20 nt, Artificial Sequence
  MKO10004969_A_Arhgap4
  gRNA
ccuugggccauggcggcgca

SEQ ID NO: 4970 - RNA, 20 nt, Artificial Sequence
  MKO10004970_A_Arhgap4
  gRNA
gaacgcuuuaccagccgcag

SEQ ID NO: 4971 - RNA, 20 nt, Artificial Sequence
  MKO10004971_A_Arhgap5
  gRNA
uucuuaggauuauguacuga

SEQ ID NO: 4972 - RNA, 20 nt, Artificial Sequence
  MKO10004972_A_Arhgap5
  gRNA
ucucagcuguaaccagaucc

SEQ ID NO: 4973 - RNA, 20 nt, Artificial Sequence
  MKO10004973_A_Arhgap5
  gRNA
uggagugaauauggaaucaa

SEQ ID NO: 4974 - RNA, 20 nt, Artificial Sequence
  MKO10004974_A_Arhgap6
  gRNA
cuggucguagcgugcgccug

SEQ ID NO: 4975 - RNA, 20 nt, Artificial Sequence
  MKO10004975_A_Arhgap6
  gRNA
cuuccagggcgccauguccg

SEQ ID NO: 4976 - RNA, 20 nt, Artificial Sequence
  MKO10004976_A_Arhgap6
  gRNA
uucggugauguagacucauu

SEQ ID NO: 4977 - RNA, 20 nt, Artificial Sequence
  MKO10004977_A_Arhgap8
  gRNA
ggcccucaccgcacuacuuc

SEQ ID NO: 4978 - RNA, 20 nt, Artificial Sequence
  MKO10004978_A_Arhgap8
  gRNA
uccuccaggggaugaccgcc

SEQ ID NO: 4979 - RNA, 20 nt, Artificial Sequence
  MKO10004979_A_Arhgap8
  gRNA
uauagucguucuccacaugc

SEQ ID NO: 4980 - RNA, 20 nt, Artificial Sequence
  MKO10004980_A_Arhgap9
  gRNA
cacucacgugcaggacguuc

SEQ ID NO: 4981 - RNA, 20 nt, Artificial Sequence
  MKO10004981_A_Arhgap9
  gRNA
cgcagguccacgcuacucuc

SEQ ID NO: 4982 - RNA, 20 nt, Artificial Sequence
  MKO10004982_A_Arhgap9
  gRNA
cagacugcgguggccgcucu

SEQ ID NO: 4983 - RNA, 20 nt, Artificial Sequence
  MKO10004983_A_Arhgdia
  gRNA
cauugugacucgacugaccu

SEQ ID NO: 4984 - RNA, 20 nt, Artificial Sequence
  MKO10004984_A_Arhgdia
  gRNA
aacucauacuccucggcccu

SEQ ID NO: 4985 - RNA, 20 nt, Artificial Sequence
  MKO10004985_A_Arhgdia
  gRNA
gagcuaugggccgagggccg

SEQ ID NO: 4986 - RNA, 20 nt, Artificial Sequence
  MKO10004986_A_Arhgdib
  gRNA
cucuucuacaggcgaucucg

SEQ ID NO: 4987 - RNA, 20 nt, Artificial Sequence
  MKO10004987_A_Arhgdib
  gRNA
cagcuaugggccccgaccag

SEQ ID NO: 4988 - RNA, 20 nt, Artificial Sequence
  MKO10004988_A_Arhgdib
  gRNA
aagccggguaacagucacgu

SEQ ID NO: 4989 - RNA, 20 nt, Artificial Sequence
  MKO10004989_A_Arhgdig
  gRNA
accacgcaguccccgacgau

SEQ ID NO: 4990 - RNA, 20 nt, Artificial Sequence
  MKO10004990_A_Arhgdig
  gRNA
gucugcaucacaccuaucgu

SEQ ID NO: 4991 - RNA, 20 nt, Artificial Sequence
  MKO10004991_A_Arhgdig
  gRNA
cuugaccaagcucacguccc

SEQ ID NO: 4992 - RNA, 20 nt, Artificial Sequence
  MKO10004992_A_Arhgef10l
  gRNA
gcggugggcgcagcgaucuc

SEQ ID NO: 4993 - RNA, 20 nt, Artificial Sequence
  MKO10004993_A_Arhgef10l
  gRNA
ucccuggccucgccccugag

SEQ ID NO: 4994 - RNA, 20 nt, Artificial Sequence
  MKO10004994_A_Arhgef10l
  gRNA
uccggcgcuccagcuggaag

SEQ ID NO: 4995 - RNA, 20 nt, Artificial Sequence
  MKO10004995_A_Arhgef10
  gRNA
cgggacuugccgauccgcuu

SEQ ID NO: 4996 - RNA, 20 nt, Artificial Sequence
  MKO10004996_A_Arhgef10
  gRNA
aagucccgucugccgacgau

SEQ ID NO: 4997 - RNA, 20 nt, Artificial Sequence
  MKO10004997_A_Arhgef10
  gRNA
cauccgagccgagucuguag

SEQ ID NO: 4998 - RNA, 20 nt, Artificial Sequence
  MKO10004998_A_Arhgef11
  gRNA
gcgcugugucaucauccaaa

SEQ ID NO: 4999 - RNA, 20 nt, Artificial Sequence
  MKO10004999_A_Arhgef11
  gRNA
ccaacagguaaacggcacca

SEQ ID NO: 5000 - RNA, 20 nt, Artificial Sequence
  MKO10005000_A_Arhgef11
  gRNA
guuuacucacuuugaugauc

SEQ ID NO: 5001 - RNA, 20 nt, Artificial Sequence
  MKO10005001_A_Arhgef12
  gRNA
cgaagccauugucgucuuuc

SEQ ID NO: 5002 - RNA, 20 nt, Artificial Sequence
  MKO10005002_A_Arhgef12
  gRNA
uugacagauuguacgaagac

SEQ ID NO: 5003 - RNA, 20 nt, Artificial Sequence
  MKO10005003_A_Arhgef12
  gRNA
caucagcuuaccauagaucu

SEQ ID NO: 5004 - RNA, 20 nt, Artificial Sequence
  MKO10005004_A_Arhgef15
  gRNA
gcgcucggcaguggagcgau

SEQ ID NO: 5005 - RNA, 20 nt, Artificial Sequence
  MKO10005005_A_Arhgef15
  gRNA
uaaagaccuaccguccugca

SEQ ID NO: 5006 - RNA, 20 nt, Artificial Sequence
  MKO10005006_A_Arhgef15
  gRNA
ccuccugcaugcgccgcucc

SEQ ID NO: 5007 - RNA, 20 nt, Artificial Sequence
  MKO10005007_A_Arhgef16
  gRNA
cuuccguugacagcgugucc

SEQ ID NO: 5008 - RNA, 20 nt, Artificial Sequence
  MKO10005008_A_Arhgef16
  gRNA
uguccuggacacgcugucaa

SEQ ID NO: 5009 - RNA, 20 nt, Artificial Sequence
  MKO10005009_A_Arhgef16
  gRNA
ugguguucaaaccccgcucu

SEQ ID NO: 5010 - RNA, 20 nt, Artificial Sequence
  MKO10005010_A_Arhgef17
  gRNA
cuugcugugcgacccgucuc

SEQ ID NO: 5011 - RNA, 20 nt, Artificial Sequence
  MKO10005011_A_Arhgef17
  gRNA
ugcggcacugcgugcaaacg

SEQ ID NO: 5012 - RNA, 20 nt, Artificial Sequence
  MKO10005012_A_Arhgef17
  gRNA
gauguucaccaagacgucuu

SEQ ID NO: 5013 - RNA, 20 nt, Artificial Sequence
  MKO10005013_A_Arhgef18
  gRNA
uccgugcgcugaugacuuac

SEQ ID NO: 5014 - RNA, 20 nt, Artificial Sequence
  MKO10005014_A_Arhgef18
  gRNA
acuccugccggcgcuccuua

SEQ ID NO: 5015 - RNA, 20 nt, Artificial Sequence
  MKO10005015_A_Arhgef18
  gRNA
aagagacaggacguccuaua

SEQ ID NO: 5016 - RNA, 20 nt, Artificial Sequence
  MKO10005016_A_Arhgef19
  gRNA
ucguuuagaucgacgggucc

SEQ ID NO: 5017 - RNA, 20 nt, Artificial Sequence
  MKO10005017_A_Arhgef19
  gRNA
uccgcgcgcaacgcucgacg

SEQ ID NO: 5018 - RNA, 20 nt, Artificial Sequence
  MKO10005018_A_Arhgef19
  gRNA
auccccgacgugcgcggcag

SEQ ID NO: 5019 - RNA, 20 nt, Artificial Sequence
  MKO10005019_A_Arhgef1
  gRNA
auccuccgccccgaugauga

SEQ ID NO: 5020 - RNA, 20 nt, Artificial Sequence
  MKO10005020_A_Arhgef1
  gRNA
guggcccugcaguucgagcc

SEQ ID NO: 5021 - RNA, 20 nt, Artificial Sequence
  MKO10005021_A_Arhgef1
  gRNA
gcuucacuugcucuaggcuc

SEQ ID NO: 5022 - RNA, 20 nt, Artificial Sequence
  MKO10005022_A_Arhgef25
  gRNA
ccguguucuccgauuccccc

SEQ ID NO: 5023 - RNA, 20 nt, Artificial Sequence
  MKO10005023_A_Arhgef25
  gRNA
gaccuuacugacuacauugc

SEQ ID NO: 5024 - RNA, 20 nt, Artificial Sequence
  MKO10005024_A_Arhgef25
  gRNA
cccccggagagagaucccuu

SEQ ID NO: 5025 - RNA, 20 nt, Artificial Sequence
  MKO10005025_A_Arhgef26
  gRNA
ccucaucagagucgauauca

SEQ ID NO: 5026 - RNA, 20 nt, Artificial Sequence
  MKO10005026_A_Arhgef26
  gRNA
aaacacucaccgcggagagc

SEQ ID NO: 5027 - RNA, 20 nt, Artificial Sequence
  MKO10005027_A_Arhgef26
  gRNA
ucuccaacauuaccgauguc

SEQ ID NO: 5028 - RNA, 20 nt, Artificial Sequence
  MKO10005028_A_Arhgef28
  gRNA
ccgacugcgucuuaacgaag

SEQ ID NO: 5029 - RNA, 20 nt, Artificial Sequence
  MKO10005029_A_Arhgef28
  gRNA
ccucuucguuaagacgcagu

SEQ ID NO: 5030 - RNA, 20 nt, Artificial Sequence
  MKO10005030_A_Arhgef28
  gRNA
ggugauugcugaccgugucc

SEQ ID NO: 5031 - RNA, 20 nt, Artificial Sequence
  MKO10005031_A_Arhgef2
  gRNA
gcacauggucaugccggaga

SEQ ID NO: 5032 - RNA, 20 nt, Artificial Sequence
  MKO10005032_A_Arhgef2
  gRNA
ggcagacguuggccgcucuc

SEQ ID NO: 5033 - RNA, 20 nt, Artificial Sequence
  MKO10005033_A_Arhgef2
  gRNA
caaccgcuguaaagacaccc

SEQ ID NO: 5034 - RNA, 20 nt, Artificial Sequence
  MKO10005034_A_Arhgef33
  gRNA
cauguuggugaagucgucac

SEQ ID NO: 5035 - RNA, 20 nt, Artificial Sequence
  MKO10005035_A_Arhgef33
  gRNA
aagaacauggcgcgcaggcc

SEQ ID NO: 5036 - RNA, 20 nt, Artificial Sequence
  MKO10005036_A_Arhgef33
  gRNA
ccaacauggagaauacgcuu

SEQ ID NO: 5037 - RNA, 20 nt, Artificial Sequence
  MKO10005037_A_Arhgef37
  gRNA
aacaggauguccagaucgcc

SEQ ID NO: 5038 - RNA, 20 nt, Artificial Sequence
  MKO10005038_A_Arhgef37
  gRNA
caacgaauacaagaugcgca

SEQ ID NO: 5039 - RNA, 20 nt, Artificial Sequence
  MKO10005039_A_Arhgef37
  gRNA
gcuggucaaggcguaccaga

SEQ ID NO: 5040 - RNA, 20 nt, Artificial Sequence
  MKO10005040_A_Arhgef38
  gRNA
aaacauaccgauuacuugca

SEQ ID NO: 5041 - RNA, 20 nt, Artificial Sequence
  MKO10005041_A_Arhgef38
  gRNA
caaagcgggccaagaucauc

SEQ ID NO: 5042 - RNA, 20 nt, Artificial Sequence
  MKO10005042_A_Arhgef38
  gRNA
gcaacaagugggacggauga

SEQ ID NO: 5043 - RNA, 20 nt, Artificial Sequence
  MKO10005043_A_Arhgef39
  gRNA
caaauugggcguagagcucc

SEQ ID NO: 5044 - RNA, 20 nt, Artificial Sequence
  MKO10005044_A_Arhgef39
  gRNA
agaaccuacgugugagcugc

SEQ ID NO: 5045 - RNA, 20 nt, Artificial Sequence
  MKO10005045_A_Arhgef39
  gRNA
agcugaagaccccuaaauuc

SEQ ID NO: 5046 - RNA, 20 nt, Artificial Sequence
  MKO10005046_A_Arhgef3
  gRNA
ugucggggcggcucucgcug

SEQ ID NO: 5047 - RNA, 20 nt, Artificial Sequence
  MKO10005047_A_Arhgef3
  gRNA
cugauugacacacacaucga

SEQ ID NO: 5048 - RNA, 20 nt, Artificial Sequence
  MKO10005048_A_Arhgef3
  gRNA
gcgcuucagccagaccuugc

SEQ ID NO: 5049 - RNA, 20 nt, Artificial Sequence
  MKO10005049_A_Arhgef40
  gRNA
guacccgcccguaagagcac

SEQ ID NO: 5050 - RNA, 20 nt, Artificial Sequence
  MKO10005050_A_Arhgef40
  gRNA
agggccggcaccggagacac

SEQ ID NO: 5051 - RNA, 20 nt, Artificial Sequence
  MKO10005051_A_Arhgef40
  gRNA
cguaccaggaggaugcgcug

SEQ ID NO: 5052 - RNA, 20 nt, Artificial Sequence
  MKO10005052_A_Arhgef4
  gRNA
gcaccuucgcgacaucugcg

SEQ ID NO: 5053 - RNA, 20 nt, Artificial Sequence
  MKO10005053_A_Arhgef4
  gRNA
ucaccucgcagaugucgcga

SEQ ID NO: 5054 - RNA, 20 nt, Artificial Sequence
  MKO10005054_A_Arhgef4
  gRNA
auguccgccagugccgcaaa

SEQ ID NO: 5055 - RNA, 20 nt, Artificial Sequence
  MKO10005055_A_Arhgef5
  gRNA
agugccuuucgacgaugccg

SEQ ID NO: 5056 - RNA, 20 nt, Artificial Sequence
  MKO10005056_A_Arhgef5
  gRNA
uuccccacggcaucgucgaa

SEQ ID NO: 5057 - RNA, 20 nt, Artificial Sequence
  MKO10005057_A_Arhgef5
  gRNA
cagcuauguuuagacugcgc

SEQ ID NO: 5058 - RNA, 20 nt, Artificial Sequence
  MKO10005058_A_Arhgef6
  gRNA
agaaauuggcccccgaauag

SEQ ID NO: 5059 - RNA, 20 nt, Artificial Sequence
  MKO10005059_A_Arhgef6
  gRNA
cagcucucagacaaacccgc

SEQ ID NO: 5060 - RNA, 20 nt, Artificial Sequence
  MKO10005060_A_Arhgef6
  gRNA
aucuugccuuuacuaucaac

SEQ ID NO: 5061 - RNA, 20 nt, Artificial Sequence
  MKO10005061_A_Arhgef7
  gRNA
gaucucucgaacguaguugc

SEQ ID NO: 5062 - RNA, 20 nt, Artificial Sequence
  MKO10005062_A_Arhgef7
  gRNA
acuuggcucguacuaccagu

SEQ ID NO: 5063 - RNA, 20 nt, Artificial Sequence
  MKO10005063_A_Arhgef7
  gRNA
gucguaucgaacccuuuggg

SEQ ID NO: 5064 - RNA, 20 nt, Artificial Sequence
  MKO10005064_A_Arhgef9
  gRNA
aucccuccucaucgucgauc

SEQ ID NO: 5065 - RNA, 20 nt, Artificial Sequence
  MKO10005065_A_Arhgef9
  gRNA
uaggagcucggccaauugua

SEQ ID NO: 5066 - RNA, 20 nt, Artificial Sequence
  MKO10005066_A_Arhgef9
  gRNA
augaucgacauugcuauuga

SEQ ID NO: 5067 - RNA, 20 nt, Artificial Sequence
  MKO10005067_A_Arid1a
  gRNA
gcccugcuggccauacgcac

SEQ ID NO: 5068 - RNA, 20 nt, Artificial Sequence
  MKO10005068_A_Arid1a
  gRNA
ggucccuguuguugcgagua

SEQ ID NO: 5069 - RNA, 20 nt, Artificial Sequence
  MKO10005069_A_Arid1a
  gRNA
uaacccauacucgcaacaac

SEQ ID NO: 5070 - RNA, 20 nt, Artificial Sequence
  MKO10005070_A_Arid1b
  gRNA
cugugcaccugggggaccgu

SEQ ID NO: 5071 - RNA, 20 nt, Artificial Sequence
  MKO10005071_A_Arid1b
  gRNA
acaguaccugcagccggcgg

SEQ ID NO: 5072 - RNA, 20 nt, Artificial Sequence
  MKO10005072_A_Arid1b
  gRNA
agaucggaccagaccucgau

SEQ ID NO: 5073 - RNA, 20 nt, Artificial Sequence
  MKO10005073_A_Arid2
  gRNA
uaccagcaacacagcguguc

SEQ ID NO: 5074 - RNA, 20 nt, Artificial Sequence
  MKO10005074_A_Arid2
  gRNA
auagcgaaguccacuucauu

SEQ ID NO: 5075 - RNA, 20 nt, Artificial Sequence
  MKO10005075_A_Arid2
  gRNA
cacuuuacugcucgcuaaug

SEQ ID NO: 5076 - RNA, 20 nt, Artificial Sequence
  MKO10005076_A_Arid3a
  gRNA
ccgccauagacagcaaucgc

SEQ ID NO: 5077 - RNA, 20 nt, Artificial Sequence
  MKO10005077_A_Arid3a
  gRNA
gagcagccccaacgagcucc

SEQ ID NO: 5078 - RNA, 20 nt, Artificial Sequence
  MKO10005078_A_Arid3a
  gRNA
ugcaggccuguucacccgca

SEQ ID NO: 5079 - RNA, 20 nt, Artificial Sequence
  MKO10005079_A_Arid3b
  gRNA
cagccaucgauggcaaccgu

SEQ ID NO: 5080 - RNA, 20 nt, Artificial Sequence
  MKO10005080_A_Arid3b
  gRNA
uacccccggcaucuacucuc

SEQ ID NO: 5081 - RNA, 20 nt, Artificial Sequence
  MKO10005081_A_Arid3b
  gRNA
cugcagcuguaugaacuaga

SEQ ID NO: 5082 - RNA, 20 nt, Artificial Sequence
  MKO10005082_A_Arid3c
  gRNA
gcccgugucucgcacucgua

SEQ ID NO: 5083 - RNA, 20 nt, Artificial Sequence
  MKO10005083_A_Arid3c
  gRNA
gaccgcgaccccgaacugcc

SEQ ID NO: 5084 - RNA, 20 nt, Artificial Sequence
  MKO10005084_A_Arid3c
  gRNA
gguuguggaagcgguaagcg

SEQ ID NO: 5085 - RNA, 20 nt, Artificial Sequence
  MKO10005085_A_Arid4a
  gRNA
gaugucagugccaaguaccg

SEQ ID NO: 5086 - RNA, 20 nt, Artificial Sequence
  MKO10005086_A_Arid4a
  gRNA
cucuuaaagggcccuuuacu

SEQ ID NO: 5087 - RNA, 20 nt, Artificial Sequence
  MKO10005087_A_Arid4a
  gRNA
ggugcaagaugaccaaguaa

SEQ ID NO: 5088 - RNA, 20 nt, Artificial Sequence
  MKO10005088_A_Arid4b
  gRNA
gaaucuugauggugccuauc

SEQ ID NO: 5089 - RNA, 20 nt, Artificial Sequence
  MKO10005089_A_Arid4b
  gRNA
ccuucagugggcccuuuaug

SEQ ID NO: 5090 - RNA, 20 nt, Artificial Sequence
  MKO10005090_A_Arid4b
  gRNA
auugauaaccgcuuccugau

SEQ ID NO: 5091 - RNA, 20 nt, Artificial Sequence
  MKO10005091_A_Arid5a
  gRNA
cccuucagaugccgcacaua

SEQ ID NO: 5092 - RNA, 20 nt, Artificial Sequence
  MKO10005092_A_Arid5a
  gRNA
gcacacgccgccacuaugag

SEQ ID NO: 5093 - RNA, 20 nt, Artificial Sequence
  MKO10005093_A_Arid5a
  gRNA
gccggcuguaccucucauag

SEQ ID NO: 5094 - RNA, 20 nt, Artificial Sequence
  MKO10005094_A_Arid5b
  gRNA
guccaugcuuaaacggaucc

SEQ ID NO: 5095 - RNA, 20 nt, Artificial Sequence
  MKO10005095_A_Arid5b
  gRNA
cuaaugcgaacugguccgug

SEQ ID NO: 5096 - RNA, 20 nt, Artificial Sequence
  MKO10005096_A_Arid5b
  gRNA
gcuaugcaaaucggauccuu

SEQ ID NO: 5097 - RNA, 20 nt, Artificial Sequence
  MKO10005097_A_Arih1
  gRNA
aguauucucgugauaguugc

SEQ ID NO: 5098 - RNA, 20 nt, Artificial Sequence
  MKO10005098_A_Arih1
  gRNA
ccgaugaccuuguauucauc

SEQ ID NO: 5099 - RNA, 20 nt, Artificial Sequence
  MKO10005099_A_Arih1
  gRNA
gaacucgccagaugaauaca

SEQ ID NO: 5100 - RNA, 20 nt, Artificial Sequence
  MKO10005100_A_Arih2
  gRNA
gagacacucacauguuugga

SEQ ID NO: 5101 - RNA, 20 nt, Artificial Sequence
  MKO10005101_A_Arih2
  gRNA
ccuccacauagucccuaaag

SEQ ID NO: 5102 - RNA, 20 nt, Artificial Sequence
  MKO10005102_A_Arih2
  gRNA
uucaacaggaaucucaugua

SEQ ID NO: 5103 - RNA, 20 nt, Artificial Sequence
  MKO10005103_A_Arl10
  gRNA
ugucaacgagguggacgugc

SEQ ID NO: 5104 - RNA, 20 nt, Artificial Sequence
  MKO10005104_A_Arl10
  gRNA
aagcuuacuucggccgcggc

SEQ ID NO: 5105 - RNA, 20 nt, Artificial Sequence
  MKO10005105_A_Arl10
  gRNA
aagcacguucuugcgcaugc

SEQ ID NO: 5106 - RNA, 20 nt, Artificial Sequence
  MKO10005106_A_Arl11
  gRNA
augaugggccucgacucugc

SEQ ID NO: 5107 - RNA, 20 nt, Artificial Sequence
  MKO10005107_A_Arl11
  gRNA
cgaccuccuuguguacgugc

SEQ ID NO: 5108 - RNA, 20 nt, Artificial Sequence
  MKO10005108_A_Arl11
  gRNA
cgaggcccaucauuaccacc

SEQ ID NO: 5109 - RNA, 20 nt, Artificial Sequence
  MKO10005109_A_Arl13a
  gRNA
caucgcagcccuacaacuau

SEQ ID NO: 5110 - RNA, 20 nt, Artificial Sequence
  MKO10005110_A_Arl13a
  gRNA
uggcaaaagucgucucauag

SEQ ID NO: 5111 - RNA, 20 nt, Artificial Sequence
  MKO10005111_A_Arl13a
  gRNA
uagugacauagcacgcaucc

SEQ ID NO: 5112 - RNA, 20 nt, Artificial Sequence
  MKO10005112_A_Arl13b
  gRNA
uaagccuuacgaucugacac

SEQ ID NO: 5113 - RNA, 20 nt, Artificial Sequence
  MKO10005113_A_Arl13b
  gRNA
gugagagggcugaacgaguc

SEQ ID NO: 5114 - RNA, 20 nt, Artificial Sequence
  MKO10005114_A_Arl13b
  gRNA
gaagacguagcucccacugu

SEQ ID NO: 5115 - RNA, 20 nt, Artificial Sequence
  MKO10005115_A_Arl14epl
  gRNA
caggcugaucuguaacgacg

SEQ ID NO: 5116 - RNA, 20 nt, Artificial Sequence
  MKO10005116_A_Arl14epl
  gRNA
ggcacggguagaagcauccc

SEQ ID NO: 5117 - RNA, 20 nt, Artificial Sequence
  MKO10005117_A_Arl14epl
  gRNA
guuagugagcuccuguugag

SEQ ID NO: 5118 - RNA, 20 nt, Artificial Sequence
  MKO10005118_A_Arl14ep
  gRNA
aucccaagcaguccucgucc

SEQ ID NO: 5119 - RNA, 20 nt, Artificial Sequence
  MKO10005119_A_Arl14ep
  gRNA
agucgugugugguacgaagc

SEQ ID NO: 5120 - RNA, 20 nt, Artificial Sequence
  MKO10005120_A_Arl14ep
  gRNA
caucuaagucaaugacgugc

SEQ ID NO: 5121 - RNA, 20 nt, Artificial Sequence
  MKO10005121_A_Arl14
  gRNA
cauuuccacguugaagccga

SEQ ID NO: 5122 - RNA, 20 nt, Artificial Sequence
  MKO10005122_A_Arl14
  gRNA
uacgugguggacuguuccga

SEQ ID NO: 5123 - RNA, 20 nt, Artificial Sequence
  MKO10005123_A_Arl14
  gRNA
ugagcgccgaagacaucacc

SEQ ID NO: 5124 - RNA, 20 nt, Artificial Sequence
  MKO10005124_A_Arl15
  gRNA
guggucgacacaacguucuc

SEQ ID NO: 5125 - RNA, 20 nt, Artificial Sequence
  MKO10005125_A_Arl15
  gRNA
ugcgcgcccugaauaugacu

SEQ ID NO: 5126 - RNA, 20 nt, Artificial Sequence
  MKO10005126_A_Arl15
  gRNA
uacuggagccgcuacuacca

SEQ ID NO: 5127 - RNA, 20 nt, Artificial Sequence
  MKO10005127_A_Arl16
  gRNA
acaccuaccgugggccgcgu

SEQ ID NO: 5128 - RNA, 20 nt, Artificial Sequence
  MKO10005128_A_Arl16
  gRNA
ugggagagcccccaccgacg

SEQ ID NO: 5129 - RNA, 20 nt, Artificial Sequence
  MKO10005129_A_Arl16
  gRNA
aagaucaccauccgagagcu

SEQ ID NO: 5130 - RNA, 20 nt, Artificial Sequence
  MKO10005130_A_Arl1
  gRNA
aguugugaccgagaucgaau

SEQ ID NO: 5131 - RNA, 20 nt, Artificial Sequence
  MKO10005131_A_Arl1
  gRNA
guccuccuaagucccaaacu

SEQ ID NO: 5132 - RNA, 20 nt, Artificial Sequence
  MKO10005132_A_Arl1
  gRNA
uucagcuauuggauuuaaug

SEQ ID NO: 5133 - RNA, 20 nt, Artificial Sequence
  MKO10005133_A_Arl2bp
  gRNA
gcguaucccaggcuucaaca

SEQ ID NO: 5134 - RNA, 20 nt, Artificial Sequence
  MKO10005134_A_Arl2bp
  gRNA
cgccagccaccucaucuuug

SEQ ID NO: 5135 - RNA, 20 nt, Artificial Sequence
  MKO10005135_A_Arl2bp
  gRNA
cuucaauguacuucucuacc

SEQ ID NO: 5136 - RNA, 20 nt, Artificial Sequence
  MKO10005136_A_Arl2
  gRNA
cgccgaccgccagcgcaugc

SEQ ID NO: 5137 - RNA, 20 nt, Artificial Sequence
  MKO10005137_A_Arl2
  gRNA
agaagucucugcgcuccuac

SEQ ID NO: 5138 - RNA, 20 nt, Artificial Sequence
  MKO10005138_A_Arl2
  gRNA
ggacaccaucuccccgacac

SEQ ID NO: 5139 - RNA, 20 nt, Artificial Sequence
  MKO10005139_A_Arl3
  gRNA
ccagccuccgagaucgcaga

SEQ ID NO: 5140 - RNA, 20 nt, Artificial Sequence
  MKO10005140_A_Arl3
  gRNA
ugcccgcguuguccaagccc

SEQ ID NO: 5141 - RNA, 20 nt, Artificial Sequence
  MKO10005141_A_Arl3
  gRNA
ccaggaacuaacggaauuac

SEQ ID NO: 5142 - RNA, 20 nt, Artificial Sequence
  MKO10005142_A_Arl4a
  gRNA
guaaauaccguaccuaccaa

SEQ ID NO: 5143 - RNA, 20 nt, Artificial Sequence
  MKO10005143_A_Arl4a
  gRNA
aacugagcucaucgacuccu

SEQ ID NO: 5144 - RNA, 20 nt, Artificial Sequence
  MKO10005144_A_Arl4a
  gRNA
acacaauaccaucugugcau

SEQ ID NO: 5145 - RNA, 20 nt, Artificial Sequence
  MKO10005145_A_Arl4c
  gRNA
ucgccgaugauggcgcacgc

SEQ ID NO: 5146 - RNA, 20 nt, Artificial Sequence
  MKO10005146_A_Arl4c
  gRNA
ggaucugccuaagucgcugc

SEQ ID NO: 5147 - RNA, 20 nt, Artificial Sequence
  MKO10005147_A_Arl4c
  gRNA
ggacucggccggcaagacua

SEQ ID NO: 5148 - RNA, 20 nt, Artificial Sequence
  MKO10005148_A_Arl4d
  gRNA
cccugcaugucgucgucauu

SEQ ID NO: 5149 - RNA, 20 nt, Artificial Sequence
  MKO10005149_A_Arl4d
  gRNA
cgucucuucuugcucgaccg

SEQ ID NO: 5150 - RNA, 20 nt, Artificial Sequence
  MKO10005150_A_Arl4d
  gRNA
acccaaugacgacgacaugc

SEQ ID NO: 5151 - RNA, 20 nt, Artificial Sequence
  MKO10005151_A_Arl5a
  gRNA
caagcauguugcgcucuuac

SEQ ID NO: 5152 - RNA, 20 nt, Artificial Sequence
  MKO10005152_A_Arl5a
  gRNA
auaauacccguuuccugaug

SEQ ID NO: 5153 - RNA, 20 nt, Artificial Sequence
  MKO10005153_A_Arl5a
  gRNA
aagaaucacuucguccuucc

SEQ ID NO: 5154 - RNA, 20 nt, Artificial Sequence
  MKO10005154_A_Arl5b
  gRNA
cagucgugcugugcgcucac

SEQ ID NO: 5155 - RNA, 20 nt, Artificial Sequence
  MKO10005155_A_Arl5b
  gRNA
auucuucuuucguaauagcc

SEQ ID NO: 5156 - RNA, 20 nt, Artificial Sequence
  MKO10005156_A_Arl5b
  gRNA
cugugagcgcacagcacgac

SEQ ID NO: 5157 - RNA, 20 nt, Artificial Sequence
  MKO10005157_A_Arl5c
  gRNA
auuagaguaguaaguguccc

SEQ ID NO: 5158 - RNA, 20 nt, Artificial Sequence
  MKO10005158_A_Arl5c
  gRNA
ucggcugcucaccacccggg

SEQ ID NO: 5159 - RNA, 20 nt, Artificial Sequence
  MKO10005159_A_Arl5c
  gRNA
gugccaucaaagaccacccg

SEQ ID NO: 5160 - RNA, 20 nt, Artificial Sequence
  MKO10005160_A_Arl6ip1
  gRNA
caacgacuuaccaaucaggu

SEQ ID NO: 5161 - RNA, 20 nt, Artificial Sequence
  MKO10005161_A_Arl6ip1
  gRNA
cucgauccaucugugcuguc

SEQ ID NO: 5162 - RNA, 20 nt, Artificial Sequence
  MKO10005162_A_Arl6ip1
  gRNA
accaggcucuuucccaucga

SEQ ID NO: 5163 - RNA, 20 nt, Artificial Sequence
  MKO10005163_A_Arl6ip4
  gRNA
aacuggaucgcgauguccuc

SEQ ID NO: 5164 - RNA, 20 nt, Artificial Sequence
  MKO10005164_A_Arl6ip4
  gRNA
ccuuucgaauaacgcucugu

SEQ ID NO: 5165 - RNA, 20 nt, Artificial Sequence
  MKO10005165_A_Arl6ip4
  gRNA
ccgacagagcguuauucgaa

SEQ ID NO: 5166 - RNA, 20 nt, Artificial Sequence
  MKO10005166_A_Arl6ip5
  gRNA
cgggcucugaucguuucgcc

SEQ ID NO: 5167 - RNA, 20 nt, Artificial Sequence
  MKO10005167_A_Arl6ip5
  gRNA
cgggcgaaacgaucagagcc

SEQ ID NO: 5168 - RNA, 20 nt, Artificial Sequence
  MKO10005168_A_Arl6ip5
  gRNA
guacccaacggccuucguga

SEQ ID NO: 5169 - RNA, 20 nt, Artificial Sequence
  MKO10005169_A_Arl6ip6
  gRNA
aauacccgggccgagucgca

SEQ ID NO: 5170 - RNA, 20 nt, Artificial Sequence
  MKO10005170_A_Arl6ip6
  gRNA
cuuucccgccaugucguucg

SEQ ID NO: 5171 - RNA, 20 nt, Artificial Sequence
  MKO10005171_A_Arl6ip6
  gRNA
cugauaauaucucuaacugc

SEQ ID NO: 5172 - RNA, 20 nt, Artificial Sequence
  MKO10005172_A_Arl6
  gRNA
gauacccuucugaaucaccc

SEQ ID NO: 5173 - RNA, 20 nt, Artificial Sequence
  MKO10005173_A_Arl6
  gRNA
uaguagugauaaguuaagaa

SEQ ID NO: 5174 - RNA, 20 nt, Artificial Sequence
  MKO10005174_A_Arl6
  gRNA
uuuacaguguuugacauguc

SEQ ID NO: 5175 - RNA, 20 nt, Artificial Sequence
  MKO10005175_A_Arl8a
  gRNA
cgccggagcgcuagaugaga

SEQ ID NO: 5176 - RNA, 20 nt, Artificial Sequence
  MKO10005176_A_Arl8a
  gRNA
ccuguauaggucuuaguccu

SEQ ID NO: 5177 - RNA, 20 nt, Artificial Sequence
  MKO10005177_A_Arl8a
  gRNA
ucgcauguugaaacccacag

SEQ ID NO: 5178 - RNA, 20 nt, Artificial Sequence
  MKO10005178_A_Arl8b
  gRNA
agccccgguuccggagcaug

SEQ ID NO: 5179 - RNA, 20 nt, Artificial Sequence
  MKO10005179_A_Arl8b
  gRNA
auuaugcaguucauuucgag

SEQ ID NO: 5180 - RNA, 20 nt, Artificial Sequence
  MKO10005180_A_Arl8b
  gRNA
aguaccgcucccacaugcuc

SEQ ID NO: 5181 - RNA, 20 nt, Artificial Sequence
  MKO10005181_A_Arl9
  gRNA
gugagccauuccgcuccuac

SEQ ID NO: 5182 - RNA, 20 nt, Artificial Sequence
  MKO10005182_A_Arl9
  gRNA
uuguuggcaaacacaacgag

SEQ ID NO: 5183 - RNA, 20 nt, Artificial Sequence
  MKO10005183_A_Arl9
  gRNA
cgaguccuacccaggcuacc

SEQ ID NO: 5184 - RNA, 20 nt, Artificial Sequence
  MKO10005184_A_Armc10
  gRNA
uucaguaaugacaggaucgu

SEQ ID NO: 5185 - RNA, 20 nt, Artificial Sequence
  MKO10005185_A_Armc10
  gRNA
uaugcagaagaccuaaccga

SEQ ID NO: 5186 - RNA, 20 nt, Artificial Sequence
  MKO10005186_A_Armc10
  gRNA
uuaggccauuauucgugagu

SEQ ID NO: 5187 - RNA, 20 nt, Artificial Sequence
  MKO10005187_A_Armc12
  gRNA
cccguggcgcucucucucga

SEQ ID NO: 5188 - RNA, 20 nt, Artificial Sequence
  MKO10005188_A_Armc12
  gRNA
ggcaucacccgccgcagcug

SEQ ID NO: 5189 - RNA, 20 nt, Artificial Sequence
  MKO10005189_A_Armc12
  gRNA
cacccgcugcguguacuugc

SEQ ID NO: 5190 - RNA, 20 nt, Artificial Sequence
  MKO10005190_A_Armc1
  gRNA
uuugcaggcgcuacgcuacu

SEQ ID NO: 5191 - RNA, 20 nt, Artificial Sequence
  MKO10005191_A_Armc1
  gRNA
augaaaugaauucgcguaga

SEQ ID NO: 5192 - RNA, 20 nt, Artificial Sequence
  MKO10005192_A_Armc1
  gRNA
ucgacgaaaucuaugugaag

SEQ ID NO: 5193 - RNA, 20 nt, Artificial Sequence
  MKO10005193_A_Armc2
  gRNA
cacgggguguaaauggucuu

SEQ ID NO: 5194 - RNA, 20 nt, Artificial Sequence
  MKO10005194_A_Armc2
  gRNA
auccagcaaacccguuagcg

SEQ ID NO: 5195 - RNA, 20 nt, Artificial Sequence
  MKO10005195_A_Armc2
  gRNA
cgggccuuacagugggcggc

SEQ ID NO: 5196 - RNA, 20 nt, Artificial Sequence
  MKO10005196_A_Armc3
  gRNA
uauugagugcaucuacaacu

SEQ ID NO: 5197 - RNA, 20 nt, Artificial Sequence
  MKO10005197_A_Armc3
  gRNA
auagaauucuucuucacguc

SEQ ID NO: 5198 - RNA, 20 nt, Artificial Sequence
  MKO10005198_A_Armc3
  gRNA
uuucagagcaaacuuauaga

SEQ ID NO: 5199 - RNA, 20 nt, Artificial Sequence
  MKO10005199_A_Armc4
  gRNA
aucgagaagagucaagcgag

SEQ ID NO: 5200 - RNA, 20 nt, Artificial Sequence
  MKO10005200_A_Armc4
  gRNA
aaaaggggaacagacggugc

SEQ ID NO: 5201 - RNA, 20 nt, Artificial Sequence
  MKO10005201_A_Armc4
  gRNA
gaguugcucaaacguuucuc

SEQ ID NO: 5202 - RNA, 20 nt, Artificial Sequence
  MKO10005202_A_Armc5
  gRNA
ccaucaaccgggcucggcuu

SEQ ID NO: 5203 - RNA, 20 nt, Artificial Sequence
  MKO10005203_A_Armc5
  gRNA
ccgaagccgagcccgguuga

SEQ ID NO: 5204 - RNA, 20 nt, Artificial Sequence
  MKO10005204_A_Armc5
  gRNA
cccacgcgcacuucguaucu

SEQ ID NO: 5205 - RNA, 20 nt, Artificial Sequence
  MKO10005205_A_Armc6
  gRNA
cgcaggcaacgacgacguaa

SEQ ID NO: 5206 - RNA, 20 nt, Artificial Sequence
  MKO10005206_A_Armc6
  gRNA
cguaccaccugcccggacaa

SEQ ID NO: 5207 - RNA, 20 nt, Artificial Sequence
  MKO10005207_A_Armc6
  gRNA
gcauggccagcacgccgaug

SEQ ID NO: 5208 - RNA, 20 nt, Artificial Sequence
  MKO10005208_A_Armc7
  gRNA
aguagccuagccgcccgacg

SEQ ID NO: 5209 - RNA, 20 nt, Artificial Sequence
  MKO10005209_A_Armc7
  gRNA
gcccgggucauaagcgaagu

SEQ ID NO: 5210 - RNA, 20 nt, Artificial Sequence
  MKO10005210_A_Armc7
  gRNA
ccaggacuuguaguugccgu

SEQ ID NO: 5211 - RNA, 20 nt, Artificial Sequence
  MKO10005211_A_Armc8
  gRNA
gaaccgcuccuagaacgaug

SEQ ID NO: 5212 - RNA, 20 nt, Artificial Sequence
  MKO10005212_A_Armc8
  gRNA
gcagucgccacuauguugac

SEQ ID NO: 5213 - RNA, 20 nt, Artificial Sequence
  MKO10005213_A_Armc8
  gRNA
aaagccaaccucaucguucu

SEQ ID NO: 5214 - RNA, 20 nt, Artificial Sequence
  MKO10005214_A_Armc9
  gRNA
ccccuucgugcccaauccga

SEQ ID NO: 5215 - RNA, 20 nt, Artificial Sequence
  MKO10005215_A_Armc9
  gRNA
uaccuggauuacgagcgacu

SEQ ID NO: 5216 - RNA, 20 nt, Artificial Sequence
  MKO10005216_A_Armc9
  gRNA
gaccaucggauugggcacga

SEQ ID NO: 5217 - RNA, 20 nt, Artificial Sequence
  MKO10005217_A_Armcx1
  gRNA
gcuguacgaugggucgcacc

SEQ ID NO: 5218 - RNA, 20 nt, Artificial Sequence
  MKO10005218_A_Armcx1
  gRNA
cugaacuugcccuugcguac

SEQ ID NO: 5219 - RNA, 20 nt, Artificial Sequence
  MKO10005219_A_Armcx1
  gRNA
ucaaaacgccauccgugagc

SEQ ID NO: 5220 - RNA, 20 nt, Artificial Sequence
  MKO10005220_A_Armcx2
  gRNA
aacuaaaugaugacggcacc

SEQ ID NO: 5221 - RNA, 20 nt, Artificial Sequence
  MKO10005221_A_Armcx2
  gRNA
aggggagguaucaccguccc

SEQ ID NO: 5222 - RNA, 20 nt, Artificial Sequence
  MKO10005222_A_Armcx2
  gRNA
gcuggauucacaauugaccu

SEQ ID NO: 5223 - RNA, 20 nt, Artificial Sequence
  MKO10005223_A_Armcx3
  gRNA
cagggaccagagccagagcc

SEQ ID NO: 5224 - RNA, 20 nt, Artificial Sequence
  MKO10005224_A_Armcx3
  gRNA
ccuggcucuugcccuggcuc

SEQ ID NO: 5225 - RNA, 20 nt, Artificial Sequence
  MKO10005225_A_Armcx3
  gRNA
ccaaguuauuccugacucuu

SEQ ID NO: 5226 - RNA, 20 nt, Artificial Sequence
  MKO10005226_A_Armcx4
  gRNA
gacuggggcggcuaaugaca

SEQ ID NO: 5227 - RNA, 20 nt, Artificial Sequence
  MKO10005227_A_Armcx4
  gRNA
auuuaguacagccacuaguc

SEQ ID NO: 5228 - RNA, 20 nt, Artificial Sequence
  MKO10005228_A_Armcx4
  gRNA
cacagucuccgucucgauuc

SEQ ID NO: 5229 - RNA, 20 nt, Artificial Sequence
  MKO10005229_A_Armcx5
  gRNA
ucagaccacuaaagccguua

SEQ ID NO: 5230 - RNA, 20 nt, Artificial Sequence
  MKO10005230_A_Armcx5
  gRNA
caagauauuguucacgaugu

SEQ ID NO: 5231 - RNA, 20 nt, Artificial Sequence
  MKO10005231_A_Armcx5
  gRNA
aucucucaagggcgcugcca

SEQ ID NO: 5232 - RNA, 20 nt, Artificial Sequence
  MKO10005232_A_Armcx6
  gRNA
cuauaaucaugggucgggcc

SEQ ID NO: 5233 - RNA, 20 nt, Artificial Sequence
  MKO10005233_A_Armcx6
  gRNA
accagcuccaaucaugaguc

SEQ ID NO: 5234 - RNA, 20 nt, Artificial Sequence
  MKO10005234_A_Armcx6
  gRNA
ggccagauguuuacugauau

SEQ ID NO: 5235 - RNA, 20 nt, Artificial Sequence
  MKO10005235_A_Arnt2
  gRNA
cggaucgacgcuuuccuccu

SEQ ID NO: 5236 - RNA, 20 nt, Artificial Sequence
  MKO10005236_A_Arnt2
  gRNA
auggacuucgaugacgaaga

SEQ ID NO: 5237 - RNA, 20 nt, Artificial Sequence
  MKO10005237_A_Arnt2
  gRNA
ugggagcacgcuuuaugagc

SEQ ID NO: 5238 - RNA, 20 nt, Artificial Sequence
  MKO10005238_A_Arntl2
  gRNA
caaaacacugcguuaugauc

SEQ ID NO: 5239 - RNA, 20 nt, Artificial Sequence
  MKO10005239_A_Arntl2
  gRNA
cugaucauaacgcaguguuu

SEQ ID NO: 5240 - RNA, 20 nt, Artificial Sequence
  MKO10005240_A_Arntl2
  gRNA
uggacaagcucagcgucuug

SEQ ID NO: 5241 - RNA, 20 nt, Artificial Sequence
  MKO10005241_A_Arntl
  gRNA
uagauaaacucaccgugcua

SEQ ID NO: 5242 - RNA, 20 nt, Artificial Sequence
  MKO10005242_A_Arntl
  gRNA
cugcacguacccugagaauu

SEQ ID NO: 5243 - RNA, 20 nt, Artificial Sequence
  MKO10005243_A_Arntl
  gRNA
uuacuagguaccuuccauga

SEQ ID NO: 5244 - RNA, 20 nt, Artificial Sequence
  MKO10005244_A_Arnt
  gRNA
guuagcuguagucgccgcca

SEQ ID NO: 5245 - RNA, 20 nt, Artificial Sequence
  MKO10005245_A_Arnt
  gRNA
gcggcgacuacagcuaaccc

SEQ ID NO: 5246 - RNA, 20 nt, Artificial Sequence
  MKO10005246_A_Arnt
  gRNA
gacaucagauguaccaucgc

SEQ ID NO: 5247 - RNA, 20 nt, Artificial Sequence
  MKO10005247_A_Arpc1a
  gRNA
gacgaaagcgcacgagcuga

SEQ ID NO: 5248 - RNA, 20 nt, Artificial Sequence
  MKO10005248_A_Arpc1a
  gRNA
cagaccgcaacgccuauguc

SEQ ID NO: 5249 - RNA, 20 nt, Artificial Sequence
  MKO10005249_A_Arpc1a
  gRNA
gaccccaugcacccagccgc

SEQ ID NO: 5250 - RNA, 20 nt, Artificial Sequence
  MKO10005250_A_Arpc1b
  gRNA
ugacccugcaggcaucgacu

SEQ ID NO: 5251 - RNA, 20 nt, Artificial Sequence
  MKO10005251_A_Arpc1b
  gRNA
caaugagaacaaguucgccg

SEQ ID NO: 5252 - RNA, 20 nt, Artificial Sequence
  MKO10005252_A_Arpc1b
  gRNA
cacgagcugaaggagcacaa

SEQ ID NO: 5253 - RNA, 20 nt, Artificial Sequence
  MKO10005253_A_Arpc2
  gRNA
caguuguuaaagagagugua

SEQ ID NO: 5254 - RNA, 20 nt, Artificial Sequence
  MKO10005254_A_Arpc2
  gRNA
cugaugcacaauagaauccu

SEQ ID NO: 5255 - RNA, 20 nt, Artificial Sequence
  MKO10005255_A_Arpc2
  gRNA
uucuugguaaauccagaacc

SEQ ID NO: 5256 - RNA, 20 nt, Artificial Sequence
  MKO10005256_A_Arpc3
  gRNA
cagagacuuacucucgcgag

SEQ ID NO: 5257 - RNA, 20 nt, Artificial Sequence
  MKO10005257_A_Arpc3
  gRNA
uuggcauaaauggcguugag

SEQ ID NO: 5258 - RNA, 20 nt, Artificial Sequence
  MKO10005258_A_Arpc3
  gRNA
caccaagcucaucgguaaca

SEQ ID NO: 5259 - RNA, 20 nt, Artificial Sequence
  MKO10005259_A_Arpc4
  gRNA
ccgggcucguaucguagcug

SEQ ID NO: 5260 - RNA, 20 nt, Artificial Sequence
  MKO10005260_A_Arpc4
  gRNA
guuuguacaucugcuccgug

SEQ ID NO: 5261 - RNA, 20 nt, Artificial Sequence
  MKO10005261_A_Arpc4
  gRNA
ccuccacagguuuccuucga

SEQ ID NO: 5262 - RNA, 20 nt, Artificial Sequence
  MKO10005262_A_Arpc5l
  gRNA
auucguagacgagcacgaag

SEQ ID NO: 5263 - RNA, 20 nt, Artificial Sequence
  MKO10005263_A_Arpc5l
  gRNA
guccucacgcuuccgccgcg

SEQ ID NO: 5264 - RNA, 20 nt, Artificial Sequence
  MKO10005264_A_Arpc5l
  gRNA
gccuaguccuccuacagcua

SEQ ID NO: 5265 - RNA, 20 nt, Artificial Sequence
  MKO10005265_A_Arpc5
  gRNA
ugcagucaaaacucgaacaa

SEQ ID NO: 5266 - RNA, 20 nt, Artificial Sequence
  MKO10005266_A_Arpc5
  gRNA
ugaaacucaccuucacugcc

SEQ ID NO: 5267 - RNA, 20 nt, Artificial Sequence
  MKO10005267_A_Arpc5
  gRNA
ucaagacgaugcugccugca

SEQ ID NO: 5268 - RNA, 20 nt, Artificial Sequence
  MKO10005268_A_Arpp19
  gRNA
aggaagugcucgggcgucgc

SEQ ID NO: 5269 - RNA, 20 nt, Artificial Sequence
  MKO10005269_A_Arpp19
  gRNA
ggcgcgagccgcaaccuuug

SEQ ID NO: 5270 - RNA, 20 nt, Artificial Sequence
  MKO10005270_A_Arpp19
  gRNA
cauguccgcggaaguccccg

SEQ ID NO: 5271 - RNA, 20 nt, Artificial Sequence
  MKO10005271_A_Arpp21
  gRNA
uaccaugcagcggcgacugg

SEQ ID NO: 5272 - RNA, 20 nt, Artificial Sequence
  MKO10005272_A_Arpp21
  gRNA
aggacugacuccgaccauac

SEQ ID NO: 5273 - RNA, 20 nt, Artificial Sequence
  MKO10005273_A_Arpp21
  gRNA
gaagagucuucagcuagauc

SEQ ID NO: 5274 - RNA, 20 nt, Artificial Sequence
  MKO10005274_A_Arr3
  gRNA
ccacgaagucucguuucccc

SEQ ID NO: 5275 - RNA, 20 nt, Artificial Sequence
  MKO10005275_A_Arr3
  gRNA
acgagacuucguggaugaug

SEQ ID NO: 5276 - RNA, 20 nt, Artificial Sequence
  MKO10005276_A_Arr3
  gRNA
guugaccccgaguacuuaga

SEQ ID NO: 5277 - RNA, 20 nt, Artificial Sequence
  MKO10005277_A_Arrb1
  gRNA
acucacccacgggguccacg

SEQ ID NO: 5278 - RNA, 20 nt, Artificial Sequence
  MKO10005278_A_Arrb1
  gRNA
ccgcggaccaugggcgacaa

SEQ ID NO: 5279 - RNA, 20 nt, Artificial Sequence
  MKO10005279_A_Arrb1
  gRNA
ccgugucccuuugucgccca

SEQ ID NO: 5280 - RNA, 20 nt, Artificial Sequence
  MKO10005280_A_Arrb2
  gRNA
gaagucgagcccuaacugca

SEQ ID NO: 5281 - RNA, 20 nt, Artificial Sequence
  MKO10005281_A_Arrb2
  gRNA
gucgcgcuugcccaaguaca

SEQ ID NO: 5282 - RNA, 20 nt, Artificial Sequence
  MKO10005282_A_Arrb2
  gRNA
ucuguucaucgccaccuacc

SEQ ID NO: 5283 - RNA, 20 nt, Artificial Sequence
  MKO10005283_A_Arrdc1
  gRNA
ccccaggaccguagacgacg

SEQ ID NO: 5284 - RNA, 20 nt, Artificial Sequence
  MKO10005284_A_Arrdc1
  gRNA
gccgcgucgucuacgguccu

SEQ ID NO: 5285 - RNA, 20 nt, Artificial Sequence
  MKO10005285_A_Arrdc1
  gRNA
ugucgauggacgcccucacc

SEQ ID NO: 5286 - RNA, 20 nt, Artificial Sequence
  MKO10005286_A_Arrdc2
  gRNA
gcccgaaucgccgugcgcug

SEQ ID NO: 5287 - RNA, 20 nt, Artificial Sequence
  MKO10005287_A_Arrdc2
  gRNA
ucgugcgcugcguauccccc

SEQ ID NO: 5288 - RNA, 20 nt, Artificial Sequence
  MKO10005288_A_Arrdc2
  gRNA
gauaucgccacgcuucccgc

SEQ ID NO: 5289 - RNA, 20 nt, Artificial Sequence
  MKO10005289_A_Arrdc3
  gRNA
ggcggccauuuaccagacgc

SEQ ID NO: 5290 - RNA, 20 nt, Artificial Sequence
  MKO10005290_A_Arrdc3
  gRNA
cgacuguaguauaauccgag

SEQ ID NO: 5291 - RNA, 20 nt, Artificial Sequence
  MKO10005291_A_Arrdc3
  gRNA
ccacuugcuaccucauucga

SEQ ID NO: 5292 - RNA, 20 nt, Artificial Sequence
  MKO10005292_A_Arrdc4
  gRNA
cuacucaagcggcgagacag

SEQ ID NO: 5293 - RNA, 20 nt, Artificial Sequence
  MKO10005293_A_Arrdc4
  gRNA
cgcaguccgcgcagggccac

SEQ ID NO: 5294 - RNA, 20 nt, Artificial Sequence
  MKO10005294_A_Arrdc4
  gRNA
ugucaacacaccgcccuuau

SEQ ID NO: 5295 - RNA, 20 nt, Artificial Sequence
  MKO10005295_A_Arrdc5
  gRNA
cggcucuaucauagacgggc

SEQ ID NO: 5296 - RNA, 20 nt, Artificial Sequence
  MKO10005296_A_Arrdc5
  gRNA
gcuucacgccaagugccgag

SEQ ID NO: 5297 - RNA, 20 nt, Artificial Sequence
  MKO10005297_A_Arrdc5
  gRNA
gccccaagaugcggucuacc

SEQ ID NO: 5298 - RNA, 20 nt, Artificial Sequence
  MKO10005298_A_Arsa
  gRNA
agaacggucggcccuggcgc

SEQ ID NO: 5299 - RNA, 20 nt, Artificial Sequence
  MKO10005299_A_Arsa
  gRNA
guucgaucaggcauguaccc

SEQ ID NO: 5300 - RNA, 20 nt, Artificial Sequence
  MKO10005300_A_Arsa
  gRNA
uuggacaugcgcaucaacuc

SEQ ID NO: 5301 - RNA, 20 nt, Artificial Sequence
  MKO10005301_A_Arsb
  gRNA
gaaugucugccgacacgccg

SEQ ID NO: 5302 - RNA, 20 nt, Artificial Sequence
  MKO10005302_A_Arsb
  gRNA
cccacacucguagaucuggc

SEQ ID NO: 5303 - RNA, 20 nt, Artificial Sequence
  MKO10005303_A_Arsb
  gRNA
cauccgaggaacgggcuucg

SEQ ID NO: 5304 - RNA, 20 nt, Artificial Sequence
  MKO10005304_A_Arsg
  gRNA
caaugagcccucagaccggu

SEQ ID NO: 5305 - RNA, 20 nt, Artificial Sequence
  MKO10005305_A_Arsg
  gRNA
ucacuagcaccgccuuguua

SEQ ID NO: 5306 - RNA, 20 nt, Artificial Sequence
  MKO10005306_A_Arsg
  gRNA
caucccguccaucaaauuuc

SEQ ID NO: 5307 - RNA, 20 nt, Artificial Sequence
  MKO10005307_A_Arsi
  gRNA
ccuauaccgcuaccgcacga

SEQ ID NO: 5308 - RNA, 20 nt, Artificial Sequence
  MKO10005308_A_Arsi
  gRNA
aaguacccuugcguccucga

SEQ ID NO: 5309 - RNA, 20 nt, Artificial Sequence
  MKO10005309_A_Arsi
  gRNA
ggauaucgagaccccaacgc

SEQ ID NO: 5310 - RNA, 20 nt, Artificial Sequence
  MKO10005310_A_Arsj
  gRNA
agccuauuugcacaccgucc

SEQ ID NO: 5311 - RNA, 20 nt, Artificial Sequence
  MKO10005311_A_Arsj
  gRNA
ucacggcugauccguaugag

SEQ ID NO: 5312 - RNA, 20 nt, Artificial Sequence
  MKO10005312_A_Arsj
  gRNA
ggucggcuauucaacccaua

SEQ ID NO: 5313 - RNA, 20 nt, Artificial Sequence
  MKO10005313_A_Arsk
  gRNA
gcauucuugcuccgacaaga

SEQ ID NO: 5314 - RNA, 20 nt, Artificial Sequence
  MKO10005314_A_Arsk
  gRNA
ggaagacuaacauuucaacc

SEQ ID NO: 5315 - RNA, 20 nt, Artificial Sequence
  MKO10005315_A_Arsk
  gRNA
acauucauaccugcacguga

SEQ ID NO: 5316 - RNA, 20 nt, Artificial Sequence
  MKO10005316_A_Art1
  gRNA
acgcaucuaccuccgcgcuc

SEQ ID NO: 5317 - RNA, 20 nt, Artificial Sequence
  MKO10005317_A_Art1
  gRNA
cuccggagccaccgaucucg

SEQ ID NO: 5318 - RNA, 20 nt, Artificial Sequence
  MKO10005318_A_Art1
  gRNA
gucaacaucggguaaguugc

SEQ ID NO: 5319 - RNA, 20 nt, Artificial Sequence
  MKO10005319_A_Art2a-ps
  gRNA
uuuaccgagguacuaauguc

SEQ ID NO: 5320 - RNA, 20 nt, Artificial Sequence
  MKO10005320_A_Art2a-ps
  gRNA
cuuaccuaagcugcuaacgu

SEQ ID NO: 5321 - RNA, 20 nt, Artificial Sequence
  MKO10005321_A_Art2a-ps
  gRNA
auuucaaguucuuccuaacu

SEQ ID NO: 5322 - RNA, 20 nt, Artificial Sequence
  MKO10005322_A_Art2b
  gRNA
caaaaacaguacgaguuauc

SEQ ID NO: 5323 - RNA, 20 nt, Artificial Sequence
  MKO10005323_A_Art2b
  gRNA
auuaacaccuccucuucacg

SEQ ID NO: 5324 - RNA, 20 nt, Artificial Sequence
  MKO10005324_A_Art2b
  gRNA
gcuggguuagccaccaaguu

SEQ ID NO: 5325 - RNA, 20 nt, Artificial Sequence
  MKO10005325_A_Art3
  gRNA
gaaaauuguaucgcgaacgc

SEQ ID NO: 5326 - RNA, 20 nt, Artificial Sequence
  MKO10005326_A_Art3
  gRNA
cucuugagccucauucacgu

SEQ ID NO: 5327 - RNA, 20 nt, Artificial Sequence
  MKO10005327_A_Art3
  gRNA
uacuacgagugcgcauuccu

SEQ ID NO: 5328 - RNA, 20 nt, Artificial Sequence
  MKO10005328_A_Art4
  gRNA
aaguccacgucgaccuuaag

SEQ ID NO: 5329 - RNA, 20 nt, Artificial Sequence
  MKO10005329_A_Art4
  gRNA
gaggaacuggccgaaucgaa

SEQ ID NO: 5330 - RNA, 20 nt, Artificial Sequence
  MKO10005330_A_Art4
  gRNA
cguccaaaagcagagcgcaa

SEQ ID NO: 5331 - RNA, 20 nt, Artificial Sequence
  MKO10005331_A_Art5
  gRNA
ccagcacggaguagcgauua

SEQ ID NO: 5332 - RNA, 20 nt, Artificial Sequence
  MKO10005332_A_Art5
  gRNA
cugaaccaggccguacggac

SEQ ID NO: 5333 - RNA, 20 nt, Artificial Sequence
  MKO10005333_A_Art5
  gRNA
gccucagcuugcacgcccuc

SEQ ID NO: 5334 - RNA, 20 nt, Artificial Sequence
  MKO10005334_A_Artn
  gRNA
cggugagggaccgucgcgag

SEQ ID NO: 5335 - RNA, 20 nt, Artificial Sequence
  MKO10005335_A_Artn
  gRNA
gcggcagccgcgcgcaucug

SEQ ID NO: 5336 - RNA, 20 nt, Artificial Sequence
  MKO10005336_A_Artn
  gRNA
accggucuuggcgcccccca

SEQ ID NO: 5337 - RNA, 20 nt, Artificial Sequence
  MKO10005337_A_Arv1
  gRNA
ugcuaaucccggccgucauc

SEQ ID NO: 5338 - RNA, 20 nt, Artificial Sequence
  MKO10005338_A_Arv1
  gRNA
cguaccggaucacgucaucg

SEQ ID NO: 5339 - RNA, 20 nt, Artificial Sequence
  MKO10005339_A_Arv1
  gRNA
agccacuuagcacgaccaac

SEQ ID NO: 5340 - RNA, 20 nt, Artificial Sequence
  MKO10005340_A_Arvcf
  gRNA
ugucacgggccgcccgcagu

SEQ ID NO: 5341 - RNA, 20 nt, Artificial Sequence
  MKO10005341_A_Arvcf
  gRNA
cggggcuucgagucuucguu

SEQ ID NO: 5342 - RNA, 20 nt, Artificial Sequence
  MKO10005342_A_Arvcf
  gRNA
ucaucgugccccauuccggc

SEQ ID NO: 5343 - RNA, 20 nt, Artificial Sequence
  MKO10005343_A_Arxes1
  gRNA
gagaauucuucaaaaagucg

SEQ ID NO: 5344 - RNA, 20 nt, Artificial Sequence
  MKO10005344_A_Arxes1
  gRNA
agaugaacucccugcugucc

SEQ ID NO: 5345 - RNA, 20 nt, Artificial Sequence
  MKO10005345_A_Arxes1
  gRNA
gcccaggucgcucuucuuuc

SEQ ID NO: 5346 - RNA, 20 nt, Artificial Sequence
  MKO10005346_A_Arxes2
  gRNA
gagaauucuucaaaaagucg

SEQ ID NO: 5347 - RNA, 20 nt, Artificial Sequence
  MKO10005347_A_Arxes2
  gRNA
agaugaacucccugcugucc

SEQ ID NO: 5348 - RNA, 20 nt, Artificial Sequence
  MKO10005348_A_Arxes2
  gRNA
gcccaggucgcucuucuuuc

SEQ ID NO: 5349 - RNA, 20 nt, Artificial Sequence
  MKO10005349_A_Arx
  gRNA
agcaagucguaccgcgagaa

SEQ ID NO: 5350 - RNA, 20 nt, Artificial Sequence
  MKO10005350_A_Arx
  gRNA
ugacgcgcgucugucugccg

SEQ ID NO: 5351 - RNA, 20 nt, Artificial Sequence
  MKO10005351_A_Arx
  gRNA
cgaagggcgccccguucucg

SEQ ID NO: 5352 - RNA, 20 nt, Artificial Sequence
  MKO10005352_A_Ar
  gRNA
aauacugaaugaccgccauc

SEQ ID NO: 5353 - RNA, 20 nt, Artificial Sequence
  MKO10005353_A_Ar
  gRNA
gccuaucuuucuuaacgucc

SEQ ID NO: 5354 - RNA, 20 nt, Artificial Sequence
  MKO10005354_A_Ar
  gRNA
aggcuuccgcaacuugcaug

SEQ ID NO: 5355 - RNA, 20 nt, Artificial Sequence
  MKO10005355_A_As3mt
  gRNA
uacacgaagacguuaguucg

SEQ ID NO: 5356 - RNA, 20 nt, Artificial Sequence
  MKO10005356_A_As3mt
  gRNA
cccucaccugaacguccuug

SEQ ID NO: 5357 - RNA, 20 nt, Artificial Sequence
  MKO10005357_A_As3mt
  gRNA
gcgugacacaagcauuaguc

SEQ ID NO: 5358 - RNA, 20 nt, Artificial Sequence
  MKO10005358_A_Asah1
  gRNA
uguauucacuaaacucguua

SEQ ID NO: 5359 - RNA, 20 nt, Artificial Sequence
  MKO10005359_A_Asah1
  gRNA
cucacucacguugguccaga

SEQ ID NO: 5360 - RNA, 20 nt, Artificial Sequence
  MKO10005360_A_Asah1
  gRNA
aaaucaacguauccuccuuc

SEQ ID NO: 5361 - RNA, 20 nt, Artificial Sequence
  MKO10005361_A_Asah2
  gRNA
ccgguugcugaaucccucgc

SEQ ID NO: 5362 - RNA, 20 nt, Artificial Sequence
  MKO10005362_A_Asah2
  gRNA
acucuauauacucgccagcg

SEQ ID NO: 5363 - RNA, 20 nt, Artificial Sequence
  MKO10005363_A_Asah2
  gRNA
gccauucgauuugacccauc

SEQ ID NO: 5364 - RNA, 20 nt, Artificial Sequence
  MKO10005364_A_Asap1
  gRNA
guucaucgccgagaccaccg

SEQ ID NO: 5365 - RNA, 20 nt, Artificial Sequence
  MKO10005365_A_Asap1
  gRNA
cucggcgaugaacucggaca

SEQ ID NO: 5366 - RNA, 20 nt, Artificial Sequence
  MKO10005366_A_Asap1
  gRNA
guccacgcugcugaaaaauc

SEQ ID NO: 5367 - RNA, 20 nt, Artificial Sequence
  MKO10005367_A_Asap2
  gRNA
gacggcacucuucaaaaacc

SEQ ID NO: 5368 - RNA, 20 nt, Artificial Sequence
  MKO10005368_A_Asap2
  gRNA
agaaacgcgcuuccuaaguc

SEQ ID NO: 5369 - RNA, 20 nt, Artificial Sequence
  MKO10005369_A_Asap2
  gRNA
caacaucaucucguucccuu

SEQ ID NO: 5370 - RNA, 20 nt, Artificial Sequence
  MKO10005370_A_Asap3
  gRNA
guucgagcuauccacagcuc

SEQ ID NO: 5371 - RNA, 20 nt, Artificial Sequence
  MKO10005371_A_Asap3
  gRNA
caacaucgucuccuucccgc

SEQ ID NO: 5372 - RNA, 20 nt, Artificial Sequence
  MKO10005372_A_Asap3
  gRNA
gucugaugaaggggcaucua

SEQ ID NO: 5373 - RNA, 20 nt, Artificial Sequence
  MKO10005373_A_Asb10
  gRNA
aucacucacucgaggauacc

SEQ ID NO: 5374 - RNA, 20 nt, Artificial Sequence
  MKO10005374_A_Asb10
  gRNA
cgugugucccccguagucca

SEQ ID NO: 5375 - RNA, 20 nt, Artificial Sequence
  MKO10005375_A_Asb10
  gRNA
aacgcuaaugccauggacua

SEQ ID NO: 5376 - RNA, 20 nt, Artificial Sequence
  MKO10005376_A_Asb11
  gRNA
uaagagccaguaagcguccc

SEQ ID NO: 5377 - RNA, 20 nt, Artificial Sequence
  MKO10005377_A_Asb11
  gRNA
ugaucgauccccacuccaug

SEQ ID NO: 5378 - RNA, 20 nt, Artificial Sequence
  MKO10005378_A_Asb11
  gRNA
uaccucgcuucacugcuucg

SEQ ID NO: 5379 - RNA, 20 nt, Artificial Sequence
  MKO10005379_A_Asb12
  gRNA
accuggaacacccuugcguu

SEQ ID NO: 5380 - RNA, 20 nt, Artificial Sequence
  MKO10005380_A_Asb12
  gRNA
gcuauauuugacgcccagac

SEQ ID NO: 5381 - RNA, 20 nt, Artificial Sequence
  MKO10005381_A_Asb12
  gRNA
gggaucugcggauaacuaaa

SEQ ID NO: 5382 - RNA, 20 nt, Artificial Sequence
  MKO10005382_A_Asb13
  gRNA
aggguugacuuucgccccau

SEQ ID NO: 5383 - RNA, 20 nt, Artificial Sequence
  MKO10005383_A_Asb13
  gRNA
cacagcauccccgcuacacg

SEQ ID NO: 5384 - RNA, 20 nt, Artificial Sequence
  MKO10005384_A_Asb13
  gRNA
gcugcuccacguguaguccg

SEQ ID NO: 5385 - RNA, 20 nt, Artificial Sequence
  MKO10005385_A_Asb14
  gRNA
agacauuaccucgccgcuuc

SEQ ID NO: 5386 - RNA, 20 nt, Artificial Sequence
  MKO10005386_A_Asb14
  gRNA
gauccauacgaagcuuggau

SEQ ID NO: 5387 - RNA, 20 nt, Artificial Sequence
  MKO10005387_A_Asb14
  gRNA
agaguacuuaacugucucga

SEQ ID NO: 5388 - RNA, 20 nt, Artificial Sequence
  MKO10005388_A_Asb15
  gRNA
cuccgaauccgucucucaag

SEQ ID NO: 5389 - RNA, 20 nt, Artificial Sequence
  MKO10005389_A_Asb15
  gRNA
gucaagacguugcuagacaa

SEQ ID NO: 5390 - RNA, 20 nt, Artificial Sequence
  MKO10005390_A_Asb15
  gRNA
guccacuugagagacggauu

SEQ ID NO: 5391 - RNA, 20 nt, Artificial Sequence
  MKO10005391_A_Asb16
  gRNA
gcgcuaaacgcugcgugcgc

SEQ ID NO: 5392 - RNA, 20 nt, Artificial Sequence
  MKO10005392_A_Asb16
  gRNA
gcugagcuugacgcccgaau

SEQ ID NO: 5393 - RNA, 20 nt, Artificial Sequence
  MKO10005393_A_Asb16
  gRNA
gcuugcagcgcgcaguccau

SEQ ID NO: 5394 - RNA, 20 nt, Artificial Sequence
  MKO10005394_A_Asb17
  gRNA
cccuucgagagugagaauaa

SEQ ID NO: 5395 - RNA, 20 nt, Artificial Sequence
  MKO10005395_A_Asb17
  gRNA
cguccaagucaacauaccuc

SEQ ID NO: 5396 - RNA, 20 nt, Artificial Sequence
  MKO10005396_A_Asb17
  gRNA
gucugagccacguagaguag

SEQ ID NO: 5397 - RNA, 20 nt, Artificial Sequence
  MKO10005397_A_Asb18
  gRNA
gacgcgggcgcgcucgacua

SEQ ID NO: 5398 - RNA, 20 nt, Artificial Sequence
  MKO10005398_A_Asb18
  gRNA
aucacggaucccgcuccgug

SEQ ID NO: 5399 - RNA, 20 nt, Artificial Sequence
  MKO10005399_A_Asb18
  gRNA
cgcgucuuacccaagcgagg

SEQ ID NO: 5400 - RNA, 20 nt, Artificial Sequence
  MKO10005400_A_Asb1
  gRNA
uucacggcggcuaaccuccu

SEQ ID NO: 5401 - RNA, 20 nt, Artificial Sequence
  MKO10005401_A_Asb1
  gRNA
gucgucccuacccacacgag

SEQ ID NO: 5402 - RNA, 20 nt, Artificial Sequence
  MKO10005402_A_Asb1
  gRNA
gagguuagccgccgugaaaa

SEQ ID NO: 5403 - RNA, 20 nt, Artificial Sequence
  MKO10005403_A_Asb2
  gRNA
acgccaaccaccgcuguaac

SEQ ID NO: 5404 - RNA, 20 nt, Artificial Sequence
  MKO10005404_A_Asb2
  gRNA
cuccgcguucuugcgcucac

SEQ ID NO: 5405 - RNA, 20 nt, Artificial Sequence
  MKO10005405_A_Asb2
  gRNA
gaucacuuacgccaucuggg

SEQ ID NO: 5406 - RNA, 20 nt, Artificial Sequence
  MKO10005406_A_Asb3
  gRNA
aauggaucccauucuaugag

SEQ ID NO: 5407 - RNA, 20 nt, Artificial Sequence
  MKO10005407_A_Asb3
  gRNA
aauuccauccacucauagaa

SEQ ID NO: 5408 - RNA, 20 nt, Artificial Sequence
  MKO10005408_A_Asb3
  gRNA
auaagauugcuucuuaaaca

SEQ ID NO: 5409 - RNA, 20 nt, Artificial Sequence
  MKO10005409_A_Asb4
  gRNA
cccguugggacgacaguuga

SEQ ID NO: 5410 - RNA, 20 nt, Artificial Sequence
  MKO10005410_A_Asb4
  gRNA
ggcguucaugcuauccacga

SEQ ID NO: 5411 - RNA, 20 nt, Artificial Sequence
  MKO10005411_A_Asb4
  gRNA
cgcuauccaguacgugcuga

SEQ ID NO: 5412 - RNA, 20 nt, Artificial Sequence
  MKO10005412_A_Asb5
  gRNA
aaguugugcagaacuccuuu

SEQ ID NO: 5413 - RNA, 20 nt, Artificial Sequence
  MKO10005413_A_Asb5
  gRNA
uugugagcaugcguugaaca

SEQ ID NO: 5414 - RNA, 20 nt, Artificial Sequence
  MKO10005414_A_Asb5
  gRNA
cugcaugaagcugcaaguca

SEQ ID NO: 5415 - RNA, 20 nt, Artificial Sequence
  MKO10005415_A_Asb6
  gRNA
gacagcuuuacuucacgccc

SEQ ID NO: 5416 - RNA, 20 nt, Artificial Sequence
  MKO10005416_A_Asb6
  gRNA
acgcauugcucacgccuucc

SEQ ID NO: 5417 - RNA, 20 nt, Artificial Sequence
  MKO10005417_A_Asb6
  gRNA
uccuguugaugucagccccg

SEQ ID NO: 5418 - RNA, 20 nt, Artificial Sequence
  MKO10005418_A_Asb7
  gRNA
uccgauuaaauccuuaaccg

SEQ ID NO: 5419 - RNA, 20 nt, Artificial Sequence
  MKO10005419_A_Asb7
  gRNA
gugaugacgugcucugcgca

SEQ ID NO: 5420 - RNA, 20 nt, Artificial Sequence
  MKO10005420_A_Asb7
  gRNA
ucacacaguacgaaagaugu

SEQ ID NO: 5421 - RNA, 20 nt, Artificial Sequence
  MKO10005421_A_Asb8
  gRNA
gagcucuacgcagucggcgu

SEQ ID NO: 5422 - RNA, 20 nt, Artificial Sequence
  MKO10005422_A_Asb8
  gRNA
ggcuacggcgcacagcauag

SEQ ID NO: 5423 - RNA, 20 nt, Artificial Sequence
  MKO10005423_A_Asb8
  gRNA
acaacgauacgccgcucagc

SEQ ID NO: 5424 - RNA, 20 nt, Artificial Sequence
  MKO10005424_A_Asb9
  gRNA
augcagauguagugucugac

SEQ ID NO: 5425 - RNA, 20 nt, Artificial Sequence
  MKO10005425_A_Asb9
  gRNA
cuagagcuaccuggcugaua

SEQ ID NO: 5426 - RNA, 20 nt, Artificial Sequence
  MKO10005426_A_Asb9
  gRNA
cuccaugaagcaugccucag

SEQ ID NO: 5427 - RNA, 20 nt, Artificial Sequence
  MKO10005427_A_Ascc1
  gRNA
uaggggcacugacgguggcc

SEQ ID NO: 5428 - RNA, 20 nt, Artificial Sequence
  MKO10005428_A_Ascc1
  gRNA
aacacggaucgacgugcucc

SEQ ID NO: 5429 - RNA, 20 nt, Artificial Sequence
  MKO10005429_A_Ascc1
  gRNA
gccuccuccugaacgugucc

SEQ ID NO: 5430 - RNA, 20 nt, Artificial Sequence
  MKO10005430_A_Ascc2
  gRNA
ucguagcuaaugaccucgac

SEQ ID NO: 5431 - RNA, 20 nt, Artificial Sequence
  MKO10005431_A_Ascc2
  gRNA
gaggucauuagcuacgaagu

SEQ ID NO: 5432 - RNA, 20 nt, Artificial Sequence
  MKO10005432_A_Ascc2
  gRNA
ccuccgaauguccacgcaca

SEQ ID NO: 5433 - RNA, 20 nt, Artificial Sequence
  MKO10005433_A_Ascc3
  gRNA
uugaaacuuaugaucgcucg

SEQ ID NO: 5434 - RNA, 20 nt, Artificial Sequence
  MKO10005434_A_Ascc3
  gRNA
guacuuaaacgcaacguuaa

SEQ ID NO: 5435 - RNA, 20 nt, Artificial Sequence
  MKO10005435_A_Ascc3
  gRNA
aaaaccacucuaucguuaca

SEQ ID NO: 5436 - RNA, 20 nt, Artificial Sequence
  MKO10005436_A_Ascl1
  gRNA
aacugaugcgcugcaaacgc

SEQ ID NO: 5437 - RNA, 20 nt, Artificial Sequence
  MKO10005437_A_Ascl1
  gRNA
gcaacgagcgcgagcgcaac

SEQ ID NO: 5438 - RNA, 20 nt, Artificial Sequence
  MKO10005438_A_Ascl1
  gRNA
agggucguaggaucccucgu

SEQ ID NO: 5439 - RNA, 20 nt, Artificial Sequence
  MKO10005439_A_Ascl2
  gRNA
cgccucuacgucuccguccc

SEQ ID NO: 5440 - RNA, 20 nt, Artificial Sequence
  MKO10005440_A_Ascl2
  gRNA
cucccuagggcacgcgucgc

SEQ ID NO: 5441 - RNA, 20 nt, Artificial Sequence
  MKO10005441_A_Ascl2
  gRNA
cgagcgcaaccgcguaaagc

SEQ ID NO: 5442 - RNA, 20 nt, Artificial Sequence
  MKO10005442_A_Ascl3
  gRNA
cgagucaagugugugaacga

SEQ ID NO: 5443 - RNA, 20 nt, Artificial Sequence
  MKO10005443_A_Ascl3
  gRNA
ccggggucucggggcauagg

SEQ ID NO: 5444 - RNA, 20 nt, Artificial Sequence
  MKO10005444_A_Ascl3
  gRNA
cugugacuacaccuacgggc

SEQ ID NO: 5445 - RNA, 20 nt, Artificial Sequence
  MKO10005445_A_Ascl4
  gRNA
cgcgcuacguacagcgccgc

SEQ ID NO: 5446 - RNA, 20 nt, Artificial Sequence
  MKO10005446_A_Ascl4
  gRNA
gccaacgcaacgagcgcgag

SEQ ID NO: 5447 - RNA, 20 nt, Artificial Sequence
  MKO10005447_A_Ascl4
  gRNA
ccgucuccgcgcgcaguccg

SEQ ID NO: 5448 - RNA, 20 nt, Artificial Sequence
  MKO10005448_A_Ascl5
  gRNA
cggguagucguaaaccccga

SEQ ID NO: 5449 - RNA, 20 nt, Artificial Sequence
  MKO10005449_A_Ascl5
  gRNA
uacguugcucaaggguucgg

SEQ ID NO: 5450 - RNA, 20 nt, Artificial Sequence
  MKO10005450_A_Ascl5
  gRNA
cgacuccaaaaaaggcgacg

SEQ ID NO: 5451 - RNA, 20 nt, Artificial Sequence
  MKO10005451_A_Asf1a
  gRNA
cugauuacuugcaccuaccg

SEQ ID NO: 5452 - RNA, 20 nt, Artificial Sequence
  MKO10005452_A_Asf1a
  gRNA
gaucaccuucgagugcaucg

SEQ ID NO: 5453 - RNA, 20 nt, Artificial Sequence
  MKO10005453_A_Asf1a
  gRNA
cagguccucgaugcacucga

SEQ ID NO: 5454 - RNA, 20 nt, Artificial Sequence
  MKO10005454_A_Asf1b
  gRNA
cgcggugauggccaaggugu

SEQ ID NO: 5455 - RNA, 20 nt, Artificial Sequence
  MKO10005455_A_Asf1b
  gRNA
cacauucagcaccgacaccu

SEQ ID NO: 5456 - RNA, 20 nt, Artificial Sequence
  MKO10005456_A_Asf1b
  gRNA
gguggguucucucgaagcuc

SEQ ID NO: 5457 - RNA, 20 nt, Artificial Sequence
  MKO10005457_A_Asgr1
  gRNA
cuucacgugcaguagcaaac

SEQ ID NO: 5458 - RNA, 20 nt, Artificial Sequence
  MKO10005458_A_Asgr1
  gRNA
gcgaagcuugagcugccaga

SEQ ID NO: 5459 - RNA, 20 nt, Artificial Sequence
  MKO10005459_A_Asgr1
  gRNA
gaaguuaguggagucgaagc

SEQ ID NO: 5460 - RNA, 20 nt, Artificial Sequence
  MKO10005460_A_Asgr2
  gRNA
ucaggguucgcagauccauu

SEQ ID NO: 5461 - RNA, 20 nt, Artificial Sequence
  MKO10005461_A_Asgr2
  gRNA
gcgaacccugaccugucagc

SEQ ID NO: 5462 - RNA, 20 nt, Artificial Sequence
  MKO10005462_A_Asgr2
  gRNA
cuucaacauccuccuguugg

SEQ ID NO: 5463 - RNA, 20 nt, Artificial Sequence
  MKO10005463_A_Ash1l
  gRNA
gggcauuuccgaggucgacc

SEQ ID NO: 5464 - RNA, 20 nt, Artificial Sequence
  MKO10005464_A_Ash1l
  gRNA
agcccuguuaguagugacgc

SEQ ID NO: 5465 - RNA, 20 nt, Artificial Sequence
  MKO10005465_A_Ash1l
  gRNA
uuaggacuuggcaccguagu

SEQ ID NO: 5466 - RNA, 20 nt, Artificial Sequence
  MKO10005466_A_Ash2l
  gRNA
ugguucaccgcugacaccuu

SEQ ID NO: 5467 - RNA, 20 nt, Artificial Sequence
  MKO10005467_A_Ash2l
  gRNA
cugccacgucaaauucgcca

SEQ ID NO: 5468 - RNA, 20 nt, Artificial Sequence
  MKO10005468_A_Ash2l
  gRNA
gacguggcagucucgaacac

SEQ ID NO: 5469 - RNA, 20 nt, Artificial Sequence
  MKO10005469_A_Asic1
  gRNA
gaugagacaucguucgaagc

SEQ ID NO: 5470 - RNA, 20 nt, Artificial Sequence
  MKO10005470_A_Asic1
  gRNA
guagaacucacgcauguuga

SEQ ID NO: 5471 - RNA, 20 nt, Artificial Sequence
  MKO10005471_A_Asic1
  gRNA
gccuccuuucaucgaccagc

SEQ ID NO: 5472 - RNA, 20 nt, Artificial Sequence
  MKO10005472_A_Asic2
  gRNA
ucacauaucugcccccgccg

SEQ ID NO: 5473 - RNA, 20 nt, Artificial Sequence
  MKO10005473_A_Asic2
  gRNA
accggcacuccccccacggc

SEQ ID NO: 5474 - RNA, 20 nt, Artificial Sequence
  MKO10005474_A_Asic2
  gRNA
gcccgucccccccuugaccg

SEQ ID NO: 5475 - RNA, 20 nt, Artificial Sequence
  MKO10005475_A_Asic3
  gRNA
caauggacuggagauuaugc

SEQ ID NO: 5476 - RNA, 20 nt, Artificial Sequence
  MKO10005476_A_Asic3
  gRNA
ugacugcaauaccgcaucug

SEQ ID NO: 5477 - RNA, 20 nt, Artificial Sequence
  MKO10005477_A_Asic3
  gRNA
cgacacccuauuaagcuaua

SEQ ID NO: 5478 - RNA, 20 nt, Artificial Sequence
  MKO10005478_A_Asic4
  gRNA
ugcagacgagacgucauucg

SEQ ID NO: 5479 - RNA, 20 nt, Artificial Sequence
  MKO10005479_A_Asic4
  gRNA
cuccaggucuauacucgcua

SEQ ID NO: 5480 - RNA, 20 nt, Artificial Sequence
  MKO10005480_A_Asic4
  gRNA
cccugagcucgcuuuccgcc

SEQ ID NO: 5481 - RNA, 20 nt, Artificial Sequence
  MKO10005481_A_Asic5
  gRNA
gcugcuccucgacguccauc

SEQ ID NO: 5482 - RNA, 20 nt, Artificial Sequence
  MKO10005482_A_Asic5
  gRNA
ggugaccauccgccaacuga

SEQ ID NO: 5483 - RNA, 20 nt, Artificial Sequence
  MKO10005483_A_Asic5
  gRNA
ucaccuuucgaacuuuguuc

SEQ ID NO: 5484 - RNA, 20 nt, Artificial Sequence
  MKO10005484_A_Asl
  gRNA
ucauuggaaccauggucgac

SEQ ID NO: 5485 - RNA, 20 nt, Artificial Sequence
  MKO10005485_A_Asl
  gRNA
aggacgaagucgcaacgacc

SEQ ID NO: 5486 - RNA, 20 nt, Artificial Sequence
  MKO10005486_A_Asl
  gRNA
uaccuucaggcgccgcucgu

SEQ ID NO: 5487 - RNA, 20 nt, Artificial Sequence
  MKO10005487_A_Asmt
  gRNA
gucguccgcgucgacgccca

SEQ ID NO: 5488 - RNA, 20 nt, Artificial Sequence
  MKO10005488_A_Asmt
  gRNA
gcuccgcguguucgacgccg

SEQ ID NO: 5489 - RNA, 20 nt, Artificial Sequence
  MKO10005489_A_Asmt
  gRNA
ggcaccuggcggacggcgug

SEQ ID NO: 5490 - RNA, 20 nt, Artificial Sequence
  MKO10005490_A_Asna1
  gRNA
gcuccccgacgaguucuucg

SEQ ID NO: 5491 - RNA, 20 nt, Artificial Sequence
  MKO10005491_A_Asna1
  gRNA
ucucacgucccuucgacagc

SEQ ID NO: 5492 - RNA, 20 nt, Artificial Sequence
  MKO10005492_A_Asna1
  gRNA
ugaacuguucgcuaacagau

SEQ ID NO: 5493 - RNA, 20 nt, Artificial Sequence
  MKO10005493_A_Asnsd1
  gRNA
uuggucggcguagcuugcuu

SEQ ID NO: 5494 - RNA, 20 nt, Artificial Sequence
  MKO10005494_A_Asnsd1
  gRNA
cugucaacccuucucgaacu

SEQ ID NO: 5495 - RNA, 20 nt, Artificial Sequence
  MKO10005495_A_Asnsd1
  gRNA
ccaaaacgagccauacaauu

SEQ ID NO: 5496 - RNA, 20 nt, Artificial Sequence
  MKO10005496_A_Asns
  gRNA
gcuguaccuuucuagcggcc

SEQ ID NO: 5497 - RNA, 20 nt, Artificial Sequence
  MKO10005497_A_Asns
  gRNA
gcaugccaucuaugacagcg

SEQ ID NO: 5498 - RNA, 20 nt, Artificial Sequence
  MKO10005498_A_Asns
  gRNA
ucuugauagcguugucaaaa

SEQ ID NO: 5499 - RNA, 20 nt, Artificial Sequence
  MKO10005499_A_Aspa
  gRNA
agugcaacccauguuagaag

SEQ ID NO: 5500 - RNA, 20 nt, Artificial Sequence
  MKO10005500_A_Aspa
  gRNA
ugacuuaccaacaggauacu

SEQ ID NO: 5501 - RNA, 20 nt, Artificial Sequence
  MKO10005501_A_Aspa
  gRNA
uuuauagacgucaauagaac

SEQ ID NO: 5502 - RNA, 20 nt, Artificial Sequence
  MKO10005502_A_Aspdh
  gRNA
cgugacccuggacggauggc

SEQ ID NO: 5503 - RNA, 20 nt, Artificial Sequence
  MKO10005503_A_Aspdh
  gRNA
gucccuugugucccgccuuc

SEQ ID NO: 5504 - RNA, 20 nt, Artificial Sequence
  MKO10005504_A_Aspdh
  gRNA
gcccucauagagcacugugc

SEQ ID NO: 5505 - RNA, 20 nt, Artificial Sequence
  MKO10005505_A_Aspg
  gRNA
ggccgucacuccacagugcg

SEQ ID NO: 5506 - RNA, 20 nt, Artificial Sequence
  MKO10005506_A_Aspg
  gRNA
auguuaccugggcacccgug

SEQ ID NO: 5507 - RNA, 20 nt, Artificial Sequence
  MKO10005507_A_Aspg
  gRNA
uggccaauacgucaucccug

SEQ ID NO: 5508 - RNA, 20 nt, Artificial Sequence
  MKO10005508_A_Asphd1
  gRNA
ugcucggguuagaugccauc

SEQ ID NO: 5509 - RNA, 20 nt, Artificial Sequence
  MKO10005509_A_Asphd1
  gRNA
auggcaucuaacccgagcau

SEQ ID NO: 5510 - RNA, 20 nt, Artificial Sequence
  MKO10005510_A_Asphd1
  gRNA
cguucugccccagccacauu

SEQ ID NO: 5511 - RNA, 20 nt, Artificial Sequence
  MKO10005511_A_Asphd2
  gRNA
gcgcgcugcacacaccacga

SEQ ID NO: 5512 - RNA, 20 nt, Artificial Sequence
  MKO10005512_A_Asphd2
  gRNA
caucgcagucccgcacugac

SEQ ID NO: 5513 - RNA, 20 nt, Artificial Sequence
  MKO10005513_A_Asphd2
  gRNA
aucuuugcuccgggacgaug

SEQ ID NO: 5514 - RNA, 20 nt, Artificial Sequence
  MKO10005514_A_Asph
  gRNA
cuuccguuauaacuuaucag

SEQ ID NO: 5515 - RNA, 20 nt, Artificial Sequence
  MKO10005515_A_Asph
  gRNA
ggacaucuguggcugucgug

SEQ ID NO: 5516 - RNA, 20 nt, Artificial Sequence
  MKO10005516_A_Asph
  gRNA
gucgauuaugaagaaguucu

SEQ ID NO: 5517 - RNA, 20 nt, Artificial Sequence
  MKO10005517_A_Aspm
  gRNA
guggacucgcguaaaaacag

SEQ ID NO: 5518 - RNA, 20 nt, Artificial Sequence
  MKO10005518_A_Aspm
  gRNA
aacuuaccauuuccguuacc

SEQ ID NO: 5519 - RNA, 20 nt, Artificial Sequence
  MKO10005519_A_Aspm
  gRNA
acauguucuaugacgaacgc

SEQ ID NO: 5520 - RNA, 20 nt, Artificial Sequence
  MKO10005520_A_Aspn
  gRNA
ucaaccauucgaguaucaaa

SEQ ID NO: 5521 - RNA, 20 nt, Artificial Sequence
  MKO10005521_A_Aspn
  gRNA
aggccuaccaccaacuuugc

SEQ ID NO: 5522 - RNA, 20 nt, Artificial Sequence
  MKO10005522_A_Aspn
  gRNA
cauuccauuugauacucgaa

SEQ ID NO: 5523 - RNA, 20 nt, Artificial Sequence
  MKO10005523_A_Asprv1
  gRNA
uucgucccagaaccuuucac

SEQ ID NO: 5524 - RNA, 20 nt, Artificial Sequence
  MKO10005524_A_Asprv1
  gRNA
cgcaaucacgcuggagagcg

SEQ ID NO: 5525 - RNA, 20 nt, Artificial Sequence
  MKO10005525_A_Asprv1
  gRNA
ggccaacgccagcgcagaag

SEQ ID NO: 5526 - RNA, 20 nt, Artificial Sequence
  MKO10005526_A_Aspscr1
  gRNA
cccucgcggcuacgggacac

SEQ ID NO: 5527 - RNA, 20 nt, Artificial Sequence
  MKO10005527_A_Aspscr1
  gRNA
gccugugucccguagccgcg

SEQ ID NO: 5528 - RNA, 20 nt, Artificial Sequence
  MKO10005528_A_Aspscr1
  gRNA
gguucgcaucgcguuccagc

SEQ ID NO: 5529 - RNA, 20 nt, Artificial Sequence
  MKO10005529_A_Asrgl1
  gRNA
caauaucaccguuuacauuc

SEQ ID NO: 5530 - RNA, 20 nt, Artificial Sequence
  MKO10005530_A_Asrgl1
  gRNA
caccacgagacucacaucga

SEQ ID NO: 5531 - RNA, 20 nt, Artificial Sequence
  MKO10005531_A_Asrgl1
  gRNA
uuggcuuacgcaaccucuac

SEQ ID NO: 5532 - RNA, 20 nt, Artificial Sequence
  MKO10005532_A_Ass1
  gRNA
gucugcaggucaucgcuccc

SEQ ID NO: 5533 - RNA, 20 nt, Artificial Sequence
  MKO10005533_A_Ass1
  gRNA
cucccuuuagguguucauug

SEQ ID NO: 5534 - RNA, 20 nt, Artificial Sequence
  MKO10005534_A_Ass1
  gRNA
ugagcucaccugcuauucac

SEQ ID NO: 5535 - RNA, 20 nt, Artificial Sequence
  MKO10005535_A_Aste1
  gRNA
cggaucugggucuaccagag

SEQ ID NO: 5536 - RNA, 20 nt, Artificial Sequence
  MKO10005536_A_Aste1
  gRNA
gaggagauaucaccgagucc

SEQ ID NO: 5537 - RNA, 20 nt, Artificial Sequence
  MKO10005537_A_Aste1
  gRNA
ccacugaacagguuguacaa

SEQ ID NO: 5538 - RNA, 20 nt, Artificial Sequence
  MKO10005538_A_Astl
  gRNA
uugaacguuucacaugcauc

SEQ ID NO: 5539 - RNA, 20 nt, Artificial Sequence
  MKO10005539_A_Astl
  gRNA
cacaaagccaccaacgcccu

SEQ ID NO: 5540 - RNA, 20 nt, Artificial Sequence
  MKO10005540_A_Astl
  gRNA
caugagcucaugcacguacu

SEQ ID NO: 5541 - RNA, 20 nt, Artificial Sequence
  MKO10005541_A_Astn1
  gRNA
ugaugauccuguacacucgc

SEQ ID NO: 5542 - RNA, 20 nt, Artificial Sequence
  MKO10005542_A_Astn1
  gRNA
ccguaccucgacugcgccuc

SEQ ID NO: 5543 - RNA, 20 nt, Artificial Sequence
  MKO10005543_A_Astn1
  gRNA
cuugcgcaaugcccgugugc

SEQ ID NO: 5544 - RNA, 20 nt, Artificial Sequence
  MKO10005544_A_Astn2
  gRNA
auacggugacggucuugagc

SEQ ID NO: 5545 - RNA, 20 nt, Artificial Sequence
  MKO10005545_A_Astn2
  gRNA
cuguuccucaacgaucuccg

SEQ ID NO: 5546 - RNA, 20 nt, Artificial Sequence
  MKO10005546_A_Astn2
  gRNA
aucuuguaccgcgaugcgcc

SEQ ID NO: 5547 - RNA, 20 nt, Artificial Sequence
  MKO10005547_A_Asun
  gRNA
gauuaccgaauaccagcaug

SEQ ID NO: 5548 - RNA, 20 nt, Artificial Sequence
  MKO10005548_A_Asun
  gRNA
aaugcucgaagauugugucc

SEQ ID NO: 5549 - RNA, 20 nt, Artificial Sequence
  MKO10005549_A_Asun
  gRNA
guaaagugcgagccucaugc

SEQ ID NO: 5550 - RNA, 20 nt, Artificial Sequence
  MKO10005550_A_Asxl1
  gRNA
gccagaggacuccgcugaug

SEQ ID NO: 5551 - RNA, 20 nt, Artificial Sequence
  MKO10005551_A_Asxl1
  gRNA
auggcauugaggcacgcaag

SEQ ID NO: 5552 - RNA, 20 nt, Artificial Sequence
  MKO10005552_A_Asxl1
  gRNA
ugagugugaaaagacuaaug

SEQ ID NO: 5553 - RNA, 20 nt, Artificial Sequence
  MKO10005553_A_Asxl2
  gRNA
guauacacgcccauucuacc

SEQ ID NO: 5554 - RNA, 20 nt, Artificial Sequence
  MKO10005554_A_Asxl2
  gRNA
aaugggcguguauacuuuga

SEQ ID NO: 5555 - RNA, 20 nt, Artificial Sequence
  MKO10005555_A_Asxl2
  gRNA
gacagcucuuucacuccauc

SEQ ID NO: 5556 - RNA, 20 nt, Artificial Sequence
  MKO10005556_A_Asxl3
  gRNA
gagcagucggauucgccuuc

SEQ ID NO: 5557 - RNA, 20 nt, Artificial Sequence
  MKO10005557_A_Asxl3
  gRNA
uuugcacugccguguucgua

SEQ ID NO: 5558 - RNA, 20 nt, Artificial Sequence
  MKO10005558_A_Asxl3
  gRNA
agauugcagccuuacgaaca

SEQ ID NO: 5559 - RNA, 20 nt, Artificial Sequence
  MKO10005559_A_Asz1
  gRNA
ucuuauguaugccgcuagug

SEQ ID NO: 5560 - RNA, 20 nt, Artificial Sequence
  MKO10005560_A_Asz1
  gRNA
cggagccgaaguuaacgccc

SEQ ID NO: 5561 - RNA, 20 nt, Artificial Sequence
  MKO10005561_A_Asz1
  gRNA
caaccugaguaugaccgucu

SEQ ID NO: 5562 - RNA, 20 nt, Artificial Sequence
  MKO10005562_A_Auad1
  gRNA
cagaacuggaacgauuucgu

SEQ ID NO: 5563 - RNA, 20 nt, Artificial Sequence
  MKO10005563_A_Auad1
  gRNA
cacuuaucagucagugucga

SEQ ID NO: 5564 - RNA, 20 nt, Artificial Sequence
  MKO10005564_A_Auad1
  gRNA
gaaccgacagccugcuucuu

SEQ ID NO: 5565 - RNA, 20 nt, Artificial Sequence
  MKO10005565_A_Auad2b
  gRNA
auccgacgaaaccgucgauc

SEQ ID NO: 5566 - RNA, 20 nt, Artificial Sequence
  MKO10005566_A_Auad2b
  gRNA
ucucuacuucgccugaucga

SEQ ID NO: 5567 - RNA, 20 nt, Artificial Sequence
  MKO10005567_A_Auad2b
  gRNA
cacaagcuacuauguccguu

SEQ ID NO: 5568 - RNA, 20 nt, Artificial Sequence
  MKO10005568_A_Auad2
  gRNA
accacaacacgcgcucuuua

SEQ ID NO: 5569 - RNA, 20 nt, Artificial Sequence
  MKO10005569_A_Auad2
  gRNA
uaggcaauuugcucgacagc

SEQ ID NO: 5570 - RNA, 20 nt, Artificial Sequence
  MKO10005570_A_Auad2
  gRNA
uuccucaaugagcgaauaac

SEQ ID NO: 5571 - RNA, 20 nt, Artificial Sequence
  MKO10005571_A_Auad3a
  gRNA
cgauguccuaccucgccgua

SEQ ID NO: 5572 - RNA, 20 nt, Artificial Sequence
  MKO10005572_A_Auad3a
  gRNA
gcucgcucgacagcgcuaug

SEQ ID NO: 5573 - RNA, 20 nt, Artificial Sequence
  MKO10005573_A_Auad3a
  gRNA
gcugucgagcgagcuuaucc

SEQ ID NO: 5574 - RNA, 20 nt, Artificial Sequence
  MKO10005574_A_Auad5
  gRNA
uuguacgccuuugucgauug

SEQ ID NO: 5575 - RNA, 20 nt, Artificial Sequence
  MKO10005575_A_Auad5
  gRNA
gacuaaaccuucccuagcug

SEQ ID NO: 5576 - RNA, 20 nt, Artificial Sequence
  MKO10005576_A_Auad5
  gRNA
cagucuuugauccgccaauu

SEQ ID NO: 5577 - RNA, 20 nt, Artificial Sequence
  MKO10005577_A_Auau1
  gRNA
augucaccgggccggcguug

SEQ ID NO: 5578 - RNA, 20 nt, Artificial Sequence
  MKO10005578_A_Auau1
  gRNA
cauggaguucccguucgaug

SEQ ID NO: 5579 - RNA, 20 nt, Artificial Sequence
  MKO10005579_A_Auau1
  gRNA
ucaguauguaaauaacgugc

SEQ ID NO: 5580 - RNA, 20 nt, Artificial Sequence
  MKO10005580_A_Aucay
  gRNA
gugcggccaacggucgucug

SEQ ID NO: 5581 - RNA, 20 nt, Artificial Sequence
  MKO10005581_A_Aucay
  gRNA
aguucgccacagacgaccgu

SEQ ID NO: 5582 - RNA, 20 nt, Artificial Sequence
  MKO10005582_A_Aucay
  gRNA
aggugugucgaggaagucgu

SEQ ID NO: 5583 - RNA, 20 nt, Artificial Sequence
  MKO10005583_A_Ate1
  gRNA
gaucucgaaaggcaauugug

SEQ ID NO: 5584 - RNA, 20 nt, Artificial Sequence
  MKO10005584_A_Ate1
  gRNA
uaucaggaucuuauagaccg

SEQ ID NO: 5585 - RNA, 20 nt, Artificial Sequence
  MKO10005585_A_Ate1
  gRNA
cauucauccacaaucuauag

SEQ ID NO: 5586 - RNA, 20 nt, Artificial Sequence
  MKO10005586_A_Atf1
  gRNA
cacgucucucccgcagaccg

SEQ ID NO: 5587 - RNA, 20 nt, Artificial Sequence
  MKO10005587_A_Atf1
  gRNA
gagagacguggcagacggcg

SEQ ID NO: 5588 - RNA, 20 nt, Artificial Sequence
  MKO10005588_A_Atf1
  gRNA
gauacucgucccgagcaacc

SEQ ID NO: 5589 - RNA, 20 nt, Artificial Sequence
  MKO10005589_A_Atf2
  gRNA
gucgacucggggugagguaa

SEQ ID NO: 5590 - RNA, 20 nt, Artificial Sequence
  MKO10005590_A_Atf2
  gRNA
uggacgaacgauagcugaug

SEQ ID NO: 5591 - RNA, 20 nt, Artificial Sequence
  MKO10005591_A_Atf2
  gRNA
gucgacuaccagugaugaaa

SEQ ID NO: 5592 - RNA, 20 nt, Artificial Sequence
  MKO10005592_A_Atf3
  gRNA
auucugagcccggacgaugc

SEQ ID NO: 5593 - RNA, 20 nt, Artificial Sequence
  MKO10005593_A_Atf3
  gRNA
uaccgucaacaacagacccc

SEQ ID NO: 5594 - RNA, 20 nt, Artificial Sequence
  MKO10005594_A_Atf3
  gRNA
ugcaucguccgggcucagaa

SEQ ID NO: 5595 - RNA, 20 nt, Artificial Sequence
  MKO10005595_A_Atf4
  gRNA
ccgccaacacuucgcuguuc

SEQ ID NO: 5596 - RNA, 20 nt, Artificial Sequence
  MKO10005596_A_Atf4
  gRNA
gaugucccccuucgaccagu

SEQ ID NO: 5597 - RNA, 20 nt, Artificial Sequence
  MKO10005597_A_Atf4
  gRNA
agaugagcucuugaccacgu

SEQ ID NO: 5598 - RNA, 20 nt, Artificial Sequence
  MKO10005598_A_Atf5
  gRNA
cuugcgguccccucgugugc

SEQ ID NO: 5599 - RNA, 20 nt, Artificial Sequence
  MKO10005599_A_Atf5
  gRNA
ccuuauacaccucaauuagc

SEQ ID NO: 5600 - RNA, 20 nt, Artificial Sequence
  MKO10005600_A_Atf5
  gRNA
agccagcccagcccgcuagc

SEQ ID NO: 5601 - RNA, 20 nt, Artificial Sequence
  MKO10005601_A_Atf6b
  gRNA
guuguuccguugcguggagc

SEQ ID NO: 5602 - RNA, 20 nt, Artificial Sequence
  MKO10005602_A_Atf6b
  gRNA
agugaucuggaccguuucaa

SEQ ID NO: 5603 - RNA, 20 nt, Artificial Sequence
  MKO10005603_A_Atf6b
  gRNA
ggacauccugcuccacgcaa

SEQ ID NO: 5604 - RNA, 20 nt, Artificial Sequence
  MKO10005604_A_Atf6
  gRNA
auuacagcugucgccauaua

SEQ ID NO: 5605 - RNA, 20 nt, Artificial Sequence
  MKO10005605_A_Atf6
  gRNA
ucgacguuguuugcugaacu

SEQ ID NO: 5606 - RNA, 20 nt, Artificial Sequence
  MKO10005606_A_Atf6
  gRNA
aguugaagaacacgagucug

SEQ ID NO: 5607 - RNA, 20 nt, Artificial Sequence
  MKO10005607_A_Atf7ip2
  gRNA
uuaaauucuagguuaaacau

SEQ ID NO: 5608 - RNA, 20 nt, Artificial Sequence
  MKO10005608_A_Atf7ip2
  gRNA
caaauuaaugaaaaugcuug

SEQ ID NO: 5609 - RNA, 20 nt, Artificial Sequence
  MKO10005609_A_Atf7ip2
  gRNA
uccagacagaaaaagacaga

SEQ ID NO: 5610 - RNA, 20 nt, Artificial Sequence
  MKO10005610_A_Atf7ip
  gRNA
ccguacguacuucucacagg

SEQ ID NO: 5611 - RNA, 20 nt, Artificial Sequence
  MKO10005611_A_Atf7ip
  gRNA
uccaaaacguuugguuaacc

SEQ ID NO: 5612 - RNA, 20 nt, Artificial Sequence
  MKO10005612_A_Atf7ip
  gRNA
ggcagugcucaccgagcugc

SEQ ID NO: 5613 - RNA, 20 nt, Artificial Sequence
  MKO10005613_A_Atf7
  gRNA
acaccuaccauuguacgucc

SEQ ID NO: 5614 - RNA, 20 nt, Artificial Sequence
  MKO10005614_A_Atf7
  gRNA
ggcgaugagucuacuuccac

SEQ ID NO: 5615 - RNA, 20 nt, Artificial Sequence
  MKO10005615_A_Atf7
  gRNA
gagccaggacguacaauggu

SEQ ID NO: 5616 - RNA, 20 nt, Artificial Sequence
  MKO10005616_A_Aug10
  gRNA
uucaugagugcuauaagccg

SEQ ID NO: 5617 - RNA, 20 nt, Artificial Sequence
  MKO10005617_A_Aug10
  gRNA
agaugggagaccguuagcuc

SEQ ID NO: 5618 - RNA, 20 nt, Artificial Sequence
  MKO10005618_A_Aug10
  gRNA
ggagaauuuagagcuaccaa

SEQ ID NO: 5619 - RNA, 20 nt, Artificial Sequence
  MKO10005619_A_Aug12
  gRNA
ugcaguuucgcccggaacgg

SEQ ID NO: 5620 - RNA, 20 nt, Artificial Sequence
  MKO10005620_A_Aug12
  gRNA
cucuggaaggcucucgccgc

SEQ ID NO: 5621 - RNA, 20 nt, Artificial Sequence
  MKO10005621_A_Aug12
  gRNA
gagcgaacccggaccaucca

SEQ ID NO: 5622 - RNA, 20 nt, Artificial Sequence
  MKO10005622_A_Aug13
  gRNA
uuuacccaaucugaacccgu

SEQ ID NO: 5623 - RNA, 20 nt, Artificial Sequence
  MKO10005623_A_Aug13
  gRNA
caccagccuaucgacucucc

SEQ ID NO: 5624 - RNA, 20 nt, Artificial Sequence
  MKO10005624_A_Aug13
  gRNA
ccgcucaucaucuuccccga

SEQ ID NO: 5625 - RNA, 20 nt, Artificial Sequence
  MKO10005625_A_Aug14
  gRNA
gaagucuucacuucgucgau

SEQ ID NO: 5626 - RNA, 20 nt, Artificial Sequence
  MKO10005626_A_Aug14
  gRNA
aucgacgaagugaagacuuc

SEQ ID NO: 5627 - RNA, 20 nt, Artificial Sequence
  MKO10005627_A_Aug14
  gRNA
aaagcggcuuacagaucagu

SEQ ID NO: 5628 - RNA, 20 nt, Artificial Sequence
  MKO10005628_A_Aug16l1
  gRNA
ccgcgaugugacgcuuccag

SEQ ID NO: 5629 - RNA, 20 nt, Artificial Sequence
  MKO10005629_A_Aug16l1
  gRNA
gucacaucgcggaggaacug

SEQ ID NO: 5630 - RNA, 20 nt, Artificial Sequence
  MKO10005630_A_Aug16l1
  gRNA
uuccacgcaccaucaugucc

SEQ ID NO: 5631 - RNA, 20 nt, Artificial Sequence
  MKO10005631_A_Aug16l2
  gRNA
auuacguagauugcgcucag

SEQ ID NO: 5632 - RNA, 20 nt, Artificial Sequence
  MKO10005632_A_Aug16l2
  gRNA
gcaagucgcgugccucuucc

SEQ ID NO: 5633 - RNA, 20 nt, Artificial Sequence
  MKO10005633_A_Aug16l2
  gRNA
aaaguugaaguccgaaccaa

SEQ ID NO: 5634 - RNA, 20 nt, Artificial Sequence
  MKO10005634_A_Aug2a
  gRNA
gugcagcugccgauuugcag

SEQ ID NO: 5635 - RNA, 20 nt, Artificial Sequence
  MKO10005635_A_Aug2a
  gRNA
cucaagagugccuucgggaa

SEQ ID NO: 5636 - RNA, 20 nt, Artificial Sequence
  MKO10005636_A_Aug2a
  gRNA
aggcuuugugagcuccaucg

SEQ ID NO: 5637 - RNA, 20 nt, Artificial Sequence
  MKO10005637_A_Aug2b
  gRNA
caccuaccuacucgaggucg

SEQ ID NO: 5638 - RNA, 20 nt, Artificial Sequence
  MKO10005638_A_Aug2b
  gRNA
gaaacagccgacgaguccuc

SEQ ID NO: 5639 - RNA, 20 nt, Artificial Sequence
  MKO10005639_A_Aug2b
  gRNA
agaggcaucccaaccuuucg

SEQ ID NO: 5640 - RNA, 20 nt, Artificial Sequence
  MKO10005640_A_Aug3
  gRNA
uguuuacaccgcuuguagca

SEQ ID NO: 5641 - RNA, 20 nt, Artificial Sequence
  MKO10005641_A_Aug3
  gRNA
gauggaguauucggaugaau

SEQ ID NO: 5642 - RNA, 20 nt, Artificial Sequence
  MKO10005642_A_Aug3
  gRNA
ggguguaaucaccccagaag

SEQ ID NO: 5643 - RNA, 20 nt, Artificial Sequence
  MKO10005643_A_Aug4a
  gRNA
gcugcugguagucaaguugc

SEQ ID NO: 5644 - RNA, 20 nt, Artificial Sequence
  MKO10005644_A_Aug4a
  gRNA
uuugguuuaugcccaagcga

SEQ ID NO: 5645 - RNA, 20 nt, Artificial Sequence
  MKO10005645_A_Aug4a
  gRNA
uccuucuguauguaaaccau

SEQ ID NO: 5646 - RNA, 20 nt, Artificial Sequence
  MKO10005646_A_Aug4b
  gRNA
ugggguugcaugcuucggug

SEQ ID NO: 5647 - RNA, 20 nt, Artificial Sequence
  MKO10005647_A_Aug4b
  gRNA
ccuguauguaaaccaaaguc

SEQ ID NO: 5648 - RNA, 20 nt, Artificial Sequence
  MKO10005648_A_Aug4b
  gRNA
aggacauuaaaguagcuguc

SEQ ID NO: 5649 - RNA, 20 nt, Artificial Sequence
  MKO10005649_A_Aug4c
  gRNA
cgauugguauggaccagcgg

SEQ ID NO: 5650 - RNA, 20 nt, Artificial Sequence
  MKO10005650_A_Aug4c
  gRNA
uggggcugcacgcugcggac

SEQ ID NO: 5651 - RNA, 20 nt, Artificial Sequence
  MKO10005651_A_Aug4c
  gRNA
gauucccccguggccgucuu

SEQ ID NO: 5652 - RNA, 20 nt, Artificial Sequence
  MKO10005652_A_Aug4d
  gRNA
ccguggaugaucagcgaacc

SEQ ID NO: 5653 - RNA, 20 nt, Artificial Sequence
  MKO10005653_A_Aug4d
  gRNA
gaucauccacgggcccccuu

SEQ ID NO: 5654 - RNA, 20 nt, Artificial Sequence
  MKO10005654_A_Aug4d
  gRNA
ucgcccgcagaggugaacag

SEQ ID NO: 5655 - RNA, 20 nt, Artificial Sequence
  MKO10005655_A_Aug5
  gRNA
uuccaugaguuuccgguuga

SEQ ID NO: 5656 - RNA, 20 nt, Artificial Sequence
  MKO10005656_A_Aug5
  gRNA
uauccccuuuagaauauauc

SEQ ID NO: 5657 - RNA, 20 nt, Artificial Sequence
  MKO10005657_A_Aug5
  gRNA
aagagucagcuauuugacgu

SEQ ID NO: 5658 - RNA, 20 nt, Artificial Sequence
  MKO10005658_A_Aug7
  gRNA
gaaguugaacgaguaccgcc

SEQ ID NO: 5659 - RNA, 20 nt, Artificial Sequence
  MKO10005659_A_Aug7
  gRNA
auuuacuuaccgcgaagguc

SEQ ID NO: 5660 - RNA, 20 nt, Artificial Sequence
  MKO10005660_A_Aug7
  gRNA
aaagggggcgaacugcaacu

SEQ ID NO: 5661 - RNA, 20 nt, Artificial Sequence
  MKO10005661_A_Aug9a
  gRNA
cauaguccacacagcuaacc

SEQ ID NO: 5662 - RNA, 20 nt, Artificial Sequence
  MKO10005662_A_Aug9a
  gRNA
uugggauccgaagagcaugu

SEQ ID NO: 5663 - RNA, 20 nt, Artificial Sequence
  MKO10005663_A_Aug9a
  gRNA
cugcccaagucuguagugcc

SEQ ID NO: 5664 - RNA, 20 nt, Artificial Sequence
  MKO10005664_A_Aug9b
  gRNA
cauuguaauccacgcagcga

SEQ ID NO: 5665 - RNA, 20 nt, Artificial Sequence
  MKO10005665_A_Aug9b
  gRNA
aaccuuccuccuucgcugcg

SEQ ID NO: 5666 - RNA, 20 nt, Artificial Sequence
  MKO10005666_A_Aug9b
  gRNA
gauccacgacaguccccugu

SEQ ID NO: 5667 - RNA, 20 nt, Artificial Sequence
  MKO10005667_A_Athl1
  gRNA
agaauaccgaguccguacgc

SEQ ID NO: 5668 - RNA, 20 nt, Artificial Sequence
  MKO10005668_A_Athl1
  gRNA
gcugcucaggguuaaguacg

SEQ ID NO: 5669 - RNA, 20 nt, Artificial Sequence
  MKO10005669_A_Athl1
  gRNA
gugauucuuaccggaguccc

SEQ ID NO: 5670 - RNA, 20 nt, Artificial Sequence
  MKO10005670_A_Atic
  gRNA
cacuuaccagcauggaccgc

SEQ ID NO: 5671 - RNA, 20 nt, Artificial Sequence
  MKO10005671_A_Atic
  gRNA
gccagaagucucgcgucucu

SEQ ID NO: 5672 - RNA, 20 nt, Artificial Sequence
  MKO10005672_A_Atic
  gRNA
acgcgucccccuaacauuuc

SEQ ID NO: 5673 - RNA, 20 nt, Artificial Sequence
  MKO10005673_A_Atl1
  gRNA
guugcgguacauguacaacc

SEQ ID NO: 5674 - RNA, 20 nt, Artificial Sequence
  MKO10005674_A_Atl1
  gRNA
cgcagccucgucuaacucaa

SEQ ID NO: 5675 - RNA, 20 nt, Artificial Sequence
  MKO10005675_A_Atl1
  gRNA
gauuacaaugaaccauugac

SEQ ID NO: 5676 - RNA, 20 nt, Artificial Sequence
  MKO10005676_A_Atl2
  gRNA
ugugcugcuaauggauaccc

SEQ ID NO: 5677 - RNA, 20 nt, Artificial Sequence
  MKO10005677_A_Atl2
  gRNA
uauccuuaugagcacucaua

SEQ ID NO: 5678 - RNA, 20 nt, Artificial Sequence
  MKO10005678_A_Atl2
  gRNA
aagccauaugagugcucaua

SEQ ID NO: 5679 - RNA, 20 nt, Artificial Sequence
  MKO10005679_A_Atl3
  gRNA
cgccaugaaaauccugucag

SEQ ID NO: 5680 - RNA, 20 nt, Artificial Sequence
  MKO10005680_A_Atl3
  gRNA
ccauauccgagaucuugaug

SEQ ID NO: 5681 - RNA, 20 nt, Artificial Sequence
  MKO10005681_A_Atl3
  gRNA
aaugggcauaggugaugcca

SEQ ID NO: 5682 - RNA, 20 nt, Artificial Sequence
  MKO10005682_A_Atmin
  gRNA
gcugccuugcagucgcgacu

SEQ ID NO: 5683 - RNA, 20 nt, Artificial Sequence
  MKO10005683_A_Atmin
  gRNA
cgucaagagccaccgacugc

SEQ ID NO: 5684 - RNA, 20 nt, Artificial Sequence
  MKO10005684_A_Atmin
  gRNA
agagcgucgcgacgccuccc

SEQ ID NO: 5685 - RNA, 20 nt, Artificial Sequence
  MKO10005685_A_Atm
  gRNA
uaaauuuaagcgccugauuc

SEQ ID NO: 5686 - RNA, 20 nt, Artificial Sequence
  MKO10005686_A_Atm
  gRNA
ccuggcauacugaauagccu

SEQ ID NO: 5687 - RNA, 20 nt, Artificial Sequence
  MKO10005687_A_Atm
  gRNA
agaccucuugaauuauguca

SEQ ID NO: 5688 - RNA, 20 nt, Artificial Sequence
  MKO10005688_A_Atn1
  gRNA
gcgcgcacgaguugaagccg

SEQ ID NO: 5689 - RNA, 20 nt, Artificial Sequence
  MKO10005689_A_Atn1
  gRNA
ccuccagcggcacgaaguac

SEQ ID NO: 5690 - RNA, 20 nt, Artificial Sequence
  MKO10005690_A_Atn1
  gRNA
ugaggauacgcuccgggugg

SEQ ID NO: 5691 - RNA, 20 nt, Artificial Sequence
  MKO10005691_A_Atoh1
  gRNA
acgggauaacguugcgcagc

SEQ ID NO: 5692 - RNA, 20 nt, Artificial Sequence
  MKO10005692_A_Atoh1
  gRNA
auagcaccgacccacgcgcc

SEQ ID NO: 5693 - RNA, 20 nt, Artificial Sequence
  MKO10005693_A_Atoh1
  gRNA
gcgggcgccucugcgguagc

SEQ ID NO: 5694 - RNA, 20 nt, Artificial Sequence
  MKO10005694_A_Atoh7
  gRNA
guucgaccggcugcgcaggg

SEQ ID NO: 5695 - RNA, 20 nt, Artificial Sequence
  MKO10005695_A_Atoh7
  gRNA
cgagcgcgcggucucgugcg

SEQ ID NO: 5696 - RNA, 20 nt, Artificial Sequence
  MKO10005696_A_Atoh7
  gRNA
cgcgcacgagaccgcgcgcu

SEQ ID NO: 5697 - RNA, 20 nt, Artificial Sequence
  MKO10005697_A_Atoh8
  gRNA
cgaagcgaccgccgccucaa

SEQ ID NO: 5698 - RNA, 20 nt, Artificial Sequence
  MKO10005698_A_Atoh8
  gRNA
gagccggugcggcgcgcgaa

SEQ ID NO: 5699 - RNA, 20 nt, Artificial Sequence
  MKO10005699_A_Atoh8
  gRNA
caggugccgugcuacuccua

SEQ ID NO: 5700 - RNA, 20 nt, Artificial Sequence
  MKO10005700_A_Atox1
  gRNA
gcagaagcacgaguucuccg

SEQ ID NO: 5701 - RNA, 20 nt, Artificial Sequence
  MKO10005701_A_Atox1
  gRNA
gucgaugcagaccuucuugu

SEQ ID NO: 5702 - RNA, 20 nt, Artificial Sequence
  MKO10005702_A_Atox1
  gRNA
cauugaccugcccaacaaga

SEQ ID NO: 5703 - RNA, 20 nt, Artificial Sequence
  MKO10005703_A_Atp10a
  gRNA
cacuuggcgccgcuucaggu

SEQ ID NO: 5704 - RNA, 20 nt, Artificial Sequence
  MKO10005704_A_Atp10a
  gRNA
ccacaucgagacugcuaacc

SEQ ID NO: 5705 - RNA, 20 nt, Artificial Sequence
  MKO10005705_A_Atp10a
  gRNA
ggggcccacuauuguucagc

SEQ ID NO: 5706 - RNA, 20 nt, Artificial Sequence
  MKO10005706_A_Atp10b
  gRNA
ucacgacacgccucugcuug

SEQ ID NO: 5707 - RNA, 20 nt, Artificial Sequence
  MKO10005707_A_Atp10b
  gRNA
cugcaccauccgaaacaccg

SEQ ID NO: 5708 - RNA, 20 nt, Artificial Sequence
  MKO10005708_A_Atp10b
  gRNA
aacgcuacaugcugaagcgc

SEQ ID NO: 5709 - RNA, 20 nt, Artificial Sequence
  MKO10005709_A_Atp10d
  gRNA
acgacgcggugcuuuccugc

SEQ ID NO: 5710 - RNA, 20 nt, Artificial Sequence
  MKO10005710_A_Atp10d
  gRNA
ccguauccgguuauucacgu

SEQ ID NO: 5711 - RNA, 20 nt, Artificial Sequence
  MKO10005711_A_Atp10d
  gRNA
aaugaccucagccgauuccg

SEQ ID NO: 5712 - RNA, 20 nt, Artificial Sequence
  MKO10005712_A_Atp11a
  gRNA
ggacagucggaccaucuacg

SEQ ID NO: 5713 - RNA, 20 nt, Artificial Sequence
  MKO10005713_A_Atp11a
  gRNA
acacugguucauggcguugu

SEQ ID NO: 5714 - RNA, 20 nt, Artificial Sequence
  MKO10005714_A_Atp11a
  gRNA
ggaggagacgauucuauugu

SEQ ID NO: 5715 - RNA, 20 nt, Artificial Sequence
  MKO10005715_A_Atp11b
  gRNA
aaguccacugguaauuggac

SEQ ID NO: 5716 - RNA, 20 nt, Artificial Sequence
  MKO10005716_A_Atp11b
  gRNA
gaacuauuuacauagccaac

SEQ ID NO: 5717 - RNA, 20 nt, Artificial Sequence
  MKO10005717_A_Atp11b
  gRNA
aaacucgauccaaaaacauu

SEQ ID NO: 5718 - RNA, 20 nt, Artificial Sequence
  MKO10005718_A_Atp11c
  gRNA
ccucggacgcgauguuccgc

SEQ ID NO: 5719 - RNA, 20 nt, Artificial Sequence
  MKO10005719_A_Atp11c
  gRNA
guguacucaccaaacgguug

SEQ ID NO: 5720 - RNA, 20 nt, Artificial Sequence
  MKO10005720_A_Atp11c
  gRNA
caaaaucuuugcgcaauaua

SEQ ID NO: 5721 - RNA, 20 nt, Artificial Sequence
  MKO10005721_A_Atp12a
  gRNA
uccccguuaaaauaacgacc

SEQ ID NO: 5722 - RNA, 20 nt, Artificial Sequence
  MKO10005722_A_Atp12a
  gRNA
cuuuaguaagaugauccccc

SEQ ID NO: 5723 - RNA, 20 nt, Artificial Sequence
  MKO10005723_A_Atp12a
  gRNA
cguugggcccaucccgagcc

SEQ ID NO: 5724 - RNA, 20 nt, Artificial Sequence
  MKO10005724_A_Atp13a1
  gRNA
ucuggugccuggacgaguau

SEQ ID NO: 5725 - RNA, 20 nt, Artificial Sequence
  MKO10005725_A_Atp13a1
  gRNA
uguaguaccaauacucgucc

SEQ ID NO: 5726 - RNA, 20 nt, Artificial Sequence
  MKO10005726_A_Atp13a1
  gRNA
uuccuaccuugucacggugc

SEQ ID NO: 5727 - RNA, 20 nt, Artificial Sequence
  MKO10005727_A_Atp13a2
  gRNA
cgauugacgucccugucguc

SEQ ID NO: 5728 - RNA, 20 nt, Artificial Sequence
  MKO10005728_A_Atp13a2
  gRNA
ggccaucggcuaucacgccg

SEQ ID NO: 5729 - RNA, 20 nt, Artificial Sequence
  MKO10005729_A_Atp13a2
  gRNA
cgcaggcgcacgccccacaa

SEQ ID NO: 5730 - RNA, 20 nt, Artificial Sequence
  MKO10005730_A_Atp13a3
  gRNA
auggcuauaacuuaugccgc

SEQ ID NO: 5731 - RNA, 20 nt, Artificial Sequence
  MKO10005731_A_Atp13a3
  gRNA
gccacucaggcagccaguag

SEQ ID NO: 5732 - RNA, 20 nt, Artificial Sequence
  MKO10005732_A_Atp13a3
  gRNA
accauagcauaagauauuuc

SEQ ID NO: 5733 - RNA, 20 nt, Artificial Sequence
  MKO10005733_A_Atp13a4
  gRNA
uaucccucgucuguaaugag

SEQ ID NO: 5734 - RNA, 20 nt, Artificial Sequence
  MKO10005734_A_Atp13a4
  gRNA
aguucgcuuaccuuuagauc

SEQ ID NO: 5735 - RNA, 20 nt, Artificial Sequence
  MKO10005735_A_Atp13a4
  gRNA
uuugcccauacacgccaagc

SEQ ID NO: 5736 - RNA, 20 nt, Artificial Sequence
  MKO10005736_A_Atp13a5
  gRNA
uuugacauccaccauacguu

SEQ ID NO: 5737 - RNA, 20 nt, Artificial Sequence
  MKO10005737_A_Atp13a5
  gRNA
ucagacccaauccaaacgua

SEQ ID NO: 5738 - RNA, 20 nt, Artificial Sequence
  MKO10005738_A_Atp13a5
  gRNA
acagugcucuccguaaauuc

SEQ ID NO: 5739 - RNA, 20 nt, Artificial Sequence
  MKO10005739_A_Atp1a1
  gRNA
guaugagccugccgcuguau

SEQ ID NO: 5740 - RNA, 20 nt, Artificial Sequence
  MKO10005740_A_Atp1a1
  gRNA
gucaccaugcuccgauacag

SEQ ID NO: 5741 - RNA, 20 nt, Artificial Sequence
  MKO10005741_A_Atp1a1
  gRNA
aaucuguuccguauuuacga

SEQ ID NO: 5742 - RNA, 20 nt, Artificial Sequence
  MKO10005742_A_Atp1a2
  gRNA
auaucuagguaucgugcuag

SEQ ID NO: 5743 - RNA, 20 nt, Artificial Sequence
  MKO10005743_A_Atp1a2
  gRNA
cauagcggccaggauaccau

SEQ ID NO: 5744 - RNA, 20 nt, Artificial Sequence
  MKO10005744_A_Atp1a2
  gRNA
uggcucacauuaucguugga

SEQ ID NO: 5745 - RNA, 20 nt, Artificial Sequence
  MKO10005745_A_Atp1a3
  gRNA
auccaggucccggcgcucuu

SEQ ID NO: 5746 - RNA, 20 nt, Artificial Sequence
  MKO10005746_A_Atp1a3
  gRNA
auacaauacugacugcgugc

SEQ ID NO: 5747 - RNA, 20 nt, Artificial Sequence
  MKO10005747_A_Atp1a3
  gRNA
caucccgggcuaggaucucc

SEQ ID NO: 5748 - RNA, 20 nt, Artificial Sequence
  MKO10005748_A_Atp1a4
  gRNA
uaucucggcgcaaggaugca

SEQ ID NO: 5749 - RNA, 20 nt, Artificial Sequence
  MKO10005749_A_Atp1a4
  gRNA
ggaugaucacaagcuaacgu

SEQ ID NO: 5750 - RNA, 20 nt, Artificial Sequence
  MKO10005750_A_Atp1a4
  gRNA
gagauaacccugauaucagc

SEQ ID NO: 5751 - RNA, 20 nt, Artificial Sequence
  MKO10005751_A_Atp1b1
  gRNA
ggcgacaucaaucacgaacg

SEQ ID NO: 5752 - RNA, 20 nt, Artificial Sequence
  MKO10005752_A_Atp1b1
  gRNA
auugaugucgccccguuccu

SEQ ID NO: 5753 - RNA, 20 nt, Artificial Sequence
  MKO10005753_A_Atp1b1
  gRNA
cgaaaaucaugucguccuuc

SEQ ID NO: 5754 - RNA, 20 nt, Artificial Sequence
  MKO10005754_A_Atp1b2
  gRNA
cugguguggccagucgaucc

SEQ ID NO: 5755 - RNA, 20 nt, Artificial Sequence
  MKO10005755_A_Atp1b2
  gRNA
uugaacuggcaggcacguuu

SEQ ID NO: 5756 - RNA, 20 nt, Artificial Sequence
  MKO10005756_A_Atp1b2
  gRNA
aacgugccugccaguucaac

SEQ ID NO: 5757 - RNA, 20 nt, Artificial Sequence
  MKO10005757_A_Atp1b3
  gRNA
gccacagacuuacaaaaagu

SEQ ID NO: 5758 - RNA, 20 nt, Artificial Sequence
  MKO10005758_A_Atp1b3
  gRNA
aauuaccuggacuaggaauc

SEQ ID NO: 5759 - RNA, 20 nt, Artificial Sequence
  MKO10005759_A_Atp1b3
  gRNA
uacgcuuuaggaaacucucc

SEQ ID NO: 5760 - RNA, 20 nt, Artificial Sequence
  MKO10005760_A_Atp1b4
  gRNA
caugccgaccuucaccgagc

SEQ ID NO: 5761 - RNA, 20 nt, Artificial Sequence
  MKO10005761_A_Atp1b4
  gRNA
cguuacgugauuagccuaaa

SEQ ID NO: 5762 - RNA, 20 nt, Artificial Sequence
  MKO10005762_A_Atp1b4
  gRNA
gaucugcaauuuccgccacc

SEQ ID NO: 5763 - RNA, 20 nt, Artificial Sequence
  MKO10005763_A_Atp2a1
  gRNA
ccucauugccaacgccauug

SEQ ID NO: 5764 - RNA, 20 nt, Artificial Sequence
  MKO10005764_A_Atp2a1
  gRNA
aaggcucgggacaucguucc

SEQ ID NO: 5765 - RNA, 20 nt, Artificial Sequence
  MKO10005765_A_Atp2a1
  gRNA
cugaccgaaagucagugcaa

SEQ ID NO: 5766 - RNA, 20 nt, Artificial Sequence
  MKO10005766_A_Atp2a2
  gRNA
ugcucucguugaccccgaag

SEQ ID NO: 5767 - RNA, 20 nt, Artificial Sequence
  MKO10005767_A_Atp2a2
  gRNA
gaacgcucacacaaagaccg

SEQ ID NO: 5768 - RNA, 20 nt, Artificial Sequence
  MKO10005768_A_Atp2a2
  gRNA
cuagaauugccggcugaaga

SEQ ID NO: 5769 - RNA, 20 nt, Artificial Sequence
  MKO10005769_A_Atp2a3
  gRNA
accgacgcgcgggagcguua

SEQ ID NO: 5770 - RNA, 20 nt, Artificial Sequence
  MKO10005770_A_Atp2a3
  gRNA
uccugcagagcucccgaccg

SEQ ID NO: 5771 - RNA, 20 nt, Artificial Sequence
  MKO10005771_A_Atp2a3
  gRNA
gccguaacgcucccgcgcgu

SEQ ID NO: 5772 - RNA, 20 nt, Artificial Sequence
  MKO10005772_A_Atp2b1
  gRNA
uuacgugcauuauccccuuc

SEQ ID NO: 5773 - RNA, 20 nt, Artificial Sequence
  MKO10005773_A_Atp2b1
  gRNA
aauugcagccauaguaucau

SEQ ID NO: 5774 - RNA, 20 nt, Artificial Sequence
  MKO10005774_A_Atp2b1
  gRNA
ccugcucaauucgacucugc

SEQ ID NO: 5775 - RNA, 20 nt, Artificial Sequence
  MKO10005775_A_Atp2b2
  gRNA
ggacgugacacuuaucaucc

SEQ ID NO: 5776 - RNA, 20 nt, Artificial Sequence
  MKO10005776_A_Atp2b2
  gRNA
agaugauggccgcgaucucc

SEQ ID NO: 5777 - RNA, 20 nt, Artificial Sequence
  MKO10005777_A_Atp2b2
  gRNA
auugaugaaagcucacucac

SEQ ID NO: 5778 - RNA, 20 nt, Artificial Sequence
  MKO10005778_A_Atp2b3
  gRNA
gggagcucucaucgaucuug

SEQ ID NO: 5779 - RNA, 20 nt, Artificial Sequence
  MKO10005779_A_Atp2b3
  gRNA
ucuucaaagccguauugagc

SEQ ID NO: 5780 - RNA, 20 nt, Artificial Sequence
  MKO10005780_A_Atp2b3
  gRNA
gguggcugcuaucgucuccc

SEQ ID NO: 5781 - RNA, 20 nt, Artificial Sequence
  MKO10005781_A_Atp2b4
  gRNA
ucucgccucggugaucauug

SEQ ID NO: 5782 - RNA, 20 nt, Artificial Sequence
  MKO10005782_A_Atp2b4
  gRNA
gcugcagagucgcaucgaac

SEQ ID NO: 5783 - RNA, 20 nt, Artificial Sequence
  MKO10005783_A_Atp2b4
  gRNA
uuuccuguaccccuccguag

SEQ ID NO: 5784 - RNA, 20 nt, Artificial Sequence
  MKO10005784_A_Atp2c1
  gRNA
ugcugaugaccgcagacgcc

SEQ ID NO: 5785 - RNA, 20 nt, Artificial Sequence
  MKO10005785_A_Atp2c1
  gRNA
aauaguaauugucgucacug

SEQ ID NO: 5786 - RNA, 20 nt, Artificial Sequence
  MKO10005786_A_Atp2c1
  gRNA
gcucucuuugacgucaguac

SEQ ID NO: 5787 - RNA, 20 nt, Artificial Sequence
  MKO10005787_A_Atp2c2
  gRNA
accgucgcugcucugccgcc

SEQ ID NO: 5788 - RNA, 20 nt, Artificial Sequence
  MKO10005788_A_Atp2c2
  gRNA
cguccucaccaaagaauaug

SEQ ID NO: 5789 - RNA, 20 nt, Artificial Sequence
  MKO10005789_A_Atp2c2
  gRNA
cagauaacgcugagcccgug

SEQ ID NO: 5790 - RNA, 20 nt, Artificial Sequence
  MKO10005790_A_Atp4a
  gRNA
acauacucgggagugccccg

SEQ ID NO: 5791 - RNA, 20 nt, Artificial Sequence
  MKO10005791_A_Atp4a
  gRNA
ccaaugcgcuccggccaccu

SEQ ID NO: 5792 - RNA, 20 nt, Artificial Sequence
  MKO10005792_A_Atp4a
  gRNA
guaucagaccagcgccacca

SEQ ID NO: 5793 - RNA, 20 nt, Artificial Sequence
  MKO10005793_A_Atp4b
  gRNA
ggaccccagcuucggcuucg

SEQ ID NO: 5794 - RNA, 20 nt, Artificial Sequence
  MKO10005794_A_Atp4b
  gRNA
uggaucagccuguacuacgc

SEQ ID NO: 5795 - RNA, 20 nt, Artificial Sequence
  MKO10005795_A_Atp4b
  gRNA
ccucuuuccccauacacguc

SEQ ID NO: 5796 - RNA, 20 nt, Artificial Sequence
  MKO10005796_A_Atp5a1
  gRNA
uuccaagacccgcagacgag

SEQ ID NO: 5797 - RNA, 20 nt, Artificial Sequence
  MKO10005797_A_Atp5a1
  gRNA
gaugguauugcgcgagugca

SEQ ID NO: 5798 - RNA, 20 nt, Artificial Sequence
  MKO10005798_A_Atp5a1
  gRNA
gcccucgguaaugcuauuga

SEQ ID NO: 5799 - RNA, 20 nt, Artificial Sequence
  MKO10005799_A_Atp5b
  gRNA
cacugccaccgggcgaaucg

SEQ ID NO: 5800 - RNA, 20 nt, Artificial Sequence
  MKO10005800_A_Atp5b
  gRNA
gaugacugccacgauucgcc

SEQ ID NO: 5801 - RNA, 20 nt, Artificial Sequence
  MKO10005801_A_Atp5b
  gRNA
ucugcuggccccauacgcca

SEQ ID NO: 5802 - RNA, 20 nt, Artificial Sequence
  MKO10005802_A_Atp5c1
  gRNA
cugaagccugcccgagugua

SEQ ID NO: 5803 - RNA, 20 nt, Artificial Sequence
  MKO10005803_A_Atp5c1
  gRNA
gggaaagaaguuaugauugu

SEQ ID NO: 5804 - RNA, 20 nt, Artificial Sequence
  MKO10005804_A_Atp5c1
  gRNA
auccagaauuuaacaacuca

SEQ ID NO: 5805 - RNA, 20 nt, Artificial Sequence
  MKO10005805_A_Atp5d
  gRNA
aguucguaccugcgucgggg

SEQ ID NO: 5806 - RNA, 20 nt, Artificial Sequence
  MKO10005806_A_Atp5d
  gRNA
auguacgcgccugaagcauc

SEQ ID NO: 5807 - RNA, 20 nt, Artificial Sequence
  MKO10005807_A_Atp5d
  gRNA
cauuggccucaauacggauc

SEQ ID NO: 5808 - RNA, 20 nt, Artificial Sequence
  MKO10005808_A_Atp5e
  gRNA
cugucgccaguacgccacca

SEQ ID NO: 5809 - RNA, 20 nt, Artificial Sequence
  MKO10005809_A_Atp5e
  gRNA
gagacaccaugguggcguac

SEQ ID NO: 5810 - RNA, 20 nt, Artificial Sequence
  MKO10005810_A_Atp5e
  gRNA
aauugugaaagucucgaaga

SEQ ID NO: 5811 - RNA, 20 nt, Artificial Sequence
  MKO10005811_A_Atp5f1
  gRNA
gcggccgcguucuucagaca

SEQ ID NO: 5812 - RNA, 20 nt, Artificial Sequence
  MKO10005812_A_Atp5f1
  gRNA
cuacccucugcacaucgaag

SEQ ID NO: 5813 - RNA, 20 nt, Artificial Sequence
  MKO10005813_A_Atp5f1
  gRNA
caguuccuuuacccuaagac

SEQ ID NO: 5814 - RNA, 20 nt, Artificial Sequence
  MKO10005814_A_Atp5g1
  gRNA
uacagauucgcuccuguacc

SEQ ID NO: 5815 - RNA, 20 nt, Artificial Sequence
  MKO10005815_A_Atp5g1
  gRNA
gacuuccuuaccugcuuaga

SEQ ID NO: 5816 - RNA, 20 nt, Artificial Sequence
  MKO10005816_A_Atp5g1
  gRNA
acugcucauuucuccagcuc

SEQ ID NO: 5817 - RNA, 20 nt, Artificial Sequence
  MKO10005817_A_Atp5g2
  gRNA
guucgucucuacccgcuccc

SEQ ID NO: 5818 - RNA, 20 nt, Artificial Sequence
  MKO10005818_A_Atp5g2
  gRNA
aagguaccuaccucaucugu

SEQ ID NO: 5819 - RNA, 20 nt, Artificial Sequence
  MKO10005819_A_Atp5g2
  gRNA
gucacagagccucagcagcu

SEQ ID NO: 5820 - RNA, 20 nt, Artificial Sequence
  MKO10005820_A_Atp5g3
  gRNA
gugugugucagcugauccga

SEQ ID NO: 5821 - RNA, 20 nt, Artificial Sequence
  MKO10005821_A_Atp5g3
  gRNA
gcuguucucauaugcuaucc

SEQ ID NO: 5822 - RNA, 20 nt, Artificial Sequence
  MKO10005822_A_Atp5g3
  gRNA
agcaccugcaccaaugaauu

SEQ ID NO: 5823 - RNA, 20 nt, Artificial Sequence
  MKO10005823_A_Atp5h
  gRNA
gauccaggaguaugagaagc

SEQ ID NO: 5824 - RNA, 20 nt, Artificial Sequence
  MKO10005824_A_Atp5h
  gRNA
ucaccugcuucucauacucc

SEQ ID NO: 5825 - RNA, 20 nt, Artificial Sequence
  MKO10005825_A_Atp5h
  gRNA
cuuuguagcuggagaaaaug

SEQ ID NO: 5826 - RNA, 20 nt, Artificial Sequence
  MKO10005826_A_Atp5j2
  gRNA
uagacaccgaccucuccgaa

SEQ ID NO: 5827 - RNA, 20 nt, Artificial Sequence
  MKO10005827_A_Atp5j2
  gRNA
gacuucaagauggcgucacu

SEQ ID NO: 5828 - RNA, 20 nt, Artificial Sequence
  MKO10005828_A_Atp5j2
  gRNA
acaacaaguacaucaacguu

SEQ ID NO: 5829 - RNA, 20 nt, Artificial Sequence
  MKO10005829_A_Atp5j
  gRNA
uccuguacagaaacucuucg

SEQ ID NO: 5830 - RNA, 20 nt, Artificial Sequence
  MKO10005830_A_Atp5j
  gRNA
uccagaucuugcugauacuc

SEQ ID NO: 5831 - RNA, 20 nt, Artificial Sequence
  MKO10005831_A_Atp5j
  gRNA
gcacagagacugcugaccga

SEQ ID NO: 5832 - RNA, 20 nt, Artificial Sequence
  MKO10005832_A_Atp5k
  gRNA
ccccagguuaccuaaaaccc

SEQ ID NO: 5833 - RNA, 20 nt, Artificial Sequence
  MKO10005833_A_Atp5k
  gRNA
cccaaacucacuguagcgcu

SEQ ID NO: 5834 - RNA, 20 nt, Artificial Sequence
  MKO10005834_A_Atp5k
  gRNA
auugagagagaacuggcgga

SEQ ID NO: 5835 - RNA, 20 nt, Artificial Sequence
  MKO10005835_A_Atp5l
  gRNA
cgcucaccggcuaccaucga

SEQ ID NO: 5836 - RNA, 20 nt, Artificial Sequence
  MKO10005836_A_Atp5l
  gRNA
aaggcaccgucgaugguagc

SEQ ID NO: 5837 - RNA, 20 nt, Artificial Sequence
  MKO10005837_A_Atp5l
  gRNA
acguaguuaccuuaacugua

SEQ ID NO: 5838 - RNA, 20 nt, Artificial Sequence
  MKO10005838_A_Atp5o
  gRNA
ucgaugccguagaccugaac

SEQ ID NO: 5839 - RNA, 20 nt, Artificial Sequence
  MKO10005839_A_Atp5o
  gRNA
gccuaaaugacaucacgaaa

SEQ ID NO: 5840 - RNA, 20 nt, Artificial Sequence
  MKO10005840_A_Atp5o
  gRNA
cugacauacccuuacaagcu

SEQ ID NO: 5841 - RNA, 20 nt, Artificial Sequence
  MKO10005841_A_Atp5sl
  gRNA
aaauauggcccguauguugc

SEQ ID NO: 5842 - RNA, 20 nt, Artificial Sequence
  MKO10005842_A_Atp5sl
  gRNA
ggcugaggcaccagucgucc

SEQ ID NO: 5843 - RNA, 20 nt, Artificial Sequence
  MKO10005843_A_Atp5sl
  gRNA
ucugaaucucggcgaggaaa

SEQ ID NO: 5844 - RNA, 20 nt, Artificial Sequence
  MKO10005844_A_Atp5s
  gRNA
ggagccaaaguacgcuacug

SEQ ID NO: 5845 - RNA, 20 nt, Artificial Sequence
  MKO10005845_A_Atp5s
  gRNA
ugccaccgauucuuguauca

SEQ ID NO: 5846 - RNA, 20 nt, Artificial Sequence
  MKO10005846_A_Atp5s
  gRNA
ucauugcucugcgacauuuc

SEQ ID NO: 5847 - RNA, 20 nt, Artificial Sequence
  MKO10005847_A_Atp6ap1l
  gRNA
cuaccguaugucaauauccu

SEQ ID NO: 5848 - RNA, 20 nt, Artificial Sequence
  MKO10005848_A_Atp6ap1l
  gRNA
ccguacaaccacuucuuuac

SEQ ID NO: 5849 - RNA, 20 nt, Artificial Sequence
  MKO10005849_A_Atp6ap1l
  gRNA
gugauggcugaacguacucc

SEQ ID NO: 5850 - RNA, 20 nt, Artificial Sequence
  MKO10005850_A_Atp6ap1
  gRNA
acagcauacggugguguguu

SEQ ID NO: 5851 - RNA, 20 nt, Artificial Sequence
  MKO10005851_A_Atp6ap1
  gRNA
gguagaaagcugcauaucgc

SEQ ID NO: 5852 - RNA, 20 nt, Artificial Sequence
  MKO10005852_A_Atp6ap1
  gRNA
cacacucaccguuaccugug

SEQ ID NO: 5853 - RNA, 20 nt, Artificial Sequence
  MKO10005853_A_Atp6ap2
  gRNA
acgucugggauucgaucucc

SEQ ID NO: 5854 - RNA, 20 nt, Artificial Sequence
  MKO10005854_A_Atp6ap2
  gRNA
uagcccguggccgguggaau

SEQ ID NO: 5855 - RNA, 20 nt, Artificial Sequence
  MKO10005855_A_Atp6ap2
  gRNA
uuuagcauauuaagaucgcc

SEQ ID NO: 5856 - RNA, 20 nt, Artificial Sequence
  MKO10005856_A_Atp6v0a1
  gRNA
ucuaagucgaucaugucccg

SEQ ID NO: 5857 - RNA, 20 nt, Artificial Sequence
  MKO10005857_A_Atp6v0a1
  gRNA
agcuugggaagguccaauuu

SEQ ID NO: 5858 - RNA, 20 nt, Artificial Sequence
  MKO10005858_A_Atp6v0a1
  gRNA
uuucacuuacaucccgaaau

SEQ ID NO: 5859 - RNA, 20 nt, Artificial Sequence
  MKO10005859_A_Atp6v0a2
  gRNA
ugaagagcucgaacgaauac

SEQ ID NO: 5860 - RNA, 20 nt, Artificial Sequence
  MKO10005860_A_Atp6v0a2
  gRNA
caacagagagucguucucua

SEQ ID NO: 5861 - RNA, 20 nt, Artificial Sequence
  MKO10005861_A_Atp6v0a2
  gRNA
cuacagcugcaugcagcggc

SEQ ID NO: 5862 - RNA, 20 nt, Artificial Sequence
  MKO10005862_A_Atp6v0a4
  gRNA
uccagggugaucauuucccg

SEQ ID NO: 5863 - RNA, 20 nt, Artificial Sequence
  MKO10005863_A_Atp6v0a4
  gRNA
aguuugugaaugaaguccga

SEQ ID NO: 5864 - RNA, 20 nt, Artificial Sequence
  MKO10005864_A_Atp6v0a4
  gRNA
gcagacgacucuagagaagu

SEQ ID NO: 5865 - RNA, 20 nt, Artificial Sequence
  MKO10005865_A_Atp6v0b
  gRNA
cggaaacuucccccuucaug

SEQ ID NO: 5866 - RNA, 20 nt, Artificial Sequence
  MKO10005866_A_Atp6v0b
  gRNA
gcccagauucgaccacauga

SEQ ID NO: 5867 - RNA, 20 nt, Artificial Sequence
  MKO10005867_A_Atp6v0b
  gRNA
accaggggaaucuauauaac

SEQ ID NO: 5868 - RNA, 20 nt, Artificial Sequence
  MKO10005868_A_Atp6v0c
  gRNA
augcucaccgcugaagacca

SEQ ID NO: 5869 - RNA, 20 nt, Artificial Sequence
  MKO10005869_A_Atp6v0c
  gRNA
ugcgaugccagugccacucu

SEQ ID NO: 5870 - RNA, 20 nt, Artificial Sequence
  MKO10005870_A_Atp6v0c
  gRNA
acagccaugggagccgccua

SEQ ID NO: 5871 - RNA, 20 nt, Artificial Sequence
  MKO10005871_A_Atp6v0d1
  gRNA
uggcgagcggcucauaagca

SEQ ID NO: 5872 - RNA, 20 nt, Artificial Sequence
  MKO10005872_A_Atp6v0d1
  gRNA
ucgaugacugacaccgucag

SEQ ID NO: 5873 - RNA, 20 nt, Artificial Sequence
  MKO10005873_A_Atp6v0d1
  gRNA
caaguucagcuauugaacgc

SEQ ID NO: 5874 - RNA, 20 nt, Artificial Sequence
  MKO10005874_A_Atp6v0d2
  gRNA
cguuaugugucccauucuug

SEQ ID NO: 5875 - RNA, 20 nt, Artificial Sequence
  MKO10005875_A_Atp6v0d2
  gRNA
gugcugguugaaacaccauu

SEQ ID NO: 5876 - RNA, 20 nt, Artificial Sequence
  MKO10005876_A_Atp6v0d2
  gRNA
ccucaucuccgugucaauuu

SEQ ID NO: 5877 - RNA, 20 nt, Artificial Sequence
  MKO10005877_A_Atp6v0e2
  gRNA
uuacccgcgguuggguccuu

SEQ ID NO: 5878 - RNA, 20 nt, Artificial Sequence
  MKO10005878_A_Atp6v0e2
  gRNA
agggcccagcgaugccgaug

SEQ ID NO: 5879 - RNA, 20 nt, Artificial Sequence
  MKO10005879_A_Atp6v0e2
  gRNA
cccaacugaacccccuguuu

SEQ ID NO: 5880 - RNA, 20 nt, Artificial Sequence
  MKO10005880_A_Atp6v0e
  gRNA
aacacgcucaucacgaucaa

SEQ ID NO: 5881 - RNA, 20 nt, Artificial Sequence
  MKO10005881_A_Atp6v0e
  gRNA
uuacccccgguuaggacccu

SEQ ID NO: 5882 - RNA, 20 nt, Artificial Sequence
  MKO10005882_A_Atp6v0e
  gRNA
uaguuggcugauugcaauuc

SEQ ID NO: 5883 - RNA, 20 nt, Artificial Sequence
  MKO10005883_A_Atp6v1a
  gRNA
gugacuuacaucgcgccgcc

SEQ ID NO: 5884 - RNA, 20 nt, Artificial Sequence
  MKO10005884_A_Atp6v1a
  gRNA
ccgcacugguaaaccucucu

SEQ ID NO: 5885 - RNA, 20 nt, Artificial Sequence
  MKO10005885_A_Atp6v1a
  gRNA
ggacccagcucgaccgagag

SEQ ID NO: 5886 - RNA, 20 nt, Artificial Sequence
  MKO10005886_A_Atp6v1b1
  gRNA
gucaacuuuacccucccuga

SEQ ID NO: 5887 - RNA, 20 nt, Artificial Sequence
  MKO10005887_A_Atp6v1b1
  gRNA
cuaacucacagguguuugaa

SEQ ID NO: 5888 - RNA, 20 nt, Artificial Sequence
  MKO10005888_A_Atp6v1b1
  gRNA
aggacagugugcagcgucaa

SEQ ID NO: 5889 - RNA, 20 nt, Artificial Sequence
  MKO10005889_A_Atp6v1b2
  gRNA
ucaggaaaacccauugaccg

SEQ ID NO: 5890 - RNA, 20 nt, Artificial Sequence
  MKO10005890_A_Atp6v1b2
  gRNA
guggacaaucucagcguauc

SEQ ID NO: 5891 - RNA, 20 nt, Artificial Sequence
  MKO10005891_A_Atp6v1b2
  gRNA
ccguuaccuucacaugaucu

SEQ ID NO: 5892 - RNA, 20 nt, Artificial Sequence
  MKO10005892_A_Atp6v1c1
  gRNA
ucgauaaugaccuaaagucu

SEQ ID NO: 5893 - RNA, 20 nt, Artificial Sequence
  MKO10005893_A_Atp6v1c1
  gRNA
ucccuuguagguuggcacgu

SEQ ID NO: 5894 - RNA, 20 nt, Artificial Sequence
  MKO10005894_A_Atp6v1c1
  gRNA
gguuggcuugucggaugaac

SEQ ID NO: 5895 - RNA, 20 nt, Artificial Sequence
  MKO10005895_A_Atp6v1c2
  gRNA
uauuucggccccuggcgaua

SEQ ID NO: 5896 - RNA, 20 nt, Artificial Sequence
  MKO10005896_A_Atp6v1c2
  gRNA
uggaccuaccuccguuagcc

SEQ ID NO: 5897 - RNA, 20 nt, Artificial Sequence
  MKO10005897_A_Atp6v1c2
  gRNA
auaucccgccaagcagccac

SEQ ID NO: 5898 - RNA, 20 nt, Artificial Sequence
  MKO10005898_A_Atp6v1d
  gRNA
guguuugaacauuaccacga

SEQ ID NO: 5899 - RNA, 20 nt, Artificial Sequence
  MKO10005899_A_Atp6v1d
  gRNA
cugucgaaaucgaagaguua

SEQ ID NO: 5900 - RNA, 20 nt, Artificial Sequence
  MKO10005900_A_Atp6v1d
  gRNA
acuuacugucaguuccuucg

SEQ ID NO: 5901 - RNA, 20 nt, Artificial Sequence
  MKO10005901_A_Atp6v1e1
  gRNA
gacccguuaccaagugcugc

SEQ ID NO: 5902 - RNA, 20 nt, Artificial Sequence
  MKO10005902_A_Atp6v1e1
  gRNA
ccuugcuugauucaucaagu

SEQ ID NO: 5903 - RNA, 20 nt, Artificial Sequence
  MKO10005903_A_Atp6v1e1
  gRNA
ccaacuugaugaaucaagca

SEQ ID NO: 5904 - RNA, 20 nt, Artificial Sequence
  MKO10005904_A_Atp6v1e2
  gRNA
aauccaugaucuucagccgc

SEQ ID NO: 5905 - RNA, 20 nt, Artificial Sequence
  MKO10005905_A_Atp6v1e2
  gRNA
ggagcacgagcuuauccagc

SEQ ID NO: 5906 - RNA, 20 nt, Artificial Sequence
  MKO10005906_A_Atp6v1e2
  gRNA
cgagauucagccgacuuucc

SEQ ID NO: 5907 - RNA, 20 nt, Artificial Sequence
  MKO10005907_A_Atp6v1f
  gRNA
aaucgcggugauuggagacg

SEQ ID NO: 5908 - RNA, 20 nt, Artificial Sequence
  MKO10005908_A_Atp6v1f
  gRNA
ggagucuuuggcugcaucgu

SEQ ID NO: 5909 - RNA, 20 nt, Artificial Sequence
  MKO10005909_A_Atp6v1f
  gRNA
gcggacaggauggcgggcag

SEQ ID NO: 5910 - RNA, 20 nt, Artificial Sequence
  MKO10005910_A_Atp6v1g1
  gRNA
gagcucacgcuugcgggccu

SEQ ID NO: 5911 - RNA, 20 nt, Artificial Sequence
  MKO10005911_A_Atp6v1g1
  gRNA
uugaaacaggaaagaaccgg

SEQ ID NO: 5912 - RNA, 20 nt, Artificial Sequence
  MKO10005912_A_Atp6v1g1
  gRNA
gaggcccaccgcagcuuccu

SEQ ID NO: 5913 - RNA, 20 nt, Artificial Sequence
  MKO10005913_A_Atp6v1g2
  gRNA
cuagacaguaacccgauagu

SEQ ID NO: 5914 - RNA, 20 nt, Artificial Sequence
  MKO10005914_A_Atp6v1g2
  gRNA
cgcgcucccgauuccucugc

SEQ ID NO: 5915 - RNA, 20 nt, Artificial Sequence
  MKO10005915_A_Atp6v1g2
  gRNA
ccuucgccugcuucagucgc

SEQ ID NO: 5916 - RNA, 20 nt, Artificial Sequence
  MKO10005916_A_Atp6v1g3
  gRNA
gcucuucuauuucauccgag

SEQ ID NO: 5917 - RNA, 20 nt, Artificial Sequence
  MKO10005917_A_Atp6v1g3
  gRNA
gaaggacuuccgccugaagc

SEQ ID NO: 5918 - RNA, 20 nt, Artificial Sequence
  MKO10005918_A_Atp6v1g3
  gRNA
gauuaagcagcuauugagca

SEQ ID NO: 5919 - RNA, 20 nt, Artificial Sequence
  MKO10005919_A_Atp6v1h
  gRNA
ccugccaauguugaaucgcc

SEQ ID NO: 5920 - RNA, 20 nt, Artificial Sequence
  MKO10005920_A_Atp6v1h
  gRNA
uuaucgccaaguuagcugcu

SEQ ID NO: 5921 - RNA, 20 nt, Artificial Sequence
  MKO10005921_A_Atp6v1h
  gRNA
ccuggcgauucaacauuggc

SEQ ID NO: 5922 - RNA, 20 nt, Artificial Sequence
  MKO10005922_A_Atp7a
  gRNA
aacacgguauugguuaagac

SEQ ID NO: 5923 - RNA, 20 nt, Artificial Sequence
  MKO10005923_A_Atp7a
  gRNA
caagguguucagcgcauuaa

SEQ ID NO: 5924 - RNA, 20 nt, Artificial Sequence
  MKO10005924_A_Atp7a
  gRNA
gcagccgaaguaccucaaau

SEQ ID NO: 5925 - RNA, 20 nt, Artificial Sequence
  MKO10005925_A_Atp7b
  gRNA
uucguagccaacauugucga

SEQ ID NO: 5926 - RNA, 20 nt, Artificial Sequence
  MKO10005926_A_Atp7b
  gRNA
ucauucaacccgaagaccuc

SEQ ID NO: 5927 - RNA, 20 nt, Artificial Sequence
  MKO10005927_A_Atp7b
  gRNA
ugacugacgcuucgaagccc

SEQ ID NO: 5928 - RNA, 20 nt, Artificial Sequence
  MKO10005928_A_Atp8a1
  gRNA
acucaccuuccgcgcgcgag

SEQ ID NO: 5929 - RNA, 20 nt, Artificial Sequence
  MKO10005929_A_Atp8a1
  gRNA
gucggagauccgcucgcgcg

SEQ ID NO: 5930 - RNA, 20 nt, Artificial Sequence
  MKO10005930_A_Atp8a1
  gRNA
aaccaguguuguguaacgac

SEQ ID NO: 5931 - RNA, 20 nt, Artificial Sequence
  MKO10005931_A_Atp8a2
  gRNA
agggugguguaccguccugu

SEQ ID NO: 5932 - RNA, 20 nt, Artificial Sequence
  MKO10005932_A_Atp8a2
  gRNA
aucccagacgucucaccaac

SEQ ID NO: 5933 - RNA, 20 nt, Artificial Sequence
  MKO10005933_A_Atp8a2
  gRNA
aaaugucaacacgcuguacu

SEQ ID NO: 5934 - RNA, 20 nt, Artificial Sequence
  MKO10005934_A_Atp8b1
  gRNA
ggcaaauuaccugcaggauc

SEQ ID NO: 5935 - RNA, 20 nt, Artificial Sequence
  MKO10005935_A_Atp8b1
  gRNA
uccaaaggcucgucauaaaa

SEQ ID NO: 5936 - RNA, 20 nt, Artificial Sequence
  MKO10005936_A_Atp8b1
  gRNA
uaggacgugugaagucauua

SEQ ID NO: 5937 - RNA, 20 nt, Artificial Sequence
  MKO10005937_A_Atp8b2
  gRNA
ccgccacaagagugauaacc

SEQ ID NO: 5938 - RNA, 20 nt, Artificial Sequence
  MKO10005938_A_Atp8b2
  gRNA
acaacucacauagucaucgg

SEQ ID NO: 5939 - RNA, 20 nt, Artificial Sequence
  MKO10005939_A_Atp8b2
  gRNA
ucaccugguuaucacucuug

SEQ ID NO: 5940 - RNA, 20 nt, Artificial Sequence
  MKO10005940_A_Atp8b3
  gRNA
ucuccccgcagaguucaccu

SEQ ID NO: 5941 - RNA, 20 nt, Artificial Sequence
  MKO10005941_A_Atp8b3
  gRNA
uguugguccagggucgacac

SEQ ID NO: 5942 - RNA, 20 nt, Artificial Sequence
  MKO10005942_A_Atp8b3
  gRNA
aguagagauuggacauucga

SEQ ID NO: 5943 - RNA, 20 nt, Artificial Sequence
  MKO10005943_A_Atp8b4
  gRNA
cagccgucaucgagaucacc

SEQ ID NO: 5944 - RNA, 20 nt, Artificial Sequence
  MKO10005944_A_Atp8b4
  gRNA
aauacucacauagucgucgg

SEQ ID NO: 5945 - RNA, 20 nt, Artificial Sequence
  MKO10005945_A_Atp8b4
  gRNA
aaaugugagaacguuguacu

SEQ ID NO: 5946 - RNA, 20 nt, Artificial Sequence
  MKO10005946_A_Atp8b5
  gRNA
gaaagacgccaucgaugacg

SEQ ID NO: 5947 - RNA, 20 nt, Artificial Sequence
  MKO10005947_A_Atp8b5
  gRNA
gaccgugauaccccugauug

SEQ ID NO: 5948 - RNA, 20 nt, Artificial Sequence
  MKO10005948_A_Atp8b5
  gRNA
agaguugaaccuucuauugu

SEQ ID NO: 5949 - RNA, 20 nt, Artificial Sequence
  MKO10005949_A_Atp9a
  gRNA
gcucaccucgugacgugagc

SEQ ID NO: 5950 - RNA, 20 nt, Artificial Sequence
  MKO10005950_A_Atp9a
  gRNA
ccuugucacgcacauaacau

SEQ ID NO: 5951 - RNA, 20 nt, Artificial Sequence
  MKO10005951_A_Atp9a
  gRNA
cgcaguucgucccagagaug

SEQ ID NO: 5952 - RNA, 20 nt, Artificial Sequence
  MKO10005952_A_Atp9b
  gRNA
cgcuucacgugcaaucguaa

SEQ ID NO: 5953 - RNA, 20 nt, Artificial Sequence
  MKO10005953_A_Atp9b
  gRNA
agcuaaaagcucgaacagua

SEQ ID NO: 5954 - RNA, 20 nt, Artificial Sequence
  MKO10005954_A_Atp9b
  gRNA
accacacauuaccucgagcu

SEQ ID NO: 5955 - RNA, 20 nt, Artificial Sequence
  MKO10005955_A_Atpaf1
  gRNA
aacugcggaggaaauaaaac

SEQ ID NO: 5956 - RNA, 20 nt, Artificial Sequence
  MKO10005956_A_Atpaf1
  gRNA
uguauuucagacagaugccu

SEQ ID NO: 5957 - RNA, 20 nt, Artificial Sequence
  MKO10005957_A_Atpaf1
  gRNA
cuugauaaaaucacuuuguu

SEQ ID NO: 5958 - RNA, 20 nt, Artificial Sequence
  MKO10005958_A_Atpaf2
  gRNA
ugcgauggccagggcuucgc

SEQ ID NO: 5959 - RNA, 20 nt, Artificial Sequence
  MKO10005959_A_Atpaf2
  gRNA
aaugggaucccgucauagag

SEQ ID NO: 5960 - RNA, 20 nt, Artificial Sequence
  MKO10005960_A_Atpaf2
  gRNA
ucagcuggucuuuacuucgc

SEQ ID NO: 5961 - RNA, 20 nt, Artificial Sequence
  MKO10005961_A_Atpif1
  gRNA
cugaagaggaucgguacuuc

SEQ ID NO: 5962 - RNA, 20 nt, Artificial Sequence
  MKO10005962_A_Atpif1
  gRNA
uuggcaguucgggcucgguu

SEQ ID NO: 5963 - RNA, 20 nt, Artificial Sequence
  MKO10005963_A_Atpif1
  gRNA
cucuuugcagucggauagca

SEQ ID NO: 5964 - RNA, 20 nt, Artificial Sequence
  MKO10005964_A_Atraid
  gRNA
ugugcauaccucccggacac

SEQ ID NO: 5965 - RNA, 20 nt, Artificial Sequence
  MKO10005965_A_Atraid
  gRNA
ggauacaucgaagcuaaugc

SEQ ID NO: 5966 - RNA, 20 nt, Artificial Sequence
  MKO10005966_A_Atraid
  gRNA
gauuuggccaacaccuuccg

SEQ ID NO: 5967 - RNA, 20 nt, Artificial Sequence
  MKO10005967_A_Atrip
  gRNA
gguuaccaaauaguccuaua

SEQ ID NO: 5968 - RNA, 20 nt, Artificial Sequence
  MKO10005968_A_Atrip
  gRNA
uauuugguaacccaucuaau

SEQ ID NO: 5969 - RNA, 20 nt, Artificial Sequence
  MKO10005969_A_Atrip
  gRNA
uccuuaccugacgugggaga

SEQ ID NO: 5970 - RNA, 20 nt, Artificial Sequence
  MKO10005970_A_Atrnl1
  gRNA
ccagacgucgugaccaccuc

SEQ ID NO: 5971 - RNA, 20 nt, Artificial Sequence
  MKO10005971_A_Atrnl1
  gRNA
ucugugucugcaacgauagu

SEQ ID NO: 5972 - RNA, 20 nt, Artificial Sequence
  MKO10005972_A_Atrnl1
  gRNA
gucucguuaccccucacuuc

SEQ ID NO: 5973 - RNA, 20 nt, Artificial Sequence
  MKO10005973_A_Atrn
  gRNA
uguaaugcaagcgauaccag

SEQ ID NO: 5974 - RNA, 20 nt, Artificial Sequence
  MKO10005974_A_Atrn
  gRNA
cgaagucucauuauucuauu

SEQ ID NO: 5975 - RNA, 20 nt, Artificial Sequence
  MKO10005975_A_Atrn
  gRNA
auguguccgaauaauugcuc

SEQ ID NO: 5976 - RNA, 20 nt, Artificial Sequence
  MKO10005976_A_Atrx
  gRNA
cuuugguucaugacaagucg

SEQ ID NO: 5977 - RNA, 20 nt, Artificial Sequence
  MKO10005977_A_Atrx
  gRNA
uucauuuacauucucauccg

SEQ ID NO: 5978 - RNA, 20 nt, Artificial Sequence
  MKO10005978_A_Atrx
  gRNA
uggaaacaaguugaguacau

SEQ ID NO: 5979 - RNA, 20 nt, Artificial Sequence
  MKO10005979_A_Atr
  gRNA
uugaagaucgcgugcuuaug

SEQ ID NO: 5980 - RNA, 20 nt, Artificial Sequence
  MKO10005980_A_Atr
  gRNA
aaagccgauucauacccagc

SEQ ID NO: 5981 - RNA, 20 nt, Artificial Sequence
  MKO10005981_A_Atr
  gRNA
gaggccaaagacaguuguau

SEQ ID NO: 5982 - RNA, 20 nt, Artificial Sequence
  MKO10005982_A_Atxn10
  gRNA
cgcaggaaccuggauacgau

SEQ ID NO: 5983 - RNA, 20 nt, Artificial Sequence
  MKO10005983_A_Atxn10
  gRNA
acucucuggaagaucguucu

SEQ ID NO: 5984 - RNA, 20 nt, Artificial Sequence
  MKO10005984_A_Atxn10
  gRNA
acucacggccacucugacgc

SEQ ID NO: 5985 - RNA, 20 nt, Artificial Sequence
  MKO10005985_A_Atxn1l
  gRNA
cuaaagcgccaacuacccgc

SEQ ID NO: 5986 - RNA, 20 nt, Artificial Sequence
  MKO10005986_A_Atxn1l
  gRNA
ucacucgaauacucaaccac

SEQ ID NO: 5987 - RNA, 20 nt, Artificial Sequence
  MKO10005987_A_Atxn1l
  gRNA
uggcggcgccagcacaucga

SEQ ID NO: 5988 - RNA, 20 nt, Artificial Sequence
  MKO10005988_A_Atxn1
  gRNA
caucgaaggccgaucuaacg

SEQ ID NO: 5989 - RNA, 20 nt, Artificial Sequence
  MKO10005989_A_Atxn1
  gRNA
ggcgccggagacccguaaac

SEQ ID NO: 5990 - RNA, 20 nt, Artificial Sequence
  MKO10005990_A_Atxn1
  gRNA
ugggggagaugucgcccgcc

SEQ ID NO: 5991 - RNA, 20 nt, Artificial Sequence
  MKO10005991_A_Atxn2l
  gRNA
ggguucuacuugugacguaa

SEQ ID NO: 5992 - RNA, 20 nt, Artificial Sequence
  MKO10005992_A_Atxn2l
  gRNA
uggacaagcagaacgucgcu

SEQ ID NO: 5993 - RNA, 20 nt, Artificial Sequence
  MKO10005993_A_Atxn2l
  gRNA
gccucgccgggaagacauug

SEQ ID NO: 5994 - RNA, 20 nt, Artificial Sequence
  MKO10005994_A_Atxn2
  gRNA
aaguuacucaccguaggcug

SEQ ID NO: 5995 - RNA, 20 nt, Artificial Sequence
  MKO10005995_A_Atxn2
  gRNA
ccuaccucuccgugcauaac

SEQ ID NO: 5996 - RNA, 20 nt, Artificial Sequence
  MKO10005996_A_Atxn2
  gRNA
caaaugcucagacuucguug

SEQ ID NO: 5997 - RNA, 20 nt, Artificial Sequence
  MKO10005997_A_Atxn3
  gRNA
gcaauugaggauagcuccac

SEQ ID NO: 5998 - RNA, 20 nt, Artificial Sequence
  MKO10005998_A_Atxn3
  gRNA
ucaacaguccagaguaccag

SEQ ID NO: 5999 - RNA, 20 nt, Artificial Sequence
  MKO10005999_A_Atxn3
  gRNA
ugccugaauaaccuauugca

SEQ ID NO: 6000 - RNA, 20 nt, Artificial Sequence
  MKO10006000_A_Atxn7l1
  gRNA
gggcuugacgaccugauugc

SEQ ID NO: 6001 - RNA, 20 nt, Artificial Sequence
  MKO10006001_A_Atxn7l1
  gRNA
cgugugcagugccugcaauc

SEQ ID NO: 6002 - RNA, 20 nt, Artificial Sequence
  MKO10006002_A_Atxn7l1
  gRNA
ccaagcccuagaacagcguc

SEQ ID NO: 6003 - RNA, 20 nt, Artificial Sequence
  MKO10006003_A_Atxn7l2
  gRNA
ggcuccagucaccgcgccga

SEQ ID NO: 6004 - RNA, 20 nt, Artificial Sequence
  MKO10006004_A_Atxn7l2
  gRNA
ugaccccgcacugccuguug

SEQ ID NO: 6005 - RNA, 20 nt, Artificial Sequence
  MKO10006005_A_Atxn7l2
  gRNA
cccgggcauaaagcuugcug

SEQ ID NO: 6006 - RNA, 20 nt, Artificial Sequence
  MKO10006006_A_Atxn7l3b
  gRNA
gugaacgcugcagcuccguc

SEQ ID NO: 6007 - RNA, 20 nt, Artificial Sequence
  MKO10006007_A_Atxn7l3b
  gRNA
gaucuauguagaccugauag

SEQ ID NO: 6008 - RNA, 20 nt, Artificial Sequence
  MKO10006008_A_Atxn7l3b
  gRNA
ucccggggacgggccccaga

SEQ ID NO: 6009 - RNA, 20 nt, Artificial Sequence
  MKO10006009_A_Atxn7l3
  gRNA
cucaccgacgguuggcgauu

SEQ ID NO: 6010 - RNA, 20 nt, Artificial Sequence
  MKO10006010_A_Atxn7l3
  gRNA
gcagccgaaucgccaaccgu

SEQ ID NO: 6011 - RNA, 20 nt, Artificial Sequence
  MKO10006011_A_Atxn7l3
  gRNA
ccaaacaagaauccucgacc

SEQ ID NO: 6012 - RNA, 20 nt, Artificial Sequence
  MKO10006012_A_Atxn7
  gRNA
gccauacuuacacucguccg

SEQ ID NO: 6013 - RNA, 20 nt, Artificial Sequence
  MKO10006013_A_Atxn7
  gRNA
auaucuccuagggaccgaau

SEQ ID NO: 6014 - RNA, 20 nt, Artificial Sequence
  MKO10006014_A_Atxn7
  gRNA
guugcagauaugccgaucuu

SEQ ID NO: 6015 - RNA, 20 nt, Artificial Sequence
  MKO10006015_A_Auh
  gRNA
aaggccgucuauggcugcga

SEQ ID NO: 6016 - RNA, 20 nt, Artificial Sequence
  MKO10006016_A_Auh
  gRNA
gcgugugacauucgaguagc

SEQ ID NO: 6017 - RNA, 20 nt, Artificial Sequence
  MKO10006017_A_Auh
  gRNA
caaugucauugaucaccgau

SEQ ID NO: 6018 - RNA, 20 nt, Artificial Sequence
  MKO10006018_A_Aup1
  gRNA
cgcgcuacugcucuacgcgc

SEQ ID NO: 6019 - RNA, 20 nt, Artificial Sequence
  MKO10006019_A_Aup1
  gRNA
gacuccgcgaucaccgcguc

SEQ ID NO: 6020 - RNA, 20 nt, Artificial Sequence
  MKO10006020_A_Aup1
  gRNA
ugcccgacagcguccuccgc

SEQ ID NO: 6021 - RNA, 20 nt, Artificial Sequence
  MKO10006021_A_Aurkaip1
  gRNA
gacccgguuucuacgucgca

SEQ ID NO: 6022 - RNA, 20 nt, Artificial Sequence
  MKO10006022_A_Aurkaip1
  gRNA
ccaccacaaguaccguaaac

SEQ ID NO: 6023 - RNA, 20 nt, Artificial Sequence
  MKO10006023_A_Aurkaip1
  gRNA
gccgugaagucaggcgcgcc

SEQ ID NO: 6024 - RNA, 20 nt, Artificial Sequence
  MKO10006024_A_Aurka
  gRNA
ucagucaccaagacgcguuu

SEQ ID NO: 6025 - RNA, 20 nt, Artificial Sequence
  MKO10006025_A_Aurka
  gRNA
ccacucaccgcaggugcgac

SEQ ID NO: 6026 - RNA, 20 nt, Artificial Sequence
  MKO10006026_A_Aurka
  gRNA
gaccacuuaccggaggcugc

SEQ ID NO: 6027 - RNA, 20 nt, Artificial Sequence
  MKO10006027_A_Aurkb
  gRNA
uccuuguagaguuccccgcg

SEQ ID NO: 6028 - RNA, 20 nt, Artificial Sequence
  MKO10006028_A_Aurkb
  gRNA
uuucgaucucucggcgaagc

SEQ ID NO: 6029 - RNA, 20 nt, Artificial Sequence
  MKO10006029_A_Aurkb
  gRNA
cgaugagcagcggacugcca

SEQ ID NO: 6030 - RNA, 20 nt, Artificial Sequence
  MKO10006030_A_Aurkc
  gRNA
ucaccguggcuguacgcugc

SEQ ID NO: 6031 - RNA, 20 nt, Artificial Sequence
  MKO10006031_A_Aurkc
  gRNA
cacucaccugguugaggugc

SEQ ID NO: 6032 - RNA, 20 nt, Artificial Sequence
  MKO10006032_A_Aurkc
  gRNA
uuccuuagcuacuggccaga

SEQ ID NO: 6033 - RNA, 20 nt, Artificial Sequence
  MKO10006033_A_Auus2
  gRNA
agugacagcgaaagcgcuag

SEQ ID NO: 6034 - RNA, 20 nt, Artificial Sequence
  MKO10006034_A_Auus2
  gRNA
cguuucuccgcacguuccug

SEQ ID NO: 6035 - RNA, 20 nt, Artificial Sequence
  MKO10006035_A_Auus2
  gRNA
agauguagcaguuaagccgc

SEQ ID NO: 6036 - RNA, 20 nt, Artificial Sequence
  MKO10006036_A_Aven
  gRNA
cacaucgaagaaugucaccg

SEQ ID NO: 6037 - RNA, 20 nt, Artificial Sequence
  MKO10006037_A_Aven
  gRNA
cuagaauucagcacucuacg

SEQ ID NO: 6038 - RNA, 20 nt, Artificial Sequence
  MKO10006038_A_Aven
  gRNA
uggucccgagaugucugguc

SEQ ID NO: 6039 - RNA, 20 nt, Artificial Sequence
  MKO10006039_A_Avil
  gRNA
cacgaguccgacaccuuccg

SEQ ID NO: 6040 - RNA, 20 nt, Artificial Sequence
  MKO10006040_A_Avil
  gRNA
aggugucggacucgugguac

SEQ ID NO: 6041 - RNA, 20 nt, Artificial Sequence
  MKO10006041_A_Avil
  gRNA
ugagacucaccuccguggcu

SEQ ID NO: 6042 - RNA, 20 nt, Artificial Sequence
  MKO10006042_A_Avl9
  gRNA
ugauaguuaugugcaccauc

SEQ ID NO: 6043 - RNA, 20 nt, Artificial Sequence
  MKO10006043_A_Avl9
  gRNA
ggcaaguacuuccauucuuc

SEQ ID NO: 6044 - RNA, 20 nt, Artificial Sequence
  MKO10006044_A_Avl9
  gRNA
uuaucgacaaauugaagcca

SEQ ID NO: 6045 - RNA, 20 nt, Artificial Sequence
  MKO10006045_A_Avpi1
  gRNA
aagagcgggcccagauaauc

SEQ ID NO: 6046 - RNA, 20 nt, Artificial Sequence
  MKO10006046_A_Avpi1
  gRNA
ucgugagcgagccaccccug

SEQ ID NO: 6047 - RNA, 20 nt, Artificial Sequence
  MKO10006047_A_Avpi1
  gRNA
uucuacagcgucugaccccc

SEQ ID NO: 6048 - RNA, 20 nt, Artificial Sequence
  MKO10006048_A_Avpr1a
  gRNA
cauaccgguccaaacgaaau

SEQ ID NO: 6049 - RNA, 20 nt, Artificial Sequence
  MKO10006049_A_Avpr1a
  gRNA
ggguaccacgaagaccccgc

SEQ ID NO: 6050 - RNA, 20 nt, Artificial Sequence
  MKO10006050_A_Avpr1a
  gRNA
agccaguaacgccgugaucg

SEQ ID NO: 6051 - RNA, 20 nt, Artificial Sequence
  MKO10006051_A_Avpr1b
  gRNA
ggacaucaccuaucgcuucc

SEQ ID NO: 6052 - RNA, 20 nt, Artificial Sequence
  MKO10006052_A_Avpr1b
  gRNA
caugacgcuggaccgguacc

SEQ ID NO: 6053 - RNA, 20 nt, Artificial Sequence
  MKO10006053_A_Avpr1b
  gRNA
aaauccuucagcgagcccgc

SEQ ID NO: 6054 - RNA, 20 nt, Artificial Sequence
  MKO10006054_A_Avpr2
  gRNA
cuaauacgacggggucggcg

SEQ ID NO: 6055 - RNA, 20 nt, Artificial Sequence
  MKO10006055_A_Avpr2
  gRNA
cacgccgaccccgucguauu

SEQ ID NO: 6056 - RNA, 20 nt, Artificial Sequence
  MKO10006056_A_Avpr2
  gRNA
uaccagacgugguagacacc

SEQ ID NO: 6057 - RNA, 20 nt, Artificial Sequence
  MKO10006057_A_Avp
  gRNA
ugaggcggaaaaaaccgucg

SEQ ID NO: 6058 - RNA, 20 nt, Artificial Sequence
  MKO10006058_A_Avp
  gRNA
agugcccaccuaugcucgcc

SEQ ID NO: 6059 - RNA, 20 nt, Artificial Sequence
  MKO10006059_A_Avp
  gRNA
cuuagcagcagcgcccgagc

SEQ ID NO: 6060 - RNA, 20 nt, Artificial Sequence
  MKO10006060_A_Awau1
  gRNA
aaaccucgugggcauugucg

SEQ ID NO: 6061 - RNA, 20 nt, Artificial Sequence
  MKO10006061_A_Awau1
  gRNA
gggccaccuacccauguugg

SEQ ID NO: 6062 - RNA, 20 nt, Artificial Sequence
  MKO10006062_A_Awau1
  gRNA
cagguggcaggcguucagac

SEQ ID NO: 6063 - RNA, 20 nt, Artificial Sequence
  MKO10006063_A_Awau2
  gRNA
ugggcccuuaccucgcucag

SEQ ID NO: 6064 - RNA, 20 nt, Artificial Sequence
  MKO10006064_A_Awau2
  gRNA
cucauggcccauucauguuu

SEQ ID NO: 6065 - RNA, 20 nt, Artificial Sequence
  MKO10006065_A_Awau2
  gRNA
uagcgacuacuucccacuca

SEQ ID NO: 6066 - RNA, 20 nt, Artificial Sequence
  MKO10006066_A_Axin1
  gRNA
guuucaccgaagaugccccc

SEQ ID NO: 6067 - RNA, 20 nt, Artificial Sequence
  MKO10006067_A_Axin1
  gRNA
caucuaccgaaaguacaucc

SEQ ID NO: 6068 - RNA, 20 nt, Artificial Sequence
  MKO10006068_A_Axin1
  gRNA
agagcuuauucaccgucuag

SEQ ID NO: 6069 - RNA, 20 nt, Artificial Sequence
  MKO10006069_A_Axin2
  gRNA
uaacucgcugucguuggcgc

SEQ ID NO: 6070 - RNA, 20 nt, Artificial Sequence
  MKO10006070_A_Axin2
  gRNA
aacgugcuucgucgucuguu

SEQ ID NO: 6071 - RNA, 20 nt, Artificial Sequence
  MKO10006071_A_Axin2
  gRNA
aucgucggucagugcgucgc

SEQ ID NO: 6072 - RNA, 20 nt, Artificial Sequence
  MKO10006072_A_Axl
  gRNA
cggaacccgugacccuacuc

SEQ ID NO: 6073 - RNA, 20 nt, Artificial Sequence
  MKO10006073_A_Axl
  gRNA
aaguguccccgugaguccuc

SEQ ID NO: 6074 - RNA, 20 nt, Artificial Sequence
  MKO10006074_A_Axl
  gRNA
gaggaugggcagggucccgc

SEQ ID NO: 6075 - RNA, 20 nt, Artificial Sequence
  MKO10006075_A_Aym1
  gRNA
gagcacagcaacaagcucag

SEQ ID NO: 6076 - RNA, 20 nt, Artificial Sequence
  MKO10006076_A_Aym1
  gRNA
ugcucucacagaacuuucug

SEQ ID NO: 6077 - RNA, 20 nt, Artificial Sequence
  MKO10006077_A_Aym1
  gRNA
cuccucucucuaagagauaa

SEQ ID NO: 6078 - RNA, 20 nt, Artificial Sequence
  MKO10006078_A_Azgp1
  gRNA
gaugaaauccucuccgucgu

SEQ ID NO: 6079 - RNA, 20 nt, Artificial Sequence
  MKO10006079_A_Azgp1
  gRNA
aguguguaccuauucggucc

SEQ ID NO: 6080 - RNA, 20 nt, Artificial Sequence
  MKO10006080_A_Azgp1
  gRNA
aaaccucggaaaaccuuugc

SEQ ID NO: 6081 - RNA, 20 nt, Artificial Sequence
  MKO10006081_A_Azi1
  gRNA
ccuuaccaggacguuccacg

SEQ ID NO: 6082 - RNA, 20 nt, Artificial Sequence
  MKO10006082_A_Azi1
  gRNA
ccagcuucaccgcuaacaac

SEQ ID NO: 6083 - RNA, 20 nt, Artificial Sequence
  MKO10006083_A_Azi1
  gRNA
ugggggagcccguccaugac

SEQ ID NO: 6084 - RNA, 20 nt, Artificial Sequence
  MKO10006084_A_Azi2
  gRNA
ggccuaucaugcauaucgug

SEQ ID NO: 6085 - RNA, 20 nt, Artificial Sequence
  MKO10006085_A_Azi2
  gRNA
acuccacucucagcguaccc

SEQ ID NO: 6086 - RNA, 20 nt, Artificial Sequence
  MKO10006086_A_Azi2
  gRNA
aaccucacgauaugcaugau

SEQ ID NO: 6087 - RNA, 20 nt, Artificial Sequence
  MKO10006087_A_Azin1
  gRNA
acacacaucgagcaucagac

SEQ ID NO: 6088 - RNA, 20 nt, Artificial Sequence
  MKO10006088_A_Azin1
  gRNA
uccagccgugcuugagaucu

SEQ ID NO: 6089 - RNA, 20 nt, Artificial Sequence
  MKO10006089_A_Azin1
  gRNA
uugcacuucaccguguaaaa

SEQ ID NO: 6090 - RNA, 20 nt, Artificial Sequence
  MKO10006090_A_B020004C17Rik
  gRNA
ugaccucggcagcugaaggu

SEQ ID NO: 6091 - RNA, 20 nt, Artificial Sequence
  MKO10006091_A_B020004C17Rik
  gRNA
uuugauccuauaugacaucu

SEQ ID NO: 6092 - RNA, 20 nt, Artificial Sequence
  MKO10006092_A_B020004C17Rik
  gRNA
aucaucagcgauggguuccc

SEQ ID NO: 6093 - RNA, 20 nt, Artificial Sequence
  MKO10006093_A_B020004J07Rik
  gRNA
uuuccagccgaccuauauug

SEQ ID NO: 6094 - RNA, 20 nt, Artificial Sequence
  MKO10006094_A_B020004J07Rik
  gRNA
aagaccucgcugauaaccuc

SEQ ID NO: 6095 - RNA, 20 nt, Artificial Sequence
  MKO10006095_A_B020004J07Rik
  gRNA
gcuaaccuaagcaaguugac

SEQ ID NO: 6096 - RNA, 20 nt, Artificial Sequence
  MKO10006096_A_B020031M17Rik
  gRNA
ccuuguacucugggcggcca

SEQ ID NO: 6097 - RNA, 20 nt, Artificial Sequence
  MKO10006097_A_B020031M17Rik
  gRNA
acugcccagugcacaagccu

SEQ ID NO: 6098 - RNA, 20 nt, Artificial Sequence
  MKO10006098_A_B020031M17Rik
  gRNA
cauggguaaagccaagaaga

SEQ ID NO: 6099 - RNA, 20 nt, Artificial Sequence
  MKO10006099_A_B230118H07Rik
  gRNA
ugauaugacccgggcuggaa

SEQ ID NO: 6100 - RNA, 20 nt, Artificial Sequence
  MKO10006100_A_B230118H07Rik
  gRNA
agcacauacccuuguucauc

SEQ ID NO: 6101 - RNA, 20 nt, Artificial Sequence
  MKO10006101_A_B230118H07Rik
  gRNA
auauccuguuccaccucacc

SEQ ID NO: 6102 - RNA, 20 nt, Artificial Sequence
  MKO10006102_A_B230216G23Rik
  gRNA
cuugcagaccggccgccucc

SEQ ID NO: 6103 - RNA, 20 nt, Artificial Sequence
  MKO10006103_A_B230216G23Rik
  gRNA
uccucuccgaccagagccgu

SEQ ID NO: 6104 - RNA, 20 nt, Artificial Sequence
  MKO10006104_A_B230216G23Rik
  gRNA
cuuguaggggcccagcgucc

SEQ ID NO: 6105 - RNA, 20 nt, Artificial Sequence
  MKO10006105_A_B230217C12Rik
  gRNA
ggucggucagcgcggagaaa

SEQ ID NO: 6106 - RNA, 20 nt, Artificial Sequence
  MKO10006106_A_B230217C12Rik
  gRNA
ccucuugcuggacccgacac

SEQ ID NO: 6107 - RNA, 20 nt, Artificial Sequence
  MKO10006107_A_B230217C12Rik
  gRNA
cauccugcuugcugacgcac

SEQ ID NO: 6108 - RNA, 20 nt, Artificial Sequence
  MKO10006108_A_B230219D22Rik
  gRNA
cucgcuuaccagaucgauug

SEQ ID NO: 6109 - RNA, 20 nt, Artificial Sequence
  MKO10006109_A_B230219D22Rik
  gRNA
acagaacgcuggauuacugc

SEQ ID NO: 6110 - RNA, 20 nt, Artificial Sequence
  MKO10006110_A_B230219D22Rik
  gRNA
gcugacuugguaguucccga

SEQ ID NO: 6111 - RNA, 20 nt, Artificial Sequence
  MKO10006111_A_B2m
  gRNA
aguauacucacgccacccac

SEQ ID NO: 6112 - RNA, 20 nt, Artificial Sequence
  MKO10006112_A_B2m
  gRNA
agucgucagcauggcucgcu

SEQ ID NO: 6113 - RNA, 20 nt, Artificial Sequence
  MKO10006113_A_B2m
  gRNA
ccgagcccaagaccgucuac

SEQ ID NO: 6114 - RNA, 20 nt, Artificial Sequence
  MKO10006114_A_B3galnt1
  gRNA
agacgcgugauugcagccca

SEQ ID NO: 6115 - RNA, 20 nt, Artificial Sequence
  MKO10006115_A_B3galnt1
  gRNA
augugaucgagcgcgucaac

SEQ ID NO: 6116 - RNA, 20 nt, Artificial Sequence
  MKO10006116_A_B3galnt1
  gRNA
cuacauuauguccggcgacc

SEQ ID NO: 6117 - RNA, 20 nt, Artificial Sequence
  MKO10006117_A_B3galnt2
  gRNA
uuaucacauuucgaaguucg

SEQ ID NO: 6118 - RNA, 20 nt, Artificial Sequence
  MKO10006118_A_B3galnt2
  gRNA
acgaacuucgaaaugugaua

SEQ ID NO: 6119 - RNA, 20 nt, Artificial Sequence
  MKO10006119_A_B3galnt2
  gRNA
gacugaaucgggcgaugaaa

SEQ ID NO: 6120 - RNA, 20 nt, Artificial Sequence
  MKO10006120_A_B3galt1
  gRNA
uugaugcccgccaggcaauc

SEQ ID NO: 6121 - RNA, 20 nt, Artificial Sequence
  MKO10006121_A_B3galt1
  gRNA
acacaacggucaauacauag

SEQ ID NO: 6122 - RNA, 20 nt, Artificial Sequence
  MKO10006122_A_B3galt1
  gRNA
uuacugcggacaucccugau

SEQ ID NO: 6123 - RNA, 20 nt, Artificial Sequence
  MKO10006123_A_B3galt2
  gRNA
agguauccgucguuugcacu

SEQ ID NO: 6124 - RNA, 20 nt, Artificial Sequence
  MKO10006124_A_B3galt2
  gRNA
uaacaccgagcuaucaccac

SEQ ID NO: 6125 - RNA, 20 nt, Artificial Sequence
  MKO10006125_A_B3galt2
  gRNA
augaguucguguucaaucac

SEQ ID NO: 6126 - RNA, 20 nt, Artificial Sequence
  MKO10006126_A_B3galt4
  gRNA
ggggugccauccgcgaagcc

SEQ ID NO: 6127 - RNA, 20 nt, Artificial Sequence
  MKO10006127_A_B3galt4
  gRNA
cccguaacagcaccgaucca

SEQ ID NO: 6128 - RNA, 20 nt, Artificial Sequence
  MKO10006128_A_B3galt4
  gRNA
acacgucaucauccgucuug

SEQ ID NO: 6129 - RNA, 20 nt, Artificial Sequence
  MKO10006129_A_B3galt5
  gRNA
acggaaaagcguaaaccgcc

SEQ ID NO: 6130 - RNA, 20 nt, Artificial Sequence
  MKO10006130_A_B3galt5
  gRNA
caagcuaaagauccggccgg

SEQ ID NO: 6131 - RNA, 20 nt, Artificial Sequence
  MKO10006131_A_B3galt5
  gRNA
ugaguaaguucgaauauccc

SEQ ID NO: 6132 - RNA, 20 nt, Artificial Sequence
  MKO10006132_A_B3galt6
  gRNA
cgacgccuacgagaaccuca

SEQ ID NO: 6133 - RNA, 20 nt, Artificial Sequence
  MKO10006133_A_B3galt6
  gRNA
cucguaggcgucgcgcaggg

SEQ ID NO: 6134 - RNA, 20 nt, Artificial Sequence
  MKO10006134_A_B3galt6
  gRNA
gcacgacccacgcuucgaca

SEQ ID NO: 6135 - RNA, 20 nt, Artificial Sequence
  MKO10006135_A_B3galtl
  gRNA
agguaccuacugcgguaaca

SEQ ID NO: 6136 - RNA, 20 nt, Artificial Sequence
  MKO10006136_A_B3galtl
  gRNA
uuugaggcagaguagucuac

SEQ ID NO: 6137 - RNA, 20 nt, Artificial Sequence
  MKO10006137_A_B3galtl
  gRNA
uuaccuaugucaugucuccc

SEQ ID NO: 6138 - RNA, 20 nt, Artificial Sequence
  MKO10006138_A_B3gau1
  gRNA
uccgcgaaguacacuacgcc

SEQ ID NO: 6139 - RNA, 20 nt, Artificial Sequence
  MKO10006139_A_B3gau1
  gRNA
gcgcgcuugcugcgcgacac

SEQ ID NO: 6140 - RNA, 20 nt, Artificial Sequence
  MKO10006140_A_B3gau1
  gRNA
auaccgaaggccaccaacaa

SEQ ID NO: 6141 - RNA, 20 nt, Artificial Sequence
  MKO10006141_A_B3gau2
  gRNA
cgccaccgaacagcgcaacg

SEQ ID NO: 6142 - RNA, 20 nt, Artificial Sequence
  MKO10006142_A_B3gau2
  gRNA
cacggucgcuuguagcgccg

SEQ ID NO: 6143 - RNA, 20 nt, Artificial Sequence
  MKO10006143_A_B3gau2
  gRNA
cggcgcuuaaauacagcuuu

SEQ ID NO: 6144 - RNA, 20 nt, Artificial Sequence
  MKO10006144_A_B3gau3
  gRNA
agagccguaccuggcguagg

SEQ ID NO: 6145 - RNA, 20 nt, Artificial Sequence
  MKO10006145_A_B3gau3
  gRNA
cgcaaaucccgccaugucca

SEQ ID NO: 6146 - RNA, 20 nt, Artificial Sequence
  MKO10006146_A_B3gau3
  gRNA
cgcugagagcccuaccccgc

SEQ ID NO: 6147 - RNA, 20 nt, Artificial Sequence
  MKO10006147_A_B3gnt1
  gRNA
guagacgcgauaaucgccgc

SEQ ID NO: 6148 - RNA, 20 nt, Artificial Sequence
  MKO10006148_A_B3gnt1
  gRNA
ucuacggaucgcggagacgg

SEQ ID NO: 6149 - RNA, 20 nt, Artificial Sequence
  MKO10006149_A_B3gnt1
  gRNA
gguaaaggaucuuauugcgc

SEQ ID NO: 6150 - RNA, 20 nt, Artificial Sequence
  MKO10006150_A_B3gnt2
  gRNA
cgucuacccaccguaugccg

SEQ ID NO: 6151 - RNA, 20 nt, Artificial Sequence
  MKO10006151_A_B3gnt2
  gRNA
acgccgguguagaagacuuc

SEQ ID NO: 6152 - RNA, 20 nt, Artificial Sequence
  MKO10006152_A_B3gnt2
  gRNA
gcugucaugaccgucgaguc

SEQ ID NO: 6153 - RNA, 20 nt, Artificial Sequence
  MKO10006153_A_B3gnt3
  gRNA
caagaagucgcgcacgugua

SEQ ID NO: 6154 - RNA, 20 nt, Artificial Sequence
  MKO10006154_A_B3gnt3
  gRNA
cccacgucgugcgcagcauc

SEQ ID NO: 6155 - RNA, 20 nt, Artificial Sequence
  MKO10006155_A_B3gnt3
  gRNA
ccacgguaaaacgcgacagc

SEQ ID NO: 6156 - RNA, 20 nt, Artificial Sequence
  MKO10006156_A_B3gnt4
  gRNA
gaacgcuguucaauaugagc

SEQ ID NO: 6157 - RNA, 20 nt, Artificial Sequence
  MKO10006157_A_B3gnt4
  gRNA
cugguaugcgcuccuucaga

SEQ ID NO: 6158 - RNA, 20 nt, Artificial Sequence
  MKO10006158_A_B3gnt4
  gRNA
gugucccuggcacacuccga

SEQ ID NO: 6159 - RNA, 20 nt, Artificial Sequence
  MKO10006159_A_B3gnt5
  gRNA
auuggucacguucaucgagg

SEQ ID NO: 6160 - RNA, 20 nt, Artificial Sequence
  MKO10006160_A_B3gnt5
  gRNA
uugaucaaguauggguagug

SEQ ID NO: 6161 - RNA, 20 nt, Artificial Sequence
  MKO10006161_A_B3gnt5
  gRNA
caaagccauagcuauuuacg

SEQ ID NO: 6162 - RNA, 20 nt, Artificial Sequence
  MKO10006162_A_B3gnt6
  gRNA
cgucgccugcgcacuacgag

SEQ ID NO: 6163 - RNA, 20 nt, Artificial Sequence
  MKO10006163_A_B3gnt6
  gRNA
ucgcgccgcucguagugcgc

SEQ ID NO: 6164 - RNA, 20 nt, Artificial Sequence
  MKO10006164_A_B3gnt6
  gRNA
gccgccgcuuuccgcaacug

SEQ ID NO: 6165 - RNA, 20 nt, Artificial Sequence
  MKO10006165_A_B3gnt7
  gRNA
ggccccggcgugggcgguaa

SEQ ID NO: 6166 - RNA, 20 nt, Artificial Sequence
  MKO10006166_A_B3gnt7
  gRNA
cacacagcaugaccgccgag

SEQ ID NO: 6167 - RNA, 20 nt, Artificial Sequence
  MKO10006167_A_B3gnt7
  gRNA
accgggccgccaugucucug

SEQ ID NO: 6168 - RNA, 20 nt, Artificial Sequence
  MKO10006168_A_B3gnt8
  gRNA
aaaccgcuccgcaagcccgg

SEQ ID NO: 6169 - RNA, 20 nt, Artificial Sequence
  MKO10006169_A_B3gnt8
  gRNA
gacuauccagccuaugcgag

SEQ ID NO: 6170 - RNA, 20 nt, Artificial Sequence
  MKO10006170_A_B3gnt8
  gRNA
ccaguacggacugucagacu

SEQ ID NO: 6171 - RNA, 20 nt, Artificial Sequence
  MKO10006171_A_B3gnt9
  gRNA
cgcgccuuugcccagacgcg

SEQ ID NO: 6172 - RNA, 20 nt, Artificial Sequence
  MKO10006172_A_B3gnt9
  gRNA
gcucuacgcgcagcgcgacg

SEQ ID NO: 6173 - RNA, 20 nt, Artificial Sequence
  MKO10006173_A_B3gnt9
  gRNA
cauccagcguuucgcaccuu

SEQ ID NO: 6174 - RNA, 20 nt, Artificial Sequence
  MKO10006174_A_B3gntl1
  gRNA
cacacucgucgggugcugac

SEQ ID NO: 6175 - RNA, 20 nt, Artificial Sequence
  MKO10006175_A_B3gntl1
  gRNA
caagccgucgcacagagcac

SEQ ID NO: 6176 - RNA, 20 nt, Artificial Sequence
  MKO10006176_A_B3gntl1
  gRNA
ccacugcucagcguugugca

SEQ ID NO: 6177 - RNA, 20 nt, Artificial Sequence
  MKO10006177_A_B430306N03Rik
  gRNA
cccacagccccgucacuaac

SEQ ID NO: 6178 - RNA, 20 nt, Artificial Sequence
  MKO10006178_A_B430306N03Rik
  gRNA
gcuuuccagauagcccgaug

SEQ ID NO: 6179 - RNA, 20 nt, Artificial Sequence
  MKO10006179_A_B430306N03Rik
  gRNA
cacgaccaccccagcaacga

SEQ ID NO: 6180 - RNA, 20 nt, Artificial Sequence
  MKO10006180_A_B4galnt1
  gRNA
acacuacaggagccgguccc

SEQ ID NO: 6181 - RNA, 20 nt, Artificial Sequence
  MKO10006181_A_B4galnt1
  gRNA
guguggagguucagccccuc

SEQ ID NO: 6182 - RNA, 20 nt, Artificial Sequence
  MKO10006182_A_B4galnt1
  gRNA
acucaaccggcagcugcaac

SEQ ID NO: 6183 - RNA, 20 nt, Artificial Sequence
  MKO10006183_A_B4galnt2
  gRNA
acuugccacuguugcguuua

SEQ ID NO: 6184 - RNA, 20 nt, Artificial Sequence
  MKO10006184_A_B4galnt2
  gRNA
gggacucuuaccucauagac

SEQ ID NO: 6185 - RNA, 20 nt, Artificial Sequence
  MKO10006185_A_B4galnt2
  gRNA
cccuucggauacccagucca

SEQ ID NO: 6186 - RNA, 20 nt, Artificial Sequence
  MKO10006186_A_B4galnt3
  gRNA
gcagauagccaaauaugcgg

SEQ ID NO: 6187 - RNA, 20 nt, Artificial Sequence
  MKO10006187_A_B4galnt3
  gRNA
aacuauggccuccgcauauu

SEQ ID NO: 6188 - RNA, 20 nt, Artificial Sequence
  MKO10006188_A_B4galnt3
  gRNA
uccaauucuaccguccccag

SEQ ID NO: 6189 - RNA, 20 nt, Artificial Sequence
  MKO10006189_A_B4galnt4
  gRNA
caaccggcagacucguacua

SEQ ID NO: 6190 - RNA, 20 nt, Artificial Sequence
  MKO10006190_A_B4galnt4
  gRNA
acgauggcacucggacuccg

SEQ ID NO: 6191 - RNA, 20 nt, Artificial Sequence
  MKO10006191_A_B4galnt4
  gRNA
cauguuugggccccgccccu

SEQ ID NO: 6192 - RNA, 20 nt, Artificial Sequence
  MKO10006192_A_B4galt1
  gRNA
cagcuuagcucgauugaaca

SEQ ID NO: 6193 - RNA, 20 nt, Artificial Sequence
  MKO10006193_A_B4galt1
  gRNA
ucaucaucccauuccguaac

SEQ ID NO: 6194 - RNA, 20 nt, Artificial Sequence
  MKO10006194_A_B4galt1
  gRNA
cagcgccagcaacucgacua

SEQ ID NO: 6195 - RNA, 20 nt, Artificial Sequence
  MKO10006195_A_B4galt2
  gRNA
gaccgcaaucuguaccguug

SEQ ID NO: 6196 - RNA, 20 nt, Artificial Sequence
  MKO10006196_A_B4galt2
  gRNA
accgcaugaucaagcacgac

SEQ ID NO: 6197 - RNA, 20 nt, Artificial Sequence
  MKO10006197_A_B4galt2
  gRNA
cccggucgugcuugaucaug

SEQ ID NO: 6198 - RNA, 20 nt, Artificial Sequence
  MKO10006198_A_B4galt3
  gRNA
uggugcucccgggcacgaug

SEQ ID NO: 6199 - RNA, 20 nt, Artificial Sequence
  MKO10006199_A_B4galt3
  gRNA
auuauggcuguucgggagcg

SEQ ID NO: 6200 - RNA, 20 nt, Artificial Sequence
  MKO10006200_A_B4galt3
  gRNA
cugcuuguucuuacacgacg

SEQ ID NO: 6201 - RNA, 20 nt, Artificial Sequence
  MKO10006201_A_B4galt4
  gRNA
cugcuucguauuccacgacg

SEQ ID NO: 6202 - RNA, 20 nt, Artificial Sequence
  MKO10006202_A_B4galt4
  gRNA
gccggaacagcacgggcuac

SEQ ID NO: 6203 - RNA, 20 nt, Artificial Sequence
  MKO10006203_A_B4galt4
  gRNA
caugguguauuugcccacgu

SEQ ID NO: 6204 - RNA, 20 nt, Artificial Sequence
  MKO10006204_A_B4galt5
  gRNA
gugcucauggcgguuccgga

SEQ ID NO: 6205 - RNA, 20 nt, Artificial Sequence
  MKO10006205_A_B4galt5
  gRNA
cucguacaccugggcaccga

SEQ ID NO: 6206 - RNA, 20 nt, Artificial Sequence
  MKO10006206_A_B4galt5
  gRNA
cacuugcucgaucacauaga

SEQ ID NO: 6207 - RNA, 20 nt, Artificial Sequence
  MKO10006207_A_B4galt6
  gRNA
auguucauggcgguuacgga

SEQ ID NO: 6208 - RNA, 20 nt, Artificial Sequence
  MKO10006208_A_B4galt6
  gRNA
caccuguucgaugacauaaa

SEQ ID NO: 6209 - RNA, 20 nt, Artificial Sequence
  MKO10006209_A_B4galt6
  gRNA
agccaacacguaccucuuua

SEQ ID NO: 6210 - RNA, 20 nt, Artificial Sequence
  MKO10006210_A_B4galt7
  gRNA
cuacaucgccaugcacgaug

SEQ ID NO: 6211 - RNA, 20 nt, Artificial Sequence
  MKO10006211_A_B4galt7
  gRNA
acggaauguccaaccgcuuu

SEQ ID NO: 6212 - RNA, 20 nt, Artificial Sequence
  MKO10006212_A_B4galt7
  gRNA
ggccagcuccuuugaugcgc

SEQ ID NO: 6213 - RNA, 20 nt, Artificial Sequence
  MKO10006213_A_B630005N14Rik
  gRNA
agaagacucgugcacguuua

SEQ ID NO: 6214 - RNA, 20 nt, Artificial Sequence
  MKO10006214_A_B630005N14Rik
  gRNA
acuugaagcgcuuaaaaccc

SEQ ID NO: 6215 - RNA, 20 nt, Artificial Sequence
  MKO10006215_A_B630005N14Rik
  gRNA
uuccaucacccuaccagcga

SEQ ID NO: 6216 - RNA, 20 nt, Artificial Sequence
  MKO10006216_A_B930041F14Rik
  gRNA
ucuucgcgcuaaacugcucg

SEQ ID NO: 6217 - RNA, 20 nt, Artificial Sequence
  MKO10006217_A_B930041F14Rik
  gRNA
cccuugcgaucgcgugcuuu

SEQ ID NO: 6218 - RNA, 20 nt, Artificial Sequence
  MKO10006218_A_B930041F14Rik
  gRNA
acguuucgcagcccggcguc

SEQ ID NO: 6219 - RNA, 20 nt, Artificial Sequence
  MKO10006219_A_B9d1
  gRNA
uuugggaaugaugucguccg

SEQ ID NO: 6220 - RNA, 20 nt, Artificial Sequence
  MKO10006220_A_B9d1
  gRNA
ccagugcuugccguacaucu

SEQ ID NO: 6221 - RNA, 20 nt, Artificial Sequence
  MKO10006221_A_B9d1
  gRNA
ccgcuguuggggcccagucc

SEQ ID NO: 6222 - RNA, 20 nt, Artificial Sequence
  MKO10006222_A_B9d2
  gRNA
cugcgccacuucgaucgcua

SEQ ID NO: 6223 - RNA, 20 nt, Artificial Sequence
  MKO10006223_A_B9d2
  gRNA
ccacuccauagcgaucgaag

SEQ ID NO: 6224 - RNA, 20 nt, Artificial Sequence
  MKO10006224_A_B9d2
  gRNA
gaccugcacuucgcuacuaa

SEQ ID NO: 6225 - RNA, 20 nt, Artificial Sequence
  MKO10006225_A_BB287469
  gRNA
uguguccauuucauugauuu

SEQ ID NO: 6226 - RNA, 20 nt, Artificial Sequence
  MKO10006226_A_BB287469
  gRNA
uccaucaugccaaagaauaa

SEQ ID NO: 6227 - RNA, 20 nt, Artificial Sequence
  MKO10006227_A_BB287469
  gRNA
agaugaagcaagaagucuga

SEQ ID NO: 6228 - RNA, 20 nt, Artificial Sequence
  MKO10006228_A_BC003331
  gRNA
ucuuucaagcaucaaccucc

SEQ ID NO: 6229 - RNA, 20 nt, Artificial Sequence
  MKO10006229_A_BC003331
  gRNA
cacuagaacaccacccaaag

SEQ ID NO: 6230 - RNA, 20 nt, Artificial Sequence
  MKO10006230_A_BC003331
  gRNA
gguugaugcuugaaagauac

SEQ ID NO: 6231 - RNA, 20 nt, Artificial Sequence
  MKO10006231_A_BC003965
  gRNA
guuacguucuagccccguag

SEQ ID NO: 6232 - RNA, 20 nt, Artificial Sequence
  MKO10006232_A_BC003965
  gRNA
gcaaagccaccccgauccgc

SEQ ID NO: 6233 - RNA, 20 nt, Artificial Sequence
  MKO10006233_A_BC003965
  gRNA
accccgcagcccgugagcac

SEQ ID NO: 6234 - RNA, 20 nt, Artificial Sequence
  MKO10006234_A_BC004004
  gRNA
ugcccagauauuaccccuca

SEQ ID NO: 6235 - RNA, 20 nt, Artificial Sequence
  MKO10006235_A_BC004004
  gRNA
agaggaacgcccuuauucuc

SEQ ID NO: 6236 - RNA, 20 nt, Artificial Sequence
  MKO10006236_A_BC004004
  gRNA
cuucuggcagcguuaccuug

SEQ ID NO: 6237 - RNA, 20 nt, Artificial Sequence
  MKO10006237_A_BC005537
  gRNA
uucgcuagagcuucuacaga

SEQ ID NO: 6238 - RNA, 20 nt, Artificial Sequence
  MKO10006238_A_BC005537
  gRNA
ggauguaaucggcuguacuc

SEQ ID NO: 6239 - RNA, 20 nt, Artificial Sequence
  MKO10006239_A_BC005537
  gRNA
ucugcauguacugagccgca

SEQ ID NO: 6240 - RNA, 20 nt, Artificial Sequence
  MKO10006240_A_BC005561
  gRNA
aaaggaguccggacaugaua

SEQ ID NO: 6241 - RNA, 20 nt, Artificial Sequence
  MKO10006241_A_BC005561
  gRNA
cuuacuauauuacgagcaac

SEQ ID NO: 6242 - RNA, 20 nt, Artificial Sequence
  MKO10006242_A_BC005561
  gRNA
caucaugaagcgccuaacaa

SEQ ID NO: 6243 - RNA, 20 nt, Artificial Sequence
  MKO10006243_A_BC005624
  gRNA
gguacccaccucaccccauu

SEQ ID NO: 6244 - RNA, 20 nt, Artificial Sequence
  MKO10006244_A_BC005624
  gRNA
uccgcaaguucugcaccucu

SEQ ID NO: 6245 - RNA, 20 nt, Artificial Sequence
  MKO10006245_A_BC005624
  gRNA
gcucagugcggcugcccugc

SEQ ID NO: 6246 - RNA, 20 nt, Artificial Sequence
  MKO10006246_A_BC005764
  gRNA
ggugcagaucauggucggcg

SEQ ID NO: 6247 - RNA, 20 nt, Artificial Sequence
  MKO10006247_A_BC005764
  gRNA
gaccccccagcuacccaucg

SEQ ID NO: 6248 - RNA, 20 nt, Artificial Sequence
  MKO10006248_A_BC005764
  gRNA
auccaacgcaccuugcugac

SEQ ID NO: 6249 - RNA, 20 nt, Artificial Sequence
  MKO10006249_A_BC016423
  gRNA
caaguaacuccgucuucuaa

SEQ ID NO: 6250 - RNA, 20 nt, Artificial Sequence
  MKO10006250_A_BC016423
  gRNA
ugcugugugauauaacucuu

SEQ ID NO: 6251 - RNA, 20 nt, Artificial Sequence
  MKO10006251_A_BC016423
  gRNA
auaauaaacugcccuuucca

SEQ ID NO: 6252 - RNA, 20 nt, Artificial Sequence
  MKO10006252_A_BC016579
  gRNA
cccugcaacaagagcguggu

SEQ ID NO: 6253 - RNA, 20 nt, Artificial Sequence
  MKO10006253_A_BC016579
  gRNA
guuauaagccuaugccuugu

SEQ ID NO: 6254 - RNA, 20 nt, Artificial Sequence
  MKO10006254_A_BC016579
  gRNA
gucaagcccgagacucucac

SEQ ID NO: 6255 - RNA, 20 nt, Artificial Sequence
  MKO10006255_A_BC017158
  gRNA
ggcuaccuuggcuagguugc

SEQ ID NO: 6256 - RNA, 20 nt, Artificial Sequence
  MKO10006256_A_BC017158
  gRNA
gccguaucaucuuugccugg

SEQ ID NO: 6257 - RNA, 20 nt, Artificial Sequence
  MKO10006257_A_BC017158
  gRNA
cagcucaccuuucacgagcc

SEQ ID NO: 6258 - RNA, 20 nt, Artificial Sequence
  MKO10006258_A_BC017643
  gRNA
gagucagcagcuucuuguag

SEQ ID NO: 6259 - RNA, 20 nt, Artificial Sequence
  MKO10006259_A_BC017643
  gRNA
ugcuugcagauagucugggc

SEQ ID NO: 6260 - RNA, 20 nt, Artificial Sequence
  MKO10006260_A_BC017643
  gRNA
gggagaagccuguugcaaac

SEQ ID NO: 6261 - RNA, 20 nt, Artificial Sequence
  MKO10006261_A_BC018242
  gRNA
gguccuucuugcguaccgcc

SEQ ID NO: 6262 - RNA, 20 nt, Artificial Sequence
  MKO10006262_A_BC018242
  gRNA
aguuggggcgacacaccgac

SEQ ID NO: 6263 - RNA, 20 nt, Artificial Sequence
  MKO10006263_A_BC018242
  gRNA
ugauagagaaacuccgcuuc

SEQ ID NO: 6264 - RNA, 20 nt, Artificial Sequence
  MKO10006264_A_BC018507
  gRNA
ucuucugauauuccgucagc

SEQ ID NO: 6265 - RNA, 20 nt, Artificial Sequence
  MKO10006265_A_BC018507
  gRNA
ucuggagcaucugcuccacu

SEQ ID NO: 6266 - RNA, 20 nt, Artificial Sequence
  MKO10006266_A_BC018507
  gRNA
uacagcugcaguuugcaaga

SEQ ID NO: 6267 - RNA, 20 nt, Artificial Sequence
  MKO10006267_A_BC021614
  gRNA
gccguaggauaguauuggau

SEQ ID NO: 6268 - RNA, 20 nt, Artificial Sequence
  MKO10006268_A_BC021614
  gRNA
accuauucagacgcauugcc

SEQ ID NO: 6269 - RNA, 20 nt, Artificial Sequence
  MKO10006269_A_BC021614
  gRNA
ccaggauauggcgauacugc

SEQ ID NO: 6270 - RNA, 20 nt, Artificial Sequence
  MKO10006270_A_BC021785
  gRNA
gagucggaaauggggucccg

SEQ ID NO: 6271 - RNA, 20 nt, Artificial Sequence
  MKO10006271_A_BC021785
  gRNA
agugagguaaagaccggcua

SEQ ID NO: 6272 - RNA, 20 nt, Artificial Sequence
  MKO10006272_A_BC021785
  gRNA
auggcaacuccugcacuauc

SEQ ID NO: 6273 - RNA, 20 nt, Artificial Sequence
  MKO10006273_A_BC021891
  gRNA
acuggugaggucccguaccg

SEQ ID NO: 6274 - RNA, 20 nt, Artificial Sequence
  MKO10006274_A_BC021891
  gRNA
caaacgaggggcggauauga

SEQ ID NO: 6275 - RNA, 20 nt, Artificial Sequence
  MKO10006275_A_BC021891
  gRNA
gcuccgcgagcugcugcucg

SEQ ID NO: 6276 - RNA, 20 nt, Artificial Sequence
  MKO10006276_A_BC022687
  gRNA
ugauguagcgcccguucccu

SEQ ID NO: 6277 - RNA, 20 nt, Artificial Sequence
  MKO10006277_A_BC022687
  gRNA
ccgacacugcgucugcuucg

SEQ ID NO: 6278 - RNA, 20 nt, Artificial Sequence
  MKO10006278_A_BC022687
  gRNA
ugcguuucaagaagucgccg

SEQ ID NO: 6279 - RNA, 20 nt, Artificial Sequence
  MKO10006279_A_BC023829
  gRNA
ccgaccaaacgauguaauag

SEQ ID NO: 6280 - RNA, 20 nt, Artificial Sequence
  MKO10006280_A_BC023829
  gRNA
caaucacauccauagagcgc

SEQ ID NO: 6281 - RNA, 20 nt, Artificial Sequence
  MKO10006281_A_BC023829
  gRNA
ucgacaugacaggucacuag

SEQ ID NO: 6282 - RNA, 20 nt, Artificial Sequence
  MKO10006282_A_BC024139
  gRNA
ggagucguugccguaccucc

SEQ ID NO: 6283 - RNA, 20 nt, Artificial Sequence
  MKO10006283_A_BC024139
  gRNA
cucccggccucucguaaucu

SEQ ID NO: 6284 - RNA, 20 nt, Artificial Sequence
  MKO10006284_A_BC024139
  gRNA
gcucccuuagcagccgcaag

SEQ ID NO: 6285 - RNA, 20 nt, Artificial Sequence
  MKO10006285_A_BC024978
  gRNA
gguuucgaagugaccugcag

SEQ ID NO: 6286 - RNA, 20 nt, Artificial Sequence
  MKO10006286_A_BC024978
  gRNA
cacgagccgugucaaaagaa

SEQ ID NO: 6287 - RNA, 20 nt, Artificial Sequence
  MKO10006287_A_BC024978
  gRNA
aacaccugacagcgucucuc

SEQ ID NO: 6288 - RNA, 20 nt, Artificial Sequence
  MKO10006288_A_BC026585
  gRNA
cccguacucacccgguguaa

SEQ ID NO: 6289 - RNA, 20 nt, Artificial Sequence
  MKO10006289_A_BC026585
  gRNA
uuccugauacugaccacgac

SEQ ID NO: 6290 - RNA, 20 nt, Artificial Sequence
  MKO10006290_A_BC026585
  gRNA
uccccgccccgucgggccac

SEQ ID NO: 6291 - RNA, 20 nt, Artificial Sequence
  MKO10006291_A_BC026590
  gRNA
uugcuuaccgguuggagugc

SEQ ID NO: 6292 - RNA, 20 nt, Artificial Sequence
  MKO10006292_A_BC026590
  gRNA
gcaauuguuacugaucugau

SEQ ID NO: 6293 - RNA, 20 nt, Artificial Sequence
  MKO10006293_A_BC026590
  gRNA
guauacuccagcacuccaac

SEQ ID NO: 6294 - RNA, 20 nt, Artificial Sequence
  MKO10006294_A_BC027072
  gRNA
aagaggcuuucccgcguguc

SEQ ID NO: 6295 - RNA, 20 nt, Artificial Sequence
  MKO10006295_A_BC027072
  gRNA
ccagaagcccgaaugaaccg

SEQ ID NO: 6296 - RNA, 20 nt, Artificial Sequence
  MKO10006296_A_BC027072
  gRNA
agcgcgagcacuuccggcgc

SEQ ID NO: 6297 - RNA, 20 nt, Artificial Sequence
  MKO10006297_A_BC027231
  gRNA
caaguuguuacugcgcuugc

SEQ ID NO: 6298 - RNA, 20 nt, Artificial Sequence
  MKO10006298_A_BC027231
  gRNA
gggccaccacaagccccauu

SEQ ID NO: 6299 - RNA, 20 nt, Artificial Sequence
  MKO10006299_A_BC027231
  gRNA
cacaucuacuuccgcaucca

SEQ ID NO: 6300 - RNA, 20 nt, Artificial Sequence
  MKO10006300_A_BC028528
  gRNA
uacacagugaccccuaauua

SEQ ID NO: 6301 - RNA, 20 nt, Artificial Sequence
  MKO10006301_A_BC028528
  gRNA
agagggugauuacuaucaag

SEQ ID NO: 6302 - RNA, 20 nt, Artificial Sequence
  MKO10006302_A_BC028528
  gRNA
uaaaauguaccccuccuuga

SEQ ID NO: 6303 - RNA, 20 nt, Artificial Sequence
  MKO10006303_A_BC029214
  gRNA
ugacggacgccgccgagcuc

SEQ ID NO: 6304 - RNA, 20 nt, Artificial Sequence
  MKO10006304_A_BC029214
  gRNA
uguuacucacgagccucgcc

SEQ ID NO: 6305 - RNA, 20 nt, Artificial Sequence
  MKO10006305_A_BC029214
  gRNA
gaacucaccugaaccgggaa

SEQ ID NO: 6306 - RNA, 20 nt, Artificial Sequence
  MKO10006306_A_BC030307
  gRNA
gccgagugaaaugagcgacg

SEQ ID NO: 6307 - RNA, 20 nt, Artificial Sequence
  MKO10006307_A_BC030307
  gRNA
cacguacugcccacaaagua

SEQ ID NO: 6308 - RNA, 20 nt, Artificial Sequence
  MKO10006308_A_BC030307
  gRNA
cuauccauucacuacgauca

SEQ ID NO: 6309 - RNA, 20 nt, Artificial Sequence
  MKO10006309_A_BC030336
  gRNA
ccaguccggguuggcgaugc

SEQ ID NO: 6310 - RNA, 20 nt, Artificial Sequence
  MKO10006310_A_BC030336
  gRNA
ugcagguccggucucgucca

SEQ ID NO: 6311 - RNA, 20 nt, Artificial Sequence
  MKO10006311_A_BC030336
  gRNA
caucgccagcaucgccaacc

SEQ ID NO: 6312 - RNA, 20 nt, Artificial Sequence
  MKO10006312_A_BC030476
  gRNA
ugcugucgcccgcuuuguug

SEQ ID NO: 6313 - RNA, 20 nt, Artificial Sequence
  MKO10006313_A_BC030476
  gRNA
aggguacagccagccgaaac

SEQ ID NO: 6314 - RNA, 20 nt, Artificial Sequence
  MKO10006314_A_BC030476
  gRNA
cacuccccgccuugcacuag

SEQ ID NO: 6315 - RNA, 20 nt, Artificial Sequence
  MKO10006315_A_BC030499
  gRNA
uucuaccagaguuucccgug

SEQ ID NO: 6316 - RNA, 20 nt, Artificial Sequence
  MKO10006316_A_BC030499
  gRNA
caaacgaaccuuuagccaca

SEQ ID NO: 6317 - RNA, 20 nt, Artificial Sequence
  MKO10006317_A_BC030499
  gRNA
ccaaaguaaaaguucuacag

SEQ ID NO: 6318 - RNA, 20 nt, Artificial Sequence
  MKO10006318_A_BC030500
  gRNA
cuccuuccacgcuacguacc

SEQ ID NO: 6319 - RNA, 20 nt, Artificial Sequence
  MKO10006319_A_BC030500
  gRNA
ggaguacaagucgcccugag

SEQ ID NO: 6320 - RNA, 20 nt, Artificial Sequence
  MKO10006320_A_BC030500
  gRNA
cggcgaaugucaagugugac

SEQ ID NO: 6321 - RNA, 20 nt, Artificial Sequence
  MKO10006321_A_BC030867
  gRNA
uuugccacuugaccacgcuc

SEQ ID NO: 6322 - RNA, 20 nt, Artificial Sequence
  MKO10006322_A_BC030867
  gRNA
gcuaaaacccgccgcuuucc

SEQ ID NO: 6323 - RNA, 20 nt, Artificial Sequence
  MKO10006323_A_BC030867
  gRNA
acaccccagacuccgacuca

SEQ ID NO: 6324 - RNA, 20 nt, Artificial Sequence
  MKO10006324_A_BC031181
  gRNA
ggccauaugcgacugaccac

SEQ ID NO: 6325 - RNA, 20 nt, Artificial Sequence
  MKO10006325_A_BC031181
  gRNA
ggagccauacauauacccug

SEQ ID NO: 6326 - RNA, 20 nt, Artificial Sequence
  MKO10006326_A_BC031181
  gRNA
uuucagggugcagguacuaa

SEQ ID NO: 6327 - RNA, 20 nt, Artificial Sequence
  MKO10006327_A_BC035044
  gRNA
uagguugccuagauauucca

SEQ ID NO: 6328 - RNA, 20 nt, Artificial Sequence
  MKO10006328_A_BC035044
  gRNA
acagcagacuagaguguugu

SEQ ID NO: 6329 - RNA, 20 nt, Artificial Sequence
  MKO10006329_A_BC035044
  gRNA
cuuguccgugaucugcuuca

SEQ ID NO: 6330 - RNA, 20 nt, Artificial Sequence
  MKO10006330_A_BC037034
  gRNA
ccuagauuguagugaccgug

SEQ ID NO: 6331 - RNA, 20 nt, Artificial Sequence
  MKO10006331_A_BC037034
  gRNA
gaggauucggauaucccaga

SEQ ID NO: 6332 - RNA, 20 nt, Artificial Sequence
  MKO10006332_A_BC037034
  gRNA
aucgagucuguagcaagcgc

SEQ ID NO: 6333 - RNA, 20 nt, Artificial Sequence
  MKO10006333_A_BC048403
  gRNA
ucugucggcucagcgccucg

SEQ ID NO: 6334 - RNA, 20 nt, Artificial Sequence
  MKO10006334_A_BC048403
  gRNA
gugauagaccuucucagccg

SEQ ID NO: 6335 - RNA, 20 nt, Artificial Sequence
  MKO10006335_A_BC048403
  gRNA
cgcaggcgcagaucucggag

SEQ ID NO: 6336 - RNA, 20 nt, Artificial Sequence
  MKO10006336_A_BC048502
  gRNA
ugacucgagagaccuacaag

SEQ ID NO: 6337 - RNA, 20 nt, Artificial Sequence
  MKO10006337_A_BC048502
  gRNA
ucacccacguuccagacauc

SEQ ID NO: 6338 - RNA, 20 nt, Artificial Sequence
  MKO10006338_A_BC048502
  gRNA
aauuuccugacccugauguc

SEQ ID NO: 6339 - RNA, 20 nt, Artificial Sequence
  MKO10006339_A_BC048507
  gRNA
ccgcgguaaccaugugcgau

SEQ ID NO: 6340 - RNA, 20 nt, Artificial Sequence
  MKO10006340_A_BC048507
  gRNA
cacugccuuccgaucgcaca

SEQ ID NO: 6341 - RNA, 20 nt, Artificial Sequence
  MKO10006341_A_BC048507
  gRNA
ucacguaacuaccgaaguuc

SEQ ID NO: 6342 - RNA, 20 nt, Artificial Sequence
  MKO10006342_A_BC048546
  gRNA
guaucccuugaucaccguuc

SEQ ID NO: 6343 - RNA, 20 nt, Artificial Sequence
  MKO10006343_A_BC048546
  gRNA
auauucuagggugacgcuca

SEQ ID NO: 6344 - RNA, 20 nt, Artificial Sequence
  MKO10006344_A_BC048546
  gRNA
guagaaguuccccucgucca

SEQ ID NO: 6345 - RNA, 20 nt, Artificial Sequence
  MKO10006345_A_BC048562
  gRNA
auugagccaacagccgccuc

SEQ ID NO: 6346 - RNA, 20 nt, Artificial Sequence
  MKO10006346_A_BC048562
  gRNA
uggucauugugguagcgcca

SEQ ID NO: 6347 - RNA, 20 nt, Artificial Sequence
  MKO10006347_A_BC048562
  gRNA
ucucacucuugacuugaccu

SEQ ID NO: 6348 - RNA, 20 nt, Artificial Sequence
  MKO10006348_A_BC048609
  gRNA
ccacaugagcuuccguuaca

SEQ ID NO: 6349 - RNA, 20 nt, Artificial Sequence
  MKO10006349_A_BC048609
  gRNA
cuaucaguacaaccguguaa

SEQ ID NO: 6350 - RNA, 20 nt, Artificial Sequence
  MKO10006350_A_BC048609
  gRNA
cccagccgaugcugaucacc

SEQ ID NO: 6351 - RNA, 20 nt, Artificial Sequence
  MKO10006351_A_BC048644
  gRNA
uaacgcggcgugacuacuga

SEQ ID NO: 6352 - RNA, 20 nt, Artificial Sequence
  MKO10006352_A_BC048644
  gRNA
caagauccgaauguuguacg

SEQ ID NO: 6353 - RNA, 20 nt, Artificial Sequence
  MKO10006353_A_BC048644
  gRNA
accauacgucacguaugaag

SEQ ID NO: 6354 - RNA, 20 nt, Artificial Sequence
  MKO10006354_A_BC048671
  gRNA
ucggcgcuccgcaagucgca

SEQ ID NO: 6355 - RNA, 20 nt, Artificial Sequence
  MKO10006355_A_BC048671
  gRNA
gcccugccggcauaagaaga

SEQ ID NO: 6356 - RNA, 20 nt, Artificial Sequence
  MKO10006356_A_BC048671
  gRNA
cugaauggccaugcgacuug

SEQ ID NO: 6357 - RNA, 20 nt, Artificial Sequence
  MKO10006357_A_BC048679
  gRNA
uguccauagcuucucgcacg

SEQ ID NO: 6358 - RNA, 20 nt, Artificial Sequence
  MKO10006358_A_BC048679
  gRNA
gagccgcgugcgagaagcua

SEQ ID NO: 6359 - RNA, 20 nt, Artificial Sequence
  MKO10006359_A_BC048679
  gRNA
acaguggugcggggcccacg

SEQ ID NO: 6360 - RNA, 20 nt, Artificial Sequence
  MKO10006360_A_BC048943
  gRNA
uacaaacaaacacgcuacgc

SEQ ID NO: 6361 - RNA, 20 nt, Artificial Sequence
  MKO10006361_A_BC048943
  gRNA
gucuacauagcuugaaaucg

SEQ ID NO: 6362 - RNA, 20 nt, Artificial Sequence
  MKO10006362_A_BC048943
  gRNA
agcuaccgaacaaagacaac

SEQ ID NO: 6363 - RNA, 20 nt, Artificial Sequence
  MKO10006363_A_BC049352
  gRNA
caucccagcaguacccgcgc

SEQ ID NO: 6364 - RNA, 20 nt, Artificial Sequence
  MKO10006364_A_BC049352
  gRNA
uuggccaagugguaccagcg

SEQ ID NO: 6365 - RNA, 20 nt, Artificial Sequence
  MKO10006365_A_BC049352
  gRNA
cacaugagcagcccggaugg

SEQ ID NO: 6366 - RNA, 20 nt, Artificial Sequence
  MKO10006366_A_BC049635
  gRNA
ccuagugauagaacgcuaag

SEQ ID NO: 6367 - RNA, 20 nt, Artificial Sequence
  MKO10006367_A_BC049635
  gRNA
ucaagggucaaaugcguucc

SEQ ID NO: 6368 - RNA, 20 nt, Artificial Sequence
  MKO10006368_A_BC049635
  gRNA
augacagaccgcuuacaucc

SEQ ID NO: 6369 - RNA, 20 nt, Artificial Sequence
  MKO10006369_A_BC049715
  gRNA
cucaacgaaccgauuuauga

SEQ ID NO: 6370 - RNA, 20 nt, Artificial Sequence
  MKO10006370_A_BC049715
  gRNA
ggaucugagucuucaucgug

SEQ ID NO: 6371 - RNA, 20 nt, Artificial Sequence
  MKO10006371_A_BC049715
  gRNA
gaguauggagauaacguuac

SEQ ID NO: 6372 - RNA, 20 nt, Artificial Sequence
  MKO10006372_A_BC049730
  gRNA
uggaucguaaaucagacagu

SEQ ID NO: 6373 - RNA, 20 nt, Artificial Sequence
  MKO10006373_A_BC049730
  gRNA
ucccgagcaucuuacugacc

SEQ ID NO: 6374 - RNA, 20 nt, Artificial Sequence
  MKO10006374_A_BC049730
  gRNA
caaccauaccuugugcccua

SEQ ID NO: 6375 - RNA, 20 nt, Artificial Sequence
  MKO10006375_A_BC049762
  gRNA
aucaggguguuauuccgcgg

SEQ ID NO: 6376 - RNA, 20 nt, Artificial Sequence
  MKO10006376_A_BC049762
  gRNA
gccacgguugcuggaagcua

SEQ ID NO: 6377 - RNA, 20 nt, Artificial Sequence
  MKO10006377_A_BC049762
  gRNA
gaguccugugcagaucucgc

SEQ ID NO: 6378 - RNA, 20 nt, Artificial Sequence
  MKO10006378_A_BC051019
  gRNA
cgucaggugggugcccccca

SEQ ID NO: 6379 - RNA, 20 nt, Artificial Sequence
  MKO10006379_A_BC051019
  gRNA
aaugggccugaaccaccgcc

SEQ ID NO: 6380 - RNA, 20 nt, Artificial Sequence
  MKO10006380_A_BC051019
  gRNA
auggccggggcuccgcuggc

SEQ ID NO: 6381 - RNA, 20 nt, Artificial Sequence
  MKO10006381_A_BC051142
  gRNA
acucuguucugaagcgaauc

SEQ ID NO: 6382 - RNA, 20 nt, Artificial Sequence
  MKO10006382_A_BC051142
  gRNA
ugacuauucugauagcaaga

SEQ ID NO: 6383 - RNA, 20 nt, Artificial Sequence
  MKO10006383_A_BC051142
  gRNA
aaccggaagauggcagaucu

SEQ ID NO: 6384 - RNA, 20 nt, Artificial Sequence
  MKO10006384_A_BC051628
  gRNA
agucaguggcgcaucaggac

SEQ ID NO: 6385 - RNA, 20 nt, Artificial Sequence
  MKO10006385_A_BC051628
  gRNA
agaugccaguuauguucgac

SEQ ID NO: 6386 - RNA, 20 nt, Artificial Sequence
  MKO10006386_A_BC051628
  gRNA
cucuuguucuagaguccagc

SEQ ID NO: 6387 - RNA, 20 nt, Artificial Sequence
  MKO10006387_A_BC051665
  gRNA
uacccaggcuucauaugcgu

SEQ ID NO: 6388 - RNA, 20 nt, Artificial Sequence
  MKO10006388_A_BC051665
  gRNA
uccugguccuauggcaacgu

SEQ ID NO: 6389 - RNA, 20 nt, Artificial Sequence
  MKO10006389_A_BC051665
  gRNA
ucagauaguccucguugugc

SEQ ID NO: 6390 - RNA, 20 nt, Artificial Sequence
  MKO10006390_A_BC052040
  gRNA
uagugucuguaccgcccacu

SEQ ID NO: 6391 - RNA, 20 nt, Artificial Sequence
  MKO10006391_A_BC052040
  gRNA
uaguaacuuucaaucgcuuc

SEQ ID NO: 6392 - RNA, 20 nt, Artificial Sequence
  MKO10006392_A_BC052040
  gRNA
ugucuaccuagguaccugaa

SEQ ID NO: 6393 - RNA, 20 nt, Artificial Sequence
  MKO10006393_A_BC053393
  gRNA
uaagagcauggaagcgucac

SEQ ID NO: 6394 - RNA, 20 nt, Artificial Sequence
  MKO10006394_A_BC053393
  gRNA
ucgacuuaccuuggagauuc

SEQ ID NO: 6395 - RNA, 20 nt, Artificial Sequence
  MKO10006395_A_BC053393
  gRNA
uaucagaagcgcauucgccu

SEQ ID NO: 6396 - RNA, 20 nt, Artificial Sequence
  MKO10006396_A_BC053749
  gRNA
cucguugucaauuaaguugc

SEQ ID NO: 6397 - RNA, 20 nt, Artificial Sequence
  MKO10006397_A_BC053749
  gRNA
cugcaacuuaauugacaacg

SEQ ID NO: 6398 - RNA, 20 nt, Artificial Sequence
  MKO10006398_A_BC053749
  gRNA
cuggcgguccucucugcucg

SEQ ID NO: 6399 - RNA, 20 nt, Artificial Sequence
  MKO10006399_A_BC055111
  gRNA
gccgaguggcuucgugggcc

SEQ ID NO: 6400 - RNA, 20 nt, Artificial Sequence
  MKO10006400_A_BC055111
  gRNA
gucagaaugugagcgguucc

SEQ ID NO: 6401 - RNA, 20 nt, Artificial Sequence
  MKO10006401_A_BC055111
  gRNA
ucuggggagacacguuuccg

SEQ ID NO: 6402 - RNA, 20 nt, Artificial Sequence
  MKO10006402_A_BC055324
  gRNA
aagugcauuugugcacugua

SEQ ID NO: 6403 - RNA, 20 nt, Artificial Sequence
  MKO10006403_A_BC055324
  gRNA
ucauaugaaccaccugacac

SEQ ID NO: 6404 - RNA, 20 nt, Artificial Sequence
  MKO10006404_A_BC055324
  gRNA
acuguaccuuugguaaaacu

SEQ ID NO: 6405 - RNA, 20 nt, Artificial Sequence
  MKO10006405_A_BC056474
  gRNA
caggcucucuaucuccgccg

SEQ ID NO: 6406 - RNA, 20 nt, Artificial Sequence
  MKO10006406_A_BC056474
  gRNA
ugauauaaaacuuuccgcuc

SEQ ID NO: 6407 - RNA, 20 nt, Artificial Sequence
  MKO10006407_A_BC056474
  gRNA
ugcucaccucagcacuuugu

SEQ ID NO: 6408 - RNA, 20 nt, Artificial Sequence
  MKO10006408_A_BC061194
  gRNA
ugcuaagucaucguuguagu

SEQ ID NO: 6409 - RNA, 20 nt, Artificial Sequence
  MKO10006409_A_BC061194
  gRNA
cacagaacugucgcaagcug

SEQ ID NO: 6410 - RNA, 20 nt, Artificial Sequence
  MKO10006410_A_BC061194
  gRNA
agcugcguuugugcugcgag

SEQ ID NO: 6411 - RNA, 20 nt, Artificial Sequence
  MKO10006411_A_BC061212
  gRNA
ucuccagaaucugacauuga

SEQ ID NO: 6412 - RNA, 20 nt, Artificial Sequence
  MKO10006412_A_BC061212
  gRNA
uccaucuagcacagccugca

SEQ ID NO: 6413 - RNA, 20 nt, Artificial Sequence
  MKO10006413_A_BC061212
  gRNA
ucccgacaggggaaaacuuc

SEQ ID NO: 6414 - RNA, 20 nt, Artificial Sequence
  MKO10006414_A_BC061237
  gRNA
gcagccuccgccuuacuucc

SEQ ID NO: 6415 - RNA, 20 nt, Artificial Sequence
  MKO10006415_A_BC061237
  gRNA
agaucaaagacaaauauagc

SEQ ID NO: 6416 - RNA, 20 nt, Artificial Sequence
  MKO10006416_A_BC061237
  gRNA
ccacagaaaaucaguucuac

SEQ ID NO: 6417 - RNA, 20 nt, Artificial Sequence
  MKO10006417_A_BC068157
  gRNA
agcccguccaguacgcugag

SEQ ID NO: 6418 - RNA, 20 nt, Artificial Sequence
  MKO10006418_A_BC068157
  gRNA
agcuccgcggcuacgauagu

SEQ ID NO: 6419 - RNA, 20 nt, Artificial Sequence
  MKO10006419_A_BC068157
  gRNA
uccgcuuagcgaugcugaau

SEQ ID NO: 6420 - RNA, 20 nt, Artificial Sequence
  MKO10006420_A_BC068281
  gRNA
ccccgcauauccacccucgc

SEQ ID NO: 6421 - RNA, 20 nt, Artificial Sequence
  MKO10006421_A_BC068281
  gRNA
gguccacccaacggugacga

SEQ ID NO: 6422 - RNA, 20 nt, Artificial Sequence
  MKO10006422_A_BC068281
  gRNA
aguaccguucaacagauguu

SEQ ID NO: 6423 - RNA, 20 nt, Artificial Sequence
  MKO10006423_A_BC080695
  gRNA
ccucgugugucugucaauga

SEQ ID NO: 6424 - RNA, 20 nt, Artificial Sequence
  MKO10006424_A_BC080695
  gRNA
ccuucauugacagacacacg

SEQ ID NO: 6425 - RNA, 20 nt, Artificial Sequence
  MKO10006425_A_BC080695
  gRNA
aguuggaauugcauauaggc

SEQ ID NO: 6426 - RNA, 20 nt, Artificial Sequence
  MKO10006426_A_BC089491
  gRNA
guccggucugaagaaacuug

SEQ ID NO: 6427 - RNA, 20 nt, Artificial Sequence
  MKO10006427_A_BC089491
  gRNA
cccgaaggccauagcuucag

SEQ ID NO: 6428 - RNA, 20 nt, Artificial Sequence
  MKO10006428_A_BC089491
  gRNA
cucaguacauuauacugaaa

SEQ ID NO: 6429 - RNA, 20 nt, Artificial Sequence
  MKO10006429_A_BC089597
  gRNA
gccucucucuaaaaaagcgc

SEQ ID NO: 6430 - RNA, 20 nt, Artificial Sequence
  MKO10006430_A_BC089597
  gRNA
aggagggagcuccgcuacuu

SEQ ID NO: 6431 - RNA, 20 nt, Artificial Sequence
  MKO10006431_A_BC089597
  gRNA
ccagcugaguaucucgugcg

SEQ ID NO: 6432 - RNA, 20 nt, Artificial Sequence
  MKO10006432_A_BC094916
  gRNA
augaucuuguuggaguuucg

SEQ ID NO: 6433 - RNA, 20 nt, Artificial Sequence
  MKO10006433_A_BC094916
  gRNA
aacagcauauagcagugccc

SEQ ID NO: 6434 - RNA, 20 nt, Artificial Sequence
  MKO10006434_A_BC094916
  gRNA
uuugcaucagcuaaaaggaa

SEQ ID NO: 6435 - RNA, 20 nt, Artificial Sequence
  MKO10006435_A_BC100451
  gRNA
aagaacgccgggcgcguaga

SEQ ID NO: 6436 - RNA, 20 nt, Artificial Sequence
  MKO10006436_A_BC100451
  gRNA
agcgcauccgucuacgcgcc

SEQ ID NO: 6437 - RNA, 20 nt, Artificial Sequence
  MKO10006437_A_BC100451
  gRNA
ccggcugcagcagguccgac

SEQ ID NO: 6438 - RNA, 20 nt, Artificial Sequence
  MKO10006438_A_BC100530
  gRNA
cucaucaagaugagucucgg

SEQ ID NO: 6439 - RNA, 20 nt, Artificial Sequence
  MKO10006439_A_BC100530
  gRNA
ucaccuugucagcaaucuuc

SEQ ID NO: 6440 - RNA, 20 nt, Artificial Sequence
  MKO10006440_A_BC100530
  gRNA
uauaaaacucaagccgucgc

SEQ ID NO: 6441 - RNA, 20 nt, Artificial Sequence
  MKO10006441_A_BC107364
  gRNA
aaacagaacccgacguguca

SEQ ID NO: 6442 - RNA, 20 nt, Artificial Sequence
  MKO10006442_A_BC107364
  gRNA
gccagcacgucuauauuccc

SEQ ID NO: 6443 - RNA, 20 nt, Artificial Sequence
  MKO10006443_A_BC107364
  gRNA
accagggaauauagacgugc

SEQ ID NO: 6444 - RNA, 20 nt, Artificial Sequence
  MKO10006444_A_BC117090
  gRNA
guaggucaacucgucauccu

SEQ ID NO: 6445 - RNA, 20 nt, Artificial Sequence
  MKO10006445_A_BC117090
  gRNA
uauguacggagguguuucag

SEQ ID NO: 6446 - RNA, 20 nt, Artificial Sequence
  MKO10006446_A_BC117090
  gRNA
uuaccagacugacaaagcca

SEQ ID NO: 6447 - RNA, 20 nt, Artificial Sequence
  MKO10006447_A_BC147527
  gRNA
uaaauuugugguaggaaucc

SEQ ID NO: 6448 - RNA, 20 nt, Artificial Sequence
  MKO10006448_A_BC147527
  gRNA
auccugcaucuuacagugcc

SEQ ID NO: 6449 - RNA, 20 nt, Artificial Sequence
  MKO10006449_A_BC147527
  gRNA
ugccuggcacuguaagaugc

SEQ ID NO: 6450 - RNA, 20 nt, Artificial Sequence
  MKO10006450_A_Baalc
  gRNA
uaguugaaacagauaucgag

SEQ ID NO: 6451 - RNA, 20 nt, Artificial Sequence
  MKO10006451_A_Baalc
  gRNA
uuccgauuuguugcuccguu

SEQ ID NO: 6452 - RNA, 20 nt, Artificial Sequence
  MKO10006452_A_Baalc
  gRNA
gcuauuccacccggggcugc

SEQ ID NO: 6453 - RNA, 20 nt, Artificial Sequence
  MKO10006453_A_Baau
  gRNA
ugaugaccugccuucucgac

SEQ ID NO: 6454 - RNA, 20 nt, Artificial Sequence
  MKO10006454_A_Baau
  gRNA
agguaaaggaaagccgcauc

SEQ ID NO: 6455 - RNA, 20 nt, Artificial Sequence
  MKO10006455_A_Baau
  gRNA
ucuaccuucuccagucgaga

SEQ ID NO: 6456 - RNA, 20 nt, Artificial Sequence
  MKO10006456_A_Babam1
  gRNA
uagugaaugacgacuccgcc

SEQ ID NO: 6457 - RNA, 20 nt, Artificial Sequence
  MKO10006457_A_Babam1
  gRNA
acgccgucuccaggucauac

SEQ ID NO: 6458 - RNA, 20 nt, Artificial Sequence
  MKO10006458_A_Babam1
  gRNA
caagagccacgaauuugcac

SEQ ID NO: 6459 - RNA, 20 nt, Artificial Sequence
  MKO10006459_A_Bace1
  gRNA
cacauaucgagaccuccgaa

SEQ ID NO: 6460 - RNA, 20 nt, Artificial Sequence
  MKO10006460_A_Bace1
  gRNA
auccggcugccccuucgcag

SEQ ID NO: 6461 - RNA, 20 nt, Artificial Sequence
  MKO10006461_A_Bace1
  gRNA
gccacagcccgacgacucuu

SEQ ID NO: 6462 - RNA, 20 nt, Artificial Sequence
  MKO10006462_A_Bace2
  gRNA
cugguauaccccaauuaaag

SEQ ID NO: 6463 - RNA, 20 nt, Artificial Sequence
  MKO10006463_A_Bace2
  gRNA
acccacaagacuaccuccgu

SEQ ID NO: 6464 - RNA, 20 nt, Artificial Sequence
  MKO10006464_A_Bace2
  gRNA
uggaagcaguaacuucgcug

SEQ ID NO: 6465 - RNA, 20 nt, Artificial Sequence
  MKO10006465_A_Bach1
  gRNA
ccucuugcgacagcguugcg

SEQ ID NO: 6466 - RNA, 20 nt, Artificial Sequence
  MKO10006466_A_Bach1
  gRNA
gcgguuccgagcccaccgcu

SEQ ID NO: 6467 - RNA, 20 nt, Artificial Sequence
  MKO10006467_A_Bach1
  gRNA
ucuggccuacgauucucgag

SEQ ID NO: 6468 - RNA, 20 nt, Artificial Sequence
  MKO10006468_A_Bach2
  gRNA
guguugggccguauccuucc

SEQ ID NO: 6469 - RNA, 20 nt, Artificial Sequence
  MKO10006469_A_Bach2
  gRNA
cgguuggucacacgcgcuug

SEQ ID NO: 6470 - RNA, 20 nt, Artificial Sequence
  MKO10006470_A_Bach2
  gRNA
cugugacgugacgcugaucg

SEQ ID NO: 6471 - RNA, 20 nt, Artificial Sequence
  MKO10006471_A_Bad
  gRNA
gaacgcgagcguccucgaaa

SEQ ID NO: 6472 - RNA, 20 nt, Artificial Sequence
  MKO10006472_A_Bad
  gRNA
cgaucccggaauccggagcc

SEQ ID NO: 6473 - RNA, 20 nt, Artificial Sequence
  MKO10006473_A_Bad
  gRNA
gcuacggccgugagcuccga

SEQ ID NO: 6474 - RNA, 20 nt, Artificial Sequence
  MKO10006474_A_Bag1
  gRNA
ggugacgaucacgcugaguc

SEQ ID NO: 6475 - RNA, 20 nt, Artificial Sequence
  MKO10006475_A_Bag1
  gRNA
caacaagcugagccaagucu

SEQ ID NO: 6476 - RNA, 20 nt, Artificial Sequence
  MKO10006476_A_Bag1
  gRNA
gcucuuuauucaauucuugc

SEQ ID NO: 6477 - RNA, 20 nt, Artificial Sequence
  MKO10006477_A_Bag2
  gRNA
caccucgucuauaauccucg

SEQ ID NO: 6478 - RNA, 20 nt, Artificial Sequence
  MKO10006478_A_Bag2
  gRNA
aggcggcaccuccgaugagc

SEQ ID NO: 6479 - RNA, 20 nt, Artificial Sequence
  MKO10006479_A_Bag2
  gRNA
ggucggccauggaagacgag

SEQ ID NO: 6480 - RNA, 20 nt, Artificial Sequence
  MKO10006480_A_Bag3
  gRNA
ucugucaugccgccacguaa

SEQ ID NO: 6481 - RNA, 20 nt, Artificial Sequence
  MKO10006481_A_Bag3
  gRNA
aucaaaaucgacccgcagac

SEQ ID NO: 6482 - RNA, 20 nt, Artificial Sequence
  MKO10006482_A_Bag3
  gRNA
ggugcagcgauuucguaccg

SEQ ID NO: 6483 - RNA, 20 nt, Artificial Sequence
  MKO10006483_A_Bag4
  gRNA
cggcucaggccuugacccga

SEQ ID NO: 6484 - RNA, 20 nt, Artificial Sequence
  MKO10006484_A_Bag4
  gRNA
ugacggaaagugcuucaccg

SEQ ID NO: 6485 - RNA, 20 nt, Artificial Sequence
  MKO10006485_A_Bag4
  gRNA
gacgaccacaagacgaugcc

SEQ ID NO: 6486 - RNA, 20 nt, Artificial Sequence
  MKO10006486_A_Bag5
  gRNA
cugacgcacgugaagaccgg

SEQ ID NO: 6487 - RNA, 20 nt, Artificial Sequence
  MKO10006487_A_Bag5
  gRNA
ugauaagaacuacauccguc

SEQ ID NO: 6488 - RNA, 20 nt, Artificial Sequence
  MKO10006488_A_Bag5
  gRNA
ucagguccagguacgugauc

SEQ ID NO: 6489 - RNA, 20 nt, Artificial Sequence
  MKO10006489_A_Bag6
  gRNA
ugauagugccaguaccgcua

SEQ ID NO: 6490 - RNA, 20 nt, Artificial Sequence
  MKO10006490_A_Bag6
  gRNA
gcgguacuggcacuaucacu

SEQ ID NO: 6491 - RNA, 20 nt, Artificial Sequence
  MKO10006491_A_Bag6
  gRNA
caccuccauccgggacagua

SEQ ID NO: 6492 - RNA, 20 nt, Artificial Sequence
  MKO10006492_A_Bahcc1
  gRNA
cgagacgaaacgcaaguccg

SEQ ID NO: 6493 - RNA, 20 nt, Artificial Sequence
  MKO10006493_A_Bahcc1
  gRNA
accgaccauggugcacccua

SEQ ID NO: 6494 - RNA, 20 nt, Artificial Sequence
  MKO10006494_A_Bahcc1
  gRNA
uguaacagcagcucacgucc

SEQ ID NO: 6495 - RNA, 20 nt, Artificial Sequence
  MKO10006495_A_Bahd1
  gRNA
ccgagaugggcgucugaaga

SEQ ID NO: 6496 - RNA, 20 nt, Artificial Sequence
  MKO10006496_A_Bahd1
  gRNA
ugccauccgaaagaguuacc

SEQ ID NO: 6497 - RNA, 20 nt, Artificial Sequence
  MKO10006497_A_Bahd1
  gRNA
uuacaggccugagcacuuac

SEQ ID NO: 6498 - RNA, 20 nt, Artificial Sequence
  MKO10006498_A_Bai1
  gRNA
auguagagcguguaacgacg

SEQ ID NO: 6499 - RNA, 20 nt, Artificial Sequence
  MKO10006499_A_Bai1
  gRNA
aagugcggguucgaguuugc

SEQ ID NO: 6500 - RNA, 20 nt, Artificial Sequence
  MKO10006500_A_Bai1
  gRNA
ccgcguacauucgccccaca

SEQ ID NO: 6501 - RNA, 20 nt, Artificial Sequence
  MKO10006501_A_Bai2
  gRNA
ggccccguagagcacgcccg

SEQ ID NO: 6502 - RNA, 20 nt, Artificial Sequence
  MKO10006502_A_Bai2
  gRNA
gugcagcaaucucgauugcc

SEQ ID NO: 6503 - RNA, 20 nt, Artificial Sequence
  MKO10006503_A_Bai2
  gRNA
uccuugcagugcacggcgug

SEQ ID NO: 6504 - RNA, 20 nt, Artificial Sequence
  MKO10006504_A_Bai3
  gRNA
ccgcugcagugugucccgua

SEQ ID NO: 6505 - RNA, 20 nt, Artificial Sequence
  MKO10006505_A_Bai3
  gRNA
cuuugguaguugacggacag

SEQ ID NO: 6506 - RNA, 20 nt, Artificial Sequence
  MKO10006506_A_Bai3
  gRNA
gcggcccauuaagagaauca

SEQ ID NO: 6507 - RNA, 20 nt, Artificial Sequence
  MKO10006507_A_Baiap2l1
  gRNA
aaaagccuacuacgacggcg

SEQ ID NO: 6508 - RNA, 20 nt, Artificial Sequence
  MKO10006508_A_Baiap2l1
  gRNA
uuuauuaaguuccguagucc

SEQ ID NO: 6509 - RNA, 20 nt, Artificial Sequence
  MKO10006509_A_Baiap2l1
  gRNA
ucaccuagcucuguugacac

SEQ ID NO: 6510 - RNA, 20 nt, Artificial Sequence
  MKO10006510_A_Baiap2l2
  gRNA
ggagcaguuuaaucccgccc

SEQ ID NO: 6511 - RNA, 20 nt, Artificial Sequence
  MKO10006511_A_Baiap2l2
  gRNA
gagcuccacaucgcagauuc

SEQ ID NO: 6512 - RNA, 20 nt, Artificial Sequence
  MKO10006512_A_Baiap2l2
  gRNA
accugggcaacaacuaccuc

SEQ ID NO: 6513 - RNA, 20 nt, Artificial Sequence
  MKO10006513_A_Baiap2
  gRNA
cuccgagcgugaaagcgaca

SEQ ID NO: 6514 - RNA, 20 nt, Artificial Sequence
  MKO10006514_A_Baiap2
  gRNA
gaccaugucgcuuucacgcu

SEQ ID NO: 6515 - RNA, 20 nt, Artificial Sequence
  MKO10006515_A_Baiap2
  gRNA
gccggugcaccucagccauc

SEQ ID NO: 6516 - RNA, 20 nt, Artificial Sequence
  MKO10006516_A_Baiap3
  gRNA
aggccacgauugggauccac

SEQ ID NO: 6517 - RNA, 20 nt, Artificial Sequence
  MKO10006517_A_Baiap3
  gRNA
agaccuccucgucaucuacc

SEQ ID NO: 6518 - RNA, 20 nt, Artificial Sequence
  MKO10006518_A_Baiap3
  gRNA
ggauuccuuaccucaggaca

SEQ ID NO: 6519 - RNA, 20 nt, Artificial Sequence
  MKO10006519_A_Bak1
  gRNA
ugcaucauuacaucgccaga

SEQ ID NO: 6520 - RNA, 20 nt, Artificial Sequence
  MKO10006520_A_Bak1
  gRNA
caaguuguccaucucggggu

SEQ ID NO: 6521 - RNA, 20 nt, Artificial Sequence
  MKO10006521_A_Bak1
  gRNA
gccucucugugcgauccauc

SEQ ID NO: 6522 - RNA, 20 nt, Artificial Sequence
  MKO10006522_A_Bambi
  gRNA
gaaccgcuaucacagcugcg

SEQ ID NO: 6523 - RNA, 20 nt, Artificial Sequence
  MKO10006523_A_Bambi
  gRNA
cucacuucgaagcauucgca

SEQ ID NO: 6524 - RNA, 20 nt, Artificial Sequence
  MKO10006524_A_Bambi
  gRNA
gaagacaugugcaauuaucg

SEQ ID NO: 6525 - RNA, 20 nt, Artificial Sequence
  MKO10006525_A_Banf1
  gRNA
augaagaccucuuccgagaa

SEQ ID NO: 6526 - RNA, 20 nt, Artificial Sequence
  MKO10006526_A_Banf1
  gRNA
aucccggccaggcuccccac

SEQ ID NO: 6527 - RNA, 20 nt, Artificial Sequence
  MKO10006527_A_Banf1
  gRNA
uuggugacguccugagcaag

SEQ ID NO: 6528 - RNA, 20 nt, Artificial Sequence
  MKO10006528_A_Banf2
  gRNA
agauggacgacaugucgccc

SEQ ID NO: 6529 - RNA, 20 nt, Artificial Sequence
  MKO10006529_A_Banf2
  gRNA
ccgugaacuugccaucaauu

SEQ ID NO: 6530 - RNA, 20 nt, Artificial Sequence
  MKO10006530_A_Banf2
  gRNA
agcagcagaugauccaccuc

SEQ ID NO: 6531 - RNA, 20 nt, Artificial Sequence
  MKO10006531_A_Bank1
  gRNA
acacucuuauuccaacgugc

SEQ ID NO: 6532 - RNA, 20 nt, Artificial Sequence
  MKO10006532_A_Bank1
  gRNA
ccgugcucugaggcgcuugu

SEQ ID NO: 6533 - RNA, 20 nt, Artificial Sequence
  MKO10006533_A_Bank1
  gRNA
accucacauggaauuucccc

SEQ ID NO: 6534 - RNA, 20 nt, Artificial Sequence
  MKO10006534_A_Banp
  gRNA
ggaacgcaccuucggaguuc

SEQ ID NO: 6535 - RNA, 20 nt, Artificial Sequence
  MKO10006535_A_Banp
  gRNA
ccaaccgcaaacauaucguc

SEQ ID NO: 6536 - RNA, 20 nt, Artificial Sequence
  MKO10006536_A_Banp
  gRNA
gcgucggcagaacaccaucg

SEQ ID NO: 6537 - RNA, 20 nt, Artificial Sequence
  MKO10006537_A_Bap1
  gRNA
ucaaauggaucgaagagcgc

SEQ ID NO: 6538 - RNA, 20 nt, Artificial Sequence
  MKO10006538_A_Bap1
  gRNA
ccgccgcaagguuucuacgu

SEQ ID NO: 6539 - RNA, 20 nt, Artificial Sequence
  MKO10006539_A_Bap1
  gRNA
gcccacgcugagccgaauga

SEQ ID NO: 6540 - RNA, 20 nt, Artificial Sequence
  MKO10006540_A_Bard1
  gRNA
uguguaaaagaucuucguuc

SEQ ID NO: 6541 - RNA, 20 nt, Artificial Sequence
  MKO10006541_A_Bard1
  gRNA
ccucaagauaaaccgacaau

SEQ ID NO: 6542 - RNA, 20 nt, Artificial Sequence
  MKO10006542_A_Bard1
  gRNA
gcuugcagaaaacguagugu

SEQ ID NO: 6543 - RNA, 20 nt, Artificial Sequence
  MKO10006543_A_Barhl1
  gRNA
gccgcacucuaucuguaccg

SEQ ID NO: 6544 - RNA, 20 nt, Artificial Sequence
  MKO10006544_A_Barhl1
  gRNA
uuggccgcaaggcggccccc

SEQ ID NO: 6545 - RNA, 20 nt, Artificial Sequence
  MKO10006545_A_Barhl1
  gRNA
ccugagcgugcaagaccgca

SEQ ID NO: 6546 - RNA, 20 nt, Artificial Sequence
  MKO10006546_A_Barhl2
  gRNA
uccgaucgcucggugaagcg

SEQ ID NO: 6547 - RNA, 20 nt, Artificial Sequence
  MKO10006547_A_Barhl2
  gRNA
uauuccaaaacucgacccgc

SEQ ID NO: 6548 - RNA, 20 nt, Artificial Sequence
  MKO10006548_A_Barhl2
  gRNA
gugcggccgccagguccauu

SEQ ID NO: 6549 - RNA, 20 nt, Artificial Sequence
  MKO10006549_A_Barx1
  gRNA
gcccagcgaccgaaauugcg

SEQ ID NO: 6550 - RNA, 20 nt, Artificial Sequence
  MKO10006550_A_Barx1
  gRNA
acgcucaguccucgcaauuu

SEQ ID NO: 6551 - RNA, 20 nt, Artificial Sequence
  MKO10006551_A_Barx1
  gRNA
gaacuugagcagcucgcccg

SEQ ID NO: 6552 - RNA, 20 nt, Artificial Sequence
  MKO10006552_A_Barx2
  gRNA
gaaagucuuguagcgccgcc

SEQ ID NO: 6553 - RNA, 20 nt, Artificial Sequence
  MKO10006553_A_Barx2
  gRNA
cuacucugugugcccgucgc

SEQ ID NO: 6554 - RNA, 20 nt, Artificial Sequence
  MKO10006554_A_Barx2
  gRNA
uucuucuuagggcgccccuu

SEQ ID NO: 6555 - RNA, 20 nt, Artificial Sequence
  MKO10006555_A_Basp1
  gRNA
gcucucggcgcucgcuucgc

SEQ ID NO: 6556 - RNA, 20 nt, Artificial Sequence
  MKO10006556_A_Basp1
  gRNA
cuccucggugcccgcgccuu

SEQ ID NO: 6557 - RNA, 20 nt, Artificial Sequence
  MKO10006557_A_Basp1
  gRNA
gaaaagcgacgcggccccgg

SEQ ID NO: 6558 - RNA, 20 nt, Artificial Sequence
  MKO10006558_A_Bauf2
  gRNA
gugcagagcguccgccuuac

SEQ ID NO: 6559 - RNA, 20 nt, Artificial Sequence
  MKO10006559_A_Bauf2
  gRNA
ggaucuccuuccgaagggcg

SEQ ID NO: 6560 - RNA, 20 nt, Artificial Sequence
  MKO10006560_A_Bauf2
  gRNA
ugugcuucugccggcugcgc

SEQ ID NO: 6561 - RNA, 20 nt, Artificial Sequence
  MKO10006561_A_Bauf3
  gRNA
gagcgcgcggcaugucgcaa

SEQ ID NO: 6562 - RNA, 20 nt, Artificial Sequence
  MKO10006562_A_Bauf3
  gRNA
agagccccaaggacgaugac

SEQ ID NO: 6563 - RNA, 20 nt, Artificial Sequence
  MKO10006563_A_Bauf3
  gRNA
gcuccuucagcaccucgcuc

SEQ ID NO: 6564 - RNA, 20 nt, Artificial Sequence
  MKO10006564_A_Bauf
  gRNA
gaaagccgacacccuucacc

SEQ ID NO: 6565 - RNA, 20 nt, Artificial Sequence
  MKO10006565_A_Bauf
  gRNA
augggcacuguauaccaccu

SEQ ID NO: 6566 - RNA, 20 nt, Artificial Sequence
  MKO10006566_A_Bauf
  gRNA
acucaccaggugaagggugu

SEQ ID NO: 6567 - RNA, 20 nt, Artificial Sequence
  MKO10006567_A_Bax
  gRNA
caacuucaacuggggccgcg

SEQ ID NO: 6568 - RNA, 20 nt, Artificial Sequence
  MKO10006568_A_Bax
  gRNA
ccaguucaucuccaauucgc

SEQ ID NO: 6569 - RNA, 20 nt, Artificial Sequence
  MKO10006569_A_Bax
  gRNA
aguuucauccaggaucgagc

SEQ ID NO: 6570 - RNA, 20 nt, Artificial Sequence
  MKO10006570_A_Baz1a
  gRNA
ugugccgugacggguagacc

SEQ ID NO: 6571 - RNA, 20 nt, Artificial Sequence
  MKO10006571_A_Baz1a
  gRNA
gcaagcgugaacgacgagua

SEQ ID NO: 6572 - RNA, 20 nt, Artificial Sequence
  MKO10006572_A_Baz1a
  gRNA
caucagcgacagugacgacu

SEQ ID NO: 6573 - RNA, 20 nt, Artificial Sequence
  MKO10006573_A_Baz1b
  gRNA
gacuagaugacagagcgcgu

SEQ ID NO: 6574 - RNA, 20 nt, Artificial Sequence
  MKO10006574_A_Baz1b
  gRNA
gaucaugaccaaauaugccg

SEQ ID NO: 6575 - RNA, 20 nt, Artificial Sequence
  MKO10006575_A_Baz1b
  gRNA
agagucgacaagcuucucua

SEQ ID NO: 6576 - RNA, 20 nt, Artificial Sequence
  MKO10006576_A_Baz2a
  gRNA
ucucgaucagcacgcgcuuu

SEQ ID NO: 6577 - RNA, 20 nt, Artificial Sequence
  MKO10006577_A_Baz2a
  gRNA
ggggcuuaacuucgauucac

SEQ ID NO: 6578 - RNA, 20 nt, Artificial Sequence
  MKO10006578_A_Baz2a
  gRNA
aagguugucgguugccccca

SEQ ID NO: 6579 - RNA, 20 nt, Artificial Sequence
  MKO10006579_A_Baz2b
  gRNA
acgauucgucauuccauucg

SEQ ID NO: 6580 - RNA, 20 nt, Artificial Sequence
  MKO10006580_A_Baz2b
  gRNA
ucgucagacaccucgaguga

SEQ ID NO: 6581 - RNA, 20 nt, Artificial Sequence
  MKO10006581_A_Baz2b
  gRNA
gacgaaucgugauucugggc

SEQ ID NO: 6582 - RNA, 20 nt, Artificial Sequence
  MKO10006582_A_Bbc3
  gRNA
gggcacucaccguccgggcg

SEQ ID NO: 6583 - RNA, 20 nt, Artificial Sequence
  MKO10006583_A_Bbc3
  gRNA
gccgcucguacugcgcguug

SEQ ID NO: 6584 - RNA, 20 nt, Artificial Sequence
  MKO10006584_A_Bbc3
  gRNA
gucgcgggcuagacccucua

SEQ ID NO: 6585 - RNA, 20 nt, Artificial Sequence
  MKO10006585_A_Bbip1
  gRNA
gcccuuaaaaucucugacgc

SEQ ID NO: 6586 - RNA, 20 nt, Artificial Sequence
  MKO10006586_A_Bbip1
  gRNA
cgagaaguccuuccaaaaca

SEQ ID NO: 6587 - RNA, 20 nt, Artificial Sequence
  MKO10006587_A_Bbip1
  gRNA
ggguuuacacagcaccauug

SEQ ID NO: 6588 - RNA, 20 nt, Artificial Sequence
  MKO10006588_A_Bbox1
  gRNA
uauucucuccucgaccuuug

SEQ ID NO: 6589 - RNA, 20 nt, Artificial Sequence
  MKO10006589_A_Bbox1
  gRNA
uaacgugugccaaaagcuca

SEQ ID NO: 6590 - RNA, 20 nt, Artificial Sequence
  MKO10006590_A_Bbox1
  gRNA
accggagcagcugacaaacg

SEQ ID NO: 6591 - RNA, 20 nt, Artificial Sequence
  MKO10006591_A_Bbs10
  gRNA
guguuguguacgaagcccac

SEQ ID NO: 6592 - RNA, 20 nt, Artificial Sequence
  MKO10006592_A_Bbs10
  gRNA
gcacucgcuagaguugcucc

SEQ ID NO: 6593 - RNA, 20 nt, Artificial Sequence
  MKO10006593_A_Bbs10
  gRNA
gagcaucgcgaaccgcugcg

SEQ ID NO: 6594 - RNA, 20 nt, Artificial Sequence
  MKO10006594_A_Bbs12
  gRNA
agagcacuacauccaaugcu

SEQ ID NO: 6595 - RNA, 20 nt, Artificial Sequence
  MKO10006595_A_Bbs12
  gRNA
cacagagaguuaccgacacc

SEQ ID NO: 6596 - RNA, 20 nt, Artificial Sequence
  MKO10006596_A_Bbs12
  gRNA
cacccucaaugagaaucacu

SEQ ID NO: 6597 - RNA, 20 nt, Artificial Sequence
  MKO10006597_A_Bbs1
  gRNA
ggacgcacacuacgacccca

SEQ ID NO: 6598 - RNA, 20 nt, Artificial Sequence
  MKO10006598_A_Bbs1
  gRNA
ucauggaccaacacgagccc

SEQ ID NO: 6599 - RNA, 20 nt, Artificial Sequence
  MKO10006599_A_Bbs1
  gRNA
cguuuggaaccaagccaaag

SEQ ID NO: 6600 - RNA, 20 nt, Artificial Sequence
  MKO10006600_A_Bbs2
  gRNA
cugcaggguuucgaucacga

SEQ ID NO: 6601 - RNA, 20 nt, Artificial Sequence
  MKO10006601_A_Bbs2
  gRNA
aacccaggcagcugaccguc

SEQ ID NO: 6602 - RNA, 20 nt, Artificial Sequence
  MKO10006602_A_Bbs2
  gRNA
ucauucauaacccucacacg

SEQ ID NO: 6603 - RNA, 20 nt, Artificial Sequence
  MKO10006603_A_Bbs4
  gRNA
ugauccaucuccacuauauc

SEQ ID NO: 6604 - RNA, 20 nt, Artificial Sequence
  MKO10006604_A_Bbs4
  gRNA
ugcaagcuucauaauccuuc

SEQ ID NO: 6605 - RNA, 20 nt, Artificial Sequence
  MKO10006605_A_Bbs4
  gRNA
gaauaugcuaucuaugucca

SEQ ID NO: 6606 - RNA, 20 nt, Artificial Sequence
  MKO10006606_A_Bbs5
  gRNA
cuucugugaucgcagugcac

SEQ ID NO: 6607 - RNA, 20 nt, Artificial Sequence
  MKO10006607_A_Bbs5
  gRNA
gaucacagaaguaaaaaguc

SEQ ID NO: 6608 - RNA, 20 nt, Artificial Sequence
  MKO10006608_A_Bbs5
  gRNA
auacuuacaaagauugacuc

SEQ ID NO: 6609 - RNA, 20 nt, Artificial Sequence
  MKO10006609_A_Bbs7
  gRNA
aggggccgucaacacgccuc

SEQ ID NO: 6610 - RNA, 20 nt, Artificial Sequence
  MKO10006610_A_Bbs7
  gRNA
auaugcuucggcgugaagaa

SEQ ID NO: 6611 - RNA, 20 nt, Artificial Sequence
  MKO10006611_A_Bbs7
  gRNA
aaaguuaucucgcgugacac

SEQ ID NO: 6612 - RNA, 20 nt, Artificial Sequence
  MKO10006612_A_Bbs9
  gRNA
acggccugcaauaugacgua

SEQ ID NO: 6613 - RNA, 20 nt, Artificial Sequence
  MKO10006613_A_Bbs9
  gRNA
ccgacuuccacuugcagcac

SEQ ID NO: 6614 - RNA, 20 nt, Artificial Sequence
  MKO10006614_A_Bbs9
  gRNA
gggcaccgagaugcuucauc

SEQ ID NO: 6615 - RNA, 20 nt, Artificial Sequence
  MKO10006615_A_Bbx
  gRNA
ccaccgcucccuuguccgac

SEQ ID NO: 6616 - RNA, 20 nt, Artificial Sequence
  MKO10006616_A_Bbx
  gRNA
cuaccaagauacuagcugau

SEQ ID NO: 6617 - RNA, 20 nt, Artificial Sequence
  MKO10006617_A_Bbx
  gRNA
agacuugccaacccccaaga

SEQ ID NO: 6618 - RNA, 20 nt, Artificial Sequence
  MKO10006618_A_Bcam
  gRNA
gggccgcguacccccauacg

SEQ ID NO: 6619 - RNA, 20 nt, Artificial Sequence
  MKO10006619_A_Bcam
  gRNA
gcgaggcgagcaagucgccc

SEQ ID NO: 6620 - RNA, 20 nt, Artificial Sequence
  MKO10006620_A_Bcam
  gRNA
ggacuacgugugcguaguga

SEQ ID NO: 6621 - RNA, 20 nt, Artificial Sequence
  MKO10006621_A_Bcan
  gRNA
gcgauagaccccggaaucau

SEQ ID NO: 6622 - RNA, 20 nt, Artificial Sequence
  MKO10006622_A_Bcan
  gRNA
cgaagccuaccgguuccgcg

SEQ ID NO: 6623 - RNA, 20 nt, Artificial Sequence
  MKO10006623_A_Bcan
  gRNA
cacacugcucauagccgccg

SEQ ID NO: 6624 - RNA, 20 nt, Artificial Sequence
  MKO10006624_A_Bcap29
  gRNA
aucggaagccuucuucagcu

SEQ ID NO: 6625 - RNA, 20 nt, Artificial Sequence
  MKO10006625_A_Bcap29
  gRNA
guucuucucuacaacauucg

SEQ ID NO: 6626 - RNA, 20 nt, Artificial Sequence
  MKO10006626_A_Bcap29
  gRNA
caaugcugaagaacaccuuu

SEQ ID NO: 6627 - RNA, 20 nt, Artificial Sequence
  MKO10006627_A_Bcap31
  gRNA
cugucacaucaucguauuuc

SEQ ID NO: 6628 - RNA, 20 nt, Artificial Sequence
  MKO10006628_A_Bcap31
  gRNA
uggcagccugcuuagacgcc

SEQ ID NO: 6629 - RNA, 20 nt, Artificial Sequence
  MKO10006629_A_Bcap31
  gRNA
cuuucccuagggagcugccg

SEQ ID NO: 6630 - RNA, 20 nt, Artificial Sequence
  MKO10006630_A_Bcar1
  gRNA
gcgcgugcugcccgugcuag

SEQ ID NO: 6631 - RNA, 20 nt, Artificial Sequence
  MKO10006631_A_Bcar1
  gRNA
gguauaugacacgcccccua

SEQ ID NO: 6632 - RNA, 20 nt, Artificial Sequence
  MKO10006632_A_Bcar1
  gRNA
gguggugguuccuacgcgag

SEQ ID NO: 6633 - RNA, 20 nt, Artificial Sequence
  MKO10006633_A_Bcar3
  gRNA
ccacggccggaucccccgac

SEQ ID NO: 6634 - RNA, 20 nt, Artificial Sequence
  MKO10006634_A_Bcar3
  gRNA
cgcgacucccugucgagccc

SEQ ID NO: 6635 - RNA, 20 nt, Artificial Sequence
  MKO10006635_A_Bcar3
  gRNA
ugugcaguaccaauucgaga

SEQ ID NO: 6636 - RNA, 20 nt, Artificial Sequence
  MKO10006636_A_Bcas1
  gRNA
uccccgggacguccugguac

SEQ ID NO: 6637 - RNA, 20 nt, Artificial Sequence
  MKO10006637_A_Bcas1
  gRNA
accagaugagcgucccacua

SEQ ID NO: 6638 - RNA, 20 nt, Artificial Sequence
  MKO10006638_A_Bcas1
  gRNA
cagccgaugaauccgugccu

SEQ ID NO: 6639 - RNA, 20 nt, Artificial Sequence
  MKO10006639_A_Bcas2
  gRNA
ucguucuuaggcggcggccc

SEQ ID NO: 6640 - RNA, 20 nt, Artificial Sequence
  MKO10006640_A_Bcas2
  gRNA
aguuggagcaccaggcgguc

SEQ ID NO: 6641 - RNA, 20 nt, Artificial Sequence
  MKO10006641_A_Bcas2
  gRNA
ucagcuccagauucucgauc

SEQ ID NO: 6642 - RNA, 20 nt, Artificial Sequence
  MKO10006642_A_Bcas3
  gRNA
gacuccgccaguacaacgac

SEQ ID NO: 6643 - RNA, 20 nt, Artificial Sequence
  MKO10006643_A_Bcas3
  gRNA
cggagacccagucguuguac

SEQ ID NO: 6644 - RNA, 20 nt, Artificial Sequence
  MKO10006644_A_Bcas3
  gRNA
agucacgacgcucuccaugu

SEQ ID NO: 6645 - RNA, 20 nt, Artificial Sequence
  MKO10006645_A_Bcau1
  gRNA
gcuccaaagaccagcgaauc

SEQ ID NO: 6646 - RNA, 20 nt, Artificial Sequence
  MKO10006646_A_Bcau1
  gRNA
cacagcguagugcaaaacag

SEQ ID NO: 6647 - RNA, 20 nt, Artificial Sequence
  MKO10006647_A_Bcau1
  gRNA
uacauccgccccacauuuau

SEQ ID NO: 6648 - RNA, 20 nt, Artificial Sequence
  MKO10006648_A_Bcau2
  gRNA
gucaccgacuccgccuaucc

SEQ ID NO: 6649 - RNA, 20 nt, Artificial Sequence
  MKO10006649_A_Bcau2
  gRNA
acggaacgagccucuacgug

SEQ ID NO: 6650 - RNA, 20 nt, Artificial Sequence
  MKO10006650_A_Bcau2
  gRNA
accagcagguacgccucuuc

SEQ ID NO: 6651 - RNA, 20 nt, Artificial Sequence
  MKO10006651_A_Bccip
  gRNA
uccaucucagauaacgauua

SEQ ID NO: 6652 - RNA, 20 nt, Artificial Sequence
  MKO10006652_A_Bccip
  gRNA
gccauaaucguuaucugaga

SEQ ID NO: 6653 - RNA, 20 nt, Artificial Sequence
  MKO10006653_A_Bccip
  gRNA
caucaggagauucgucagcu

SEQ ID NO: 6654 - RNA, 20 nt, Artificial Sequence
  MKO10006654_A_Bcdin3d
  gRNA
auuuccgaacggggcggccc

SEQ ID NO: 6655 - RNA, 20 nt, Artificial Sequence
  MKO10006655_A_Bcdin3d
  gRNA
uacaccccacgucgagcccu

SEQ ID NO: 6656 - RNA, 20 nt, Artificial Sequence
  MKO10006656_A_Bcdin3d
  gRNA
agcacgcuaacuccaucccg

SEQ ID NO: 6657 - RNA, 20 nt, Artificial Sequence
  MKO10006657_A_Bche
  gRNA
agaagucuaccgugacgcuu

SEQ ID NO: 6658 - RNA, 20 nt, Artificial Sequence
  MKO10006658_A_Bche
  gRNA
aucgaucuuccaaacuaccu

SEQ ID NO: 6659 - RNA, 20 nt, Artificial Sequence
  MKO10006659_A_Bche
  gRNA
ggaaggcaggauuucaucgc

SEQ ID NO: 6660 - RNA, 20 nt, Artificial Sequence
  MKO10006660_A_Bckdha
  gRNA
cauucacguugccguagcac

SEQ ID NO: 6661 - RNA, 20 nt, Artificial Sequence
  MKO10006661_A_Bckdha
  gRNA
uccuugcagccguagugaac

SEQ ID NO: 6662 - RNA, 20 nt, Artificial Sequence
  MKO10006662_A_Bckdha
  gRNA
ggaacuggggcuugucgucc

SEQ ID NO: 6663 - RNA, 20 nt, Artificial Sequence
  MKO10006663_A_Bckdhb
  gRNA
gccaaguaucgcuaccgcuc

SEQ ID NO: 6664 - RNA, 20 nt, Artificial Sequence
  MKO10006664_A_Bckdhb
  gRNA
cucguaaaccaacagugcau

SEQ ID NO: 6665 - RNA, 20 nt, Artificial Sequence
  MKO10006665_A_Bckdhb
  gRNA
ccacacaaccccacggggcc

SEQ ID NO: 6666 - RNA, 20 nt, Artificial Sequence
  MKO10006666_A_Bckdk
  gRNA
ggcuacggaagcccuugaug

SEQ ID NO: 6667 - RNA, 20 nt, Artificial Sequence
  MKO10006667_A_Bckdk
  gRNA
ccgccuuaccacaugcagua

SEQ ID NO: 6668 - RNA, 20 nt, Artificial Sequence
  MKO10006668_A_Bckdk
  gRNA
uacagcacgagcuauacauc

SEQ ID NO: 6669 - RNA, 20 nt, Artificial Sequence
  MKO10006669_A_Bcl10
  gRNA
gccgaacuucaaguagaaaa

SEQ ID NO: 6670 - RNA, 20 nt, Artificial Sequence
  MKO10006670_A_Bcl10
  gRNA
uuccccccucuuccaaccga

SEQ ID NO: 6671 - RNA, 20 nt, Artificial Sequence
  MKO10006671_A_Bcl10
  gRNA
ggcucccgcaccgucccuca

SEQ ID NO: 6672 - RNA, 20 nt, Artificial Sequence
  MKO10006672_A_Bcl11a
  gRNA
ggauaccaacccgcgggguc

SEQ ID NO: 6673 - RNA, 20 nt, Artificial Sequence
  MKO10006673_A_Bcl11a
  gRNA
guccuucacacacccccguu

SEQ ID NO: 6674 - RNA, 20 nt, Artificial Sequence
  MKO10006674_A_Bcl11a
  gRNA
cgccgaacggggguguguga

SEQ ID NO: 6675 - RNA, 20 nt, Artificial Sequence
  MKO10006675_A_Bcl11b
  gRNA
cugagucccgucgcccgaga

SEQ ID NO: 6676 - RNA, 20 nt, Artificial Sequence
  MKO10006676_A_Bcl11b
  gRNA
agucgccaucggccgcuuuc

SEQ ID NO: 6677 - RNA, 20 nt, Artificial Sequence
  MKO10006677_A_Bcl11b
  gRNA
ccgcgcccguucacugcacc

SEQ ID NO: 6678 - RNA, 20 nt, Artificial Sequence
  MKO10006678_A_Bcl2a1a
  gRNA
gaauggauacggcagaaugg

SEQ ID NO: 6679 - RNA, 20 nt, Artificial Sequence
  MKO10006679_A_Bcl2a1a
  gRNA
guuuguaagcacauacaucc

SEQ ID NO: 6680 - RNA, 20 nt, Artificial Sequence
  MKO10006680_A_Bcl2a1a
  gRNA
aaaagucagccagccagauu

SEQ ID NO: 6681 - RNA, 20 nt, Artificial Sequence
  MKO10006681_A_Bcl2a1b
  gRNA
agcacucugcaugcuuugcu

SEQ ID NO: 6682 - RNA, 20 nt, Artificial Sequence
  MKO10006682_A_Bcl2a1b
  gRNA
gaauucauaaucaauaacac

SEQ ID NO: 6683 - RNA, 20 nt, Artificial Sequence
  MKO10006683_A_Bcl2a1b
  gRNA
aaaagucagccagccagauu

SEQ ID NO: 6684 - RNA, 20 nt, Artificial Sequence
  MKO10006684_A_Bcl2a1c
  gRNA
agucauccaaguaugacuuu

SEQ ID NO: 6685 - RNA, 20 nt, Artificial Sequence
  MKO10006685_A_Bcl2a1c
  gRNA
gaugaauucugccccaaaac

SEQ ID NO: 6686 - RNA, 20 nt, Artificial Sequence
  MKO10006686_A_Bcl2a1c
  gRNA
uacaaacaaguuuccaguuu

SEQ ID NO: 6687 - RNA, 20 nt, Artificial Sequence
  MKO10006687_A_Bcl2a1d
  gRNA
guucauguauauccacuccc

SEQ ID NO: 6688 - RNA, 20 nt, Artificial Sequence
  MKO10006688_A_Bcl2a1d
  gRNA
uaugaauucugccacaaaac

SEQ ID NO: 6689 - RNA, 20 nt, Artificial Sequence
  MKO10006689_A_Bcl2a1d
  gRNA
aagaaguuugaacccaaauc

SEQ ID NO: 6690 - RNA, 20 nt, Artificial Sequence
  MKO10006690_A_Bcl2l10
  gRNA
auucauaagcguccccgcga

SEQ ID NO: 6691 - RNA, 20 nt, Artificial Sequence
  MKO10006691_A_Bcl2l10
  gRNA
cgucuagugcguucaugcag

SEQ ID NO: 6692 - RNA, 20 nt, Artificial Sequence
  MKO10006692_A_Bcl2l10
  gRNA
uucaagaauccuuuaccgcu

SEQ ID NO: 6693 - RNA, 20 nt, Artificial Sequence
  MKO10006693_A_Bcl2l11
  gRNA
guuugcaaaugauuaccgcg

SEQ ID NO: 6694 - RNA, 20 nt, Artificial Sequence
  MKO10006694_A_Bcl2l11
  gRNA
guuacgcuuuaucuuccguc

SEQ ID NO: 6695 - RNA, 20 nt, Artificial Sequence
  MKO10006695_A_Bcl2l11
  gRNA
ggaaccugaagaucugcgcc

SEQ ID NO: 6696 - RNA, 20 nt, Artificial Sequence
  MKO10006696_A_Bcl2l12
  gRNA
gacaagggaggcaucuucgg

SEQ ID NO: 6697 - RNA, 20 nt, Artificial Sequence
  MKO10006697_A_Bcl2l12
  gRNA
gcaccaauuguuccagccgc

SEQ ID NO: 6698 - RNA, 20 nt, Artificial Sequence
  MKO10006698_A_Bcl2l12
  gRNA
cagcccgucucugccgugcc

SEQ ID NO: 6699 - RNA, 20 nt, Artificial Sequence
  MKO10006699_A_Bcl2l13
  gRNA
ccagguacaucacaccgaac

SEQ ID NO: 6700 - RNA, 20 nt, Artificial Sequence
  MKO10006700_A_Bcl2l13
  gRNA
agguguuguagcaaaacuag

SEQ ID NO: 6701 - RNA, 20 nt, Artificial Sequence
  MKO10006701_A_Bcl2l13
  gRNA
gaguaccuuauuccauccgc

SEQ ID NO: 6702 - RNA, 20 nt, Artificial Sequence
  MKO10006702_A_Bcl2l14
  gRNA
gauggucuugaacguugagu

SEQ ID NO: 6703 - RNA, 20 nt, Artificial Sequence
  MKO10006703_A_Bcl2l14
  gRNA
agacgccaucgccaagcuca

SEQ ID NO: 6704 - RNA, 20 nt, Artificial Sequence
  MKO10006704_A_Bcl2l14
  gRNA
uggcugaaauuguuuacucc

SEQ ID NO: 6705 - RNA, 20 nt, Artificial Sequence
  MKO10006705_A_Bcl2l15
  gRNA
uguuggccgccuucgaauac

SEQ ID NO: 6706 - RNA, 20 nt, Artificial Sequence
  MKO10006706_A_Bcl2l15
  gRNA
augguucaucugcacccgau

SEQ ID NO: 6707 - RNA, 20 nt, Artificial Sequence
  MKO10006707_A_Bcl2l15
  gRNA
uacgugacgggcaugaucaa

SEQ ID NO: 6708 - RNA, 20 nt, Artificial Sequence
  MKO10006708_A_Bcl2l1
  gRNA
aguaaacuggggucgcaucg

SEQ ID NO: 6709 - RNA, 20 nt, Artificial Sequence
  MKO10006709_A_Bcl2l1
  gRNA
accagcgguugaagcgcucc

SEQ ID NO: 6710 - RNA, 20 nt, Artificial Sequence
  MKO10006710_A_Bcl2l1
  gRNA
cacgcacagugccccgccaa

SEQ ID NO: 6711 - RNA, 20 nt, Artificial Sequence
  MKO10006711_A_Bcl2l2
  gRNA
cccuaacuggggccgucuug

SEQ ID NO: 6712 - RNA, 20 nt, Artificial Sequence
  MKO10006712_A_Bcl2l2
  gRNA
gcccccuuggaaaaguucgu

SEQ ID NO: 6713 - RNA, 20 nt, Artificial Sequence
  MKO10006713_A_Bcl2l2
  gRNA
gcugacgggggccguggcac

SEQ ID NO: 6714 - RNA, 20 nt, Artificial Sequence
  MKO10006714_A_Bcl2
  gRNA
caucugacccuccgccgggc

SEQ ID NO: 6715 - RNA, 20 nt, Artificial Sequence
  MKO10006715_A_Bcl2
  gRNA
aaagcguccccucgcgguga

SEQ ID NO: 6716 - RNA, 20 nt, Artificial Sequence
  MKO10006716_A_Bcl2
  gRNA
ggucggggccugcaucacuc

SEQ ID NO: 6717 - RNA, 20 nt, Artificial Sequence
  MKO10006717_A_Bcl3
  gRNA
aaaguggggggccaucgucg

SEQ ID NO: 6718 - RNA, 20 nt, Artificial Sequence
  MKO10006718_A_Bcl3
  gRNA
cauuuacucuaccccgacga

SEQ ID NO: 6719 - RNA, 20 nt, Artificial Sequence
  MKO10006719_A_Bcl3
  gRNA
ccgugacgauccagggccau

SEQ ID NO: 6720 - RNA, 20 nt, Artificial Sequence
  MKO10006720_A_Bcl6b
  gRNA
uccacacuugaaucgugcag

SEQ ID NO: 6721 - RNA, 20 nt, Artificial Sequence
  MKO10006721_A_Bcl6b
  gRNA
ccgaucugccuuccguuaua

SEQ ID NO: 6722 - RNA, 20 nt, Artificial Sequence
  MKO10006722_A_Bcl6b
  gRNA
caacuuggcuagucaccgca

SEQ ID NO: 6723 - RNA, 20 nt, Artificial Sequence
  MKO10006723_A_Bcl6
  gRNA
cuaccgaggucgugaggucg

SEQ ID NO: 6724 - RNA, 20 nt, Artificial Sequence
  MKO10006724_A_Bcl6
  gRNA
ucuccacgaccucacgaccu

SEQ ID NO: 6725 - RNA, 20 nt, Artificial Sequence
  MKO10006725_A_Bcl6
  gRNA
agcauguugucgacacaugc

SEQ ID NO: 6726 - RNA, 20 nt, Artificial Sequence
  MKO10006726_A_Bcl7a
  gRNA
aacccacccgugcccagcga

SEQ ID NO: 6727 - RNA, 20 nt, Artificial Sequence
  MKO10006727_A_Bcl7a
  gRNA
cucggugaacagcuccgaga

SEQ ID NO: 6728 - RNA, 20 nt, Artificial Sequence
  MKO10006728_A_Bcl7a
  gRNA
uucggugccaucgcugggca

SEQ ID NO: 6729 - RNA, 20 nt, Artificial Sequence
  MKO10006729_A_Bcl7b
  gRNA
ggaauuggcugaggcgucag

SEQ ID NO: 6730 - RNA, 20 nt, Artificial Sequence
  MKO10006730_A_Bcl7b
  gRNA
accuccuugcuaucugucac

SEQ ID NO: 6731 - RNA, 20 nt, Artificial Sequence
  MKO10006731_A_Bcl7b
  gRNA
aaucgaauaauacagcagcc

SEQ ID NO: 6732 - RNA, 20 nt, Artificial Sequence
  MKO10006732_A_Bcl7c
  gRNA
ccucccacagggagaagcgc

SEQ ID NO: 6733 - RNA, 20 nt, Artificial Sequence
  MKO10006733_A_Bcl7c
  gRNA
cuucccuucgaaucuucaag

SEQ ID NO: 6734 - RNA, 20 nt, Artificial Sequence
  MKO10006734_A_Bcl7c
  gRNA
cugggcuggggcgucccccc

SEQ ID NO: 6735 - RNA, 20 nt, Artificial Sequence
  MKO10006735_A_Bcl9l
  gRNA
gacuccaucccucgauucag

SEQ ID NO: 6736 - RNA, 20 nt, Artificial Sequence
  MKO10006736_A_Bcl9l
  gRNA
cgucuggccgaaggccuggc

SEQ ID NO: 6737 - RNA, 20 nt, Artificial Sequence
  MKO10006737_A_Bcl9l
  gRNA
gcacacaccuccguuuacuc

SEQ ID NO: 6738 - RNA, 20 nt, Artificial Sequence
  MKO10006738_A_Bcl9
  gRNA
gaugccggguugggcacguu

SEQ ID NO: 6739 - RNA, 20 nt, Artificial Sequence
  MKO10006739_A_Bcl9
  gRNA
ucacuuccugccccgucgcc

SEQ ID NO: 6740 - RNA, 20 nt, Artificial Sequence
  MKO10006740_A_Bcl9
  gRNA
ucauggaguguggcgugugc

SEQ ID NO: 6741 - RNA, 20 nt, Artificial Sequence
  MKO10006741_A_Bclaf1
  gRNA
gagauuaucgucgagauuac

SEQ ID NO: 6742 - RNA, 20 nt, Artificial Sequence
  MKO10006742_A_Bclaf1
  gRNA
uaccuguuggaaucgucaag

SEQ ID NO: 6743 - RNA, 20 nt, Artificial Sequence
  MKO10006743_A_Bclaf1
  gRNA
agacugcauacauagucgaa

SEQ ID NO: 6744 - RNA, 20 nt, Artificial Sequence
  MKO10006744_A_Bcmo1
  gRNA
caggggacccugcuccgaaa

SEQ ID NO: 6745 - RNA, 20 nt, Artificial Sequence
  MKO10006745_A_Bcmo1
  gRNA
cgauguaggugucacucugc

SEQ ID NO: 6746 - RNA, 20 nt, Artificial Sequence
  MKO10006746_A_Bcmo1
  gRNA
caccuacaucgccaacauug

SEQ ID NO: 6747 - RNA, 20 nt, Artificial Sequence
  MKO10006747_A_Bco2
  gRNA
ggagacgauucacggagcac

SEQ ID NO: 6748 - RNA, 20 nt, Artificial Sequence
  MKO10006748_A_Bco2
  gRNA
guacugcacaaaguugacgu

SEQ ID NO: 6749 - RNA, 20 nt, Artificial Sequence
  MKO10006749_A_Bco2
  gRNA
guugcuucaccaguuccgaa

SEQ ID NO: 6750 - RNA, 20 nt, Artificial Sequence
  MKO10006750_A_Bcorl1
  gRNA
gcugaagcucgggcuaacgc

SEQ ID NO: 6751 - RNA, 20 nt, Artificial Sequence
  MKO10006751_A_Bcorl1
  gRNA
uacaucccaccuccgaguug

SEQ ID NO: 6752 - RNA, 20 nt, Artificial Sequence
  MKO10006752_A_Bcorl1
  gRNA
guccgagugcucagaaccac

SEQ ID NO: 6753 - RNA, 20 nt, Artificial Sequence
  MKO10006753_A_Bcor
  gRNA
gaugaggccgaauccaacga

SEQ ID NO: 6754 - RNA, 20 nt, Artificial Sequence
  MKO10006754_A_Bcor
  gRNA
cuuacgggcugcauacgagc

SEQ ID NO: 6755 - RNA, 20 nt, Artificial Sequence
  MKO10006755_A_Bcor
  gRNA
cgacgcuucaaaagccaggc

SEQ ID NO: 6756 - RNA, 20 nt, Artificial Sequence
  MKO10006756_A_Bcr
  gRNA
gguacgucuccucgcuggcc

SEQ ID NO: 6757 - RNA, 20 nt, Artificial Sequence
  MKO10006757_A_Bcr
  gRNA
auauggcugugccgcagacc

SEQ ID NO: 6758 - RNA, 20 nt, Artificial Sequence
  MKO10006758_A_Bcr
  gRNA
cacuccguaguuauccacaa

SEQ ID NO: 6759 - RNA, 20 nt, Artificial Sequence
  MKO10006759_A_Bcs1l
  gRNA
uugguuauccgcgccgacgu

SEQ ID NO: 6760 - RNA, 20 nt, Artificial Sequence
  MKO10006760_A_Bcs1l
  gRNA
acgucggcgcggauaaccaa

SEQ ID NO: 6761 - RNA, 20 nt, Artificial Sequence
  MKO10006761_A_Bcs1l
  gRNA
uaccuucuuuaugggccccc

SEQ ID NO: 6762 - RNA, 20 nt, Artificial Sequence
  MKO10006762_A_Bdh1
  gRNA
cguagguccgacggguguca

SEQ ID NO: 6763 - RNA, 20 nt, Artificial Sequence
  MKO10006763_A_Bdh1
  gRNA
aacgcaggcaucucaacguu

SEQ ID NO: 6764 - RNA, 20 nt, Artificial Sequence
  MKO10006764_A_Bdh1
  gRNA
gcgguggagacgauccgcuc

SEQ ID NO: 6765 - RNA, 20 nt, Artificial Sequence
  MKO10006765_A_Bdh2
  gRNA
aggauccacuaugggccgac

SEQ ID NO: 6766 - RNA, 20 nt, Artificial Sequence
  MKO10006766_A_Bdh2
  gRNA
ugcccguccaaucccuugag

SEQ ID NO: 6767 - RNA, 20 nt, Artificial Sequence
  MKO10006767_A_Bdh2
  gRNA
uuuggacucguugauaucug

SEQ ID NO: 6768 - RNA, 20 nt, Artificial Sequence
  MKO10006768_A_Bdkrb1
  gRNA
cuugggcuugccgucgccgc

SEQ ID NO: 6769 - RNA, 20 nt, Artificial Sequence
  MKO10006769_A_Bdkrb1
  gRNA
acguugggaaccguuucaac

SEQ ID NO: 6770 - RNA, 20 nt, Artificial Sequence
  MKO10006770_A_Bdkrb1
  gRNA
cgacuuugacggaacgcaga

SEQ ID NO: 6771 - RNA, 20 nt, Artificial Sequence
  MKO10006771_A_Bdkrb2
  gRNA
ucuuaacgggacccuuucga

SEQ ID NO: 6772 - RNA, 20 nt, Artificial Sequence
  MKO10006772_A_Bdkrb2
  gRNA
ggcccagaaagguaacccgc

SEQ ID NO: 6773 - RNA, 20 nt, Artificial Sequence
  MKO10006773_A_Bdkrb2
  gRNA
gacuuacccaaaggaggccg

SEQ ID NO: 6774 - RNA, 20 nt, Artificial Sequence
  MKO10006774_A_Bdnf
  gRNA
uguacaaguccgcguccuua

SEQ ID NO: 6775 - RNA, 20 nt, Artificial Sequence
  MKO10006775_A_Bdnf
  gRNA
acgcggacuuguacacuucc

SEQ ID NO: 6776 - RNA, 20 nt, Artificial Sequence
  MKO10006776_A_Bdnf
  gRNA
gaacuacccaaucguauguu

SEQ ID NO: 6777 - RNA, 20 nt, Artificial Sequence
  MKO10006777_A_Bdp1
  gRNA
uacgucauuggauuguuauc

SEQ ID NO: 6778 - RNA, 20 nt, Artificial Sequence
  MKO10006778_A_Bdp1
  gRNA
aagaugcucacucucucguu

SEQ ID NO: 6779 - RNA, 20 nt, Artificial Sequence
  MKO10006779_A_Bdp1
  gRNA
agacagauaccgaaucuaua

SEQ ID NO: 6780 - RNA, 20 nt, Artificial Sequence
  MKO10006780_A_Bean1
  gRNA
cugguggcgagcgcugucau

SEQ ID NO: 6781 - RNA, 20 nt, Artificial Sequence
  MKO10006781_A_Bean1
  gRNA
gcucaccguauucucggugu

SEQ ID NO: 6782 - RNA, 20 nt, Artificial Sequence
  MKO10006782_A_Bean1
  gRNA
gcccuuggacgucagcuccg

SEQ ID NO: 6783 - RNA, 20 nt, Artificial Sequence
  MKO10006783_A_Becn1
  gRNA
gccauuuauugaaacucgcc

SEQ ID NO: 6784 - RNA, 20 nt, Artificial Sequence
  MKO10006784_A_Becn1
  gRNA
aucuucgagagacaccaucc

SEQ ID NO: 6785 - RNA, 20 nt, Artificial Sequence
  MKO10006785_A_Becn1
  gRNA
ggcccgacaugaugucaaac

SEQ ID NO: 6786 - RNA, 20 nt, Artificial Sequence
  MKO10006786_A_Begain
  gRNA
uguugagggcgacaaucuca

SEQ ID NO: 6787 - RNA, 20 nt, Artificial Sequence
  MKO10006787_A_Begain
  gRNA
ugacuccacgcgccacuacc

SEQ ID NO: 6788 - RNA, 20 nt, Artificial Sequence
  MKO10006788_A_Begain
  gRNA
cuccuacaccacgcauaagc

SEQ ID NO: 6789 - RNA, 20 nt, Artificial Sequence
  MKO10006789_A_Bend3
  gRNA
ccgcgaaguugcccaccgac

SEQ ID NO: 6790 - RNA, 20 nt, Artificial Sequence
  MKO10006790_A_Bend3
  gRNA
guuacgcaaucaaccccgag

SEQ ID NO: 6791 - RNA, 20 nt, Artificial Sequence
  MKO10006791_A_Bend3
  gRNA
agagggcagcgacgcuaccu

SEQ ID NO: 6792 - RNA, 20 nt, Artificial Sequence
  MKO10006792_A_Bend4
  gRNA
cccauccuccucuacgcugc

SEQ ID NO: 6793 - RNA, 20 nt, Artificial Sequence
  MKO10006793_A_Bend4
  gRNA
caugauuucuugcgucaagc

SEQ ID NO: 6794 - RNA, 20 nt, Artificial Sequence
  MKO10006794_A_Bend4
  gRNA
aggucccgaaagacgcccuc

SEQ ID NO: 6795 - RNA, 20 nt, Artificial Sequence
  MKO10006795_A_Bend5
  gRNA
agcggcucacaagaguaucg

SEQ ID NO: 6796 - RNA, 20 nt, Artificial Sequence
  MKO10006796_A_Bend5
  gRNA
acucaccgcugccaagccgc

SEQ ID NO: 6797 - RNA, 20 nt, Artificial Sequence
  MKO10006797_A_Bend5
  gRNA
cugaaagugcuccguaacuc

SEQ ID NO: 6798 - RNA, 20 nt, Artificial Sequence
  MKO10006798_A_Bend6
  gRNA
gauugagacgucauccgcac

SEQ ID NO: 6799 - RNA, 20 nt, Artificial Sequence
  MKO10006799_A_Bend6
  gRNA
cagccggcuucgacagucuu

SEQ ID NO: 6800 - RNA, 20 nt, Artificial Sequence
  MKO10006800_A_Bend6
  gRNA
ucuuacaggaguaacgaagc

SEQ ID NO: 6801 - RNA, 20 nt, Artificial Sequence
  MKO10006801_A_Bend7
  gRNA
cgguucgcugggagcacaua

SEQ ID NO: 6802 - RNA, 20 nt, Artificial Sequence
  MKO10006802_A_Bend7
  gRNA
gccuccacucuaauucacgu

SEQ ID NO: 6803 - RNA, 20 nt, Artificial Sequence
  MKO10006803_A_Bend7
  gRNA
ccgacuauugaauucacccc

SEQ ID NO: 6804 - RNA, 20 nt, Artificial Sequence
  MKO10006804_A_Best1
  gRNA
gccaguacgagaacuugccg

SEQ ID NO: 6805 - RNA, 20 nt, Artificial Sequence
  MKO10006805_A_Best1
  gRNA
aucaugaggcggucgggcca

SEQ ID NO: 6806 - RNA, 20 nt, Artificial Sequence
  MKO10006806_A_Best1
  gRNA
ccuaucuuggaggucgaauc

SEQ ID NO: 6807 - RNA, 20 nt, Artificial Sequence
  MKO10006807_A_Best2
  gRNA
cgcacgcucaugcgcuacgc

SEQ ID NO: 6808 - RNA, 20 nt, Artificial Sequence
  MKO10006808_A_Best2
  gRNA
gugcaugggcgagacgaucg

SEQ ID NO: 6809 - RNA, 20 nt, Artificial Sequence
  MKO10006809_A_Best2
  gRNA
cugcguaugguucucgagcc

SEQ ID NO: 6810 - RNA, 20 nt, Artificial Sequence
  MKO10006810_A_Best3
  gRNA
cgacuggguuggcauuccgc

SEQ ID NO: 6811 - RNA, 20 nt, Artificial Sequence
  MKO10006811_A_Best3
  gRNA
ccguaccugcuucgaccacg

SEQ ID NO: 6812 - RNA, 20 nt, Artificial Sequence
  MKO10006812_A_Best3
  gRNA
gggaaaccucuuguacaccg

SEQ ID NO: 6813 - RNA, 20 nt, Artificial Sequence
  MKO10006813_A_Bet1l
  gRNA
agcuggcuuuggacaucgac

SEQ ID NO: 6814 - RNA, 20 nt, Artificial Sequence
  MKO10006814_A_Bet1l
  gRNA
gcuucacacuccccgugagu

SEQ ID NO: 6815 - RNA, 20 nt, Artificial Sequence
  MKO10006815_A_Bet1l
  gRNA
ucgcccagaccgugccaucg

SEQ ID NO: 6816 - RNA, 20 nt, Artificial Sequence
  MKO10006816_A_Bet1
  gRNA
acaagcauuauaaccaguau

SEQ ID NO: 6817 - RNA, 20 nt, Artificial Sequence
  MKO10006817_A_Bet1
  gRNA
ucacaauuugauucuacaac

SEQ ID NO: 6818 - RNA, 20 nt, Artificial Sequence
  MKO10006818_A_Bet1
  gRNA
ccuggcaggaugaggcgugc

SEQ ID NO: 6819 - RNA, 20 nt, Artificial Sequence
  MKO10006819_A_Bex1
  gRNA
ucccaucuauagugagcgau

SEQ ID NO: 6820 - RNA, 20 nt, Artificial Sequence
  MKO10006820_A_Bex1
  gRNA
ggcaaaaacugugcaccuag

SEQ ID NO: 6821 - RNA, 20 nt, Artificial Sequence
  MKO10006821_A_Bex1
  gRNA
agcccaucgcucacuauaga

SEQ ID NO: 6822 - RNA, 20 nt, Artificial Sequence
  MKO10006822_A_Bex2
  gRNA
gacuacuacgugccuagagg

SEQ ID NO: 6823 - RNA, 20 nt, Artificial Sequence
  MKO10006823_A_Bex2
  gRNA
ucccaucuguagugcacgau

SEQ ID NO: 6824 - RNA, 20 nt, Artificial Sequence
  MKO10006824_A_Bex2
  gRNA
guggcccugccuuucgaagc

SEQ ID NO: 6825 - RNA, 20 nt, Artificial Sequence
  MKO10006825_A_Bex4
  gRNA
gggguucggaaacgccugua

SEQ ID NO: 6826 - RNA, 20 nt, Artificial Sequence
  MKO10006826_A_Bex4
  gRNA
aucuuagauuucaagguaug

SEQ ID NO: 6827 - RNA, 20 nt, Artificial Sequence
  MKO10006827_A_Bex4
  gRNA
caaauuuaaacaagucauac

SEQ ID NO: 6828 - RNA, 20 nt, Artificial Sequence
  MKO10006828_A_Bex6
  gRNA
gacuuguguguaacuuuaga

SEQ ID NO: 6829 - RNA, 20 nt, Artificial Sequence
  MKO10006829_A_Bex6
  gRNA
uuguaaugacugucagauuc

SEQ ID NO: 6830 - RNA, 20 nt, Artificial Sequence
  MKO10006830_A_Bex6
  gRNA
ucugacagucauuacaacuu

SEQ ID NO: 6831 - RNA, 20 nt, Artificial Sequence
  MKO10006831_A_Bfar
  gRNA
aggcaaacuccgcgaucagc

SEQ ID NO: 6832 - RNA, 20 nt, Artificial Sequence
  MKO10006832_A_Bfar
  gRNA
ucuuccguaccagcugaucg

SEQ ID NO: 6833 - RNA, 20 nt, Artificial Sequence
  MKO10006833_A_Bfar
  gRNA
ccacugcugcuacgacaccc

SEQ ID NO: 6834 - RNA, 20 nt, Artificial Sequence
  MKO10006834_A_Bfsp1
  gRNA
gcguaaccugcaccuucagu

SEQ ID NO: 6835 - RNA, 20 nt, Artificial Sequence
  MKO10006835_A_Bfsp1
  gRNA
cagucuguacgaucugcugc

SEQ ID NO: 6836 - RNA, 20 nt, Artificial Sequence
  MKO10006836_A_Bfsp1
  gRNA
guuacgcaauaaggcuucau

SEQ ID NO: 6837 - RNA, 20 nt, Artificial Sequence
  MKO10006837_A_Bfsp2
  gRNA
gacggaaucuuuacgggcuc

SEQ ID NO: 6838 - RNA, 20 nt, Artificial Sequence
  MKO10006838_A_Bfsp2
  gRNA
uugagacgauccgaguucag

SEQ ID NO: 6839 - RNA, 20 nt, Artificial Sequence
  MKO10006839_A_Bfsp2
  gRNA
cucuuuaaagucauccgcac

SEQ ID NO: 6840 - RNA, 20 nt, Artificial Sequence
  MKO10006840_A_Bglap2
  gRNA
gauaccguagaugcguuugu

SEQ ID NO: 6841 - RNA, 20 nt, Artificial Sequence
  MKO10006841_A_Bglap2
  gRNA
cuaguaccuuugucagacuc

SEQ ID NO: 6842 - RNA, 20 nt, Artificial Sequence
  MKO10006842_A_Bglap2
  gRNA
ccucucucugcucacucugc

SEQ ID NO: 6843 - RNA, 20 nt, Artificial Sequence
  MKO10006843_A_Bglap3
  gRNA
uuuacagaugccacgcccac

SEQ ID NO: 6844 - RNA, 20 nt, Artificial Sequence
  MKO10006844_A_Bglap3
  gRNA
gauaccguagaugcgucugu

SEQ ID NO: 6845 - RNA, 20 nt, Artificial Sequence
  MKO10006845_A_Bglap3
  gRNA
gacgagcuaucaaaccagua

SEQ ID NO: 6846 - RNA, 20 nt, Artificial Sequence
  MKO10006846_A_Bglap
  gRNA
gauaccauagaugcguuugu

SEQ ID NO: 6847 - RNA, 20 nt, Artificial Sequence
  MKO10006847_A_Bglap
  gRNA
ucugcucacucugcugaccc

SEQ ID NO: 6848 - RNA, 20 nt, Artificial Sequence
  MKO10006848_A_Bglap
  gRNA
cagcagagugagcagaaaga

SEQ ID NO: 6849 - RNA, 20 nt, Artificial Sequence
  MKO10006849_A_Bgn
  gRNA
agcccgcugaacacgcccuu

SEQ ID NO: 6850 - RNA, 20 nt, Artificial Sequence
  MKO10006850_A_Bgn
  gRNA
cuuugcggauacgguuguca

SEQ ID NO: 6851 - RNA, 20 nt, Artificial Sequence
  MKO10006851_A_Bgn
  gRNA
uucgauacuccaagcuguac

SEQ ID NO: 6852 - RNA, 20 nt, Artificial Sequence
  MKO10006852_A_Bhlha15
  gRNA
gcgaggucaucccgcacgug

SEQ ID NO: 6853 - RNA, 20 nt, Artificial Sequence
  MKO10006853_A_Bhlha15
  gRNA
gaccucgcgcagugccugga

SEQ ID NO: 6854 - RNA, 20 nt, Artificial Sequence
  MKO10006854_A_Bhlha15
  gRNA
caccagaccccugucgccgg

SEQ ID NO: 6855 - RNA, 20 nt, Artificial Sequence
  MKO10006855_A_Bhlha9
  gRNA
ccaagaucgcuacgcugcgc

SEQ ID NO: 6856 - RNA, 20 nt, Artificial Sequence
  MKO10006856_A_Bhlha9
  gRNA
uagcgccuagccuaacgcgc

SEQ ID NO: 6857 - RNA, 20 nt, Artificial Sequence
  MKO10006857_A_Bhlha9
  gRNA
ccugcgcagcguagcgaucu

SEQ ID NO: 6858 - RNA, 20 nt, Artificial Sequence
  MKO10006858_A_Bhlhb9
  gRNA
agccauauuccgugaaguua

SEQ ID NO: 6859 - RNA, 20 nt, Artificial Sequence
  MKO10006859_A_Bhlhb9
  gRNA
gugcugaggagcccgcaccu

SEQ ID NO: 6860 - RNA, 20 nt, Artificial Sequence
  MKO10006860_A_Bhlhb9
  gRNA
ugaacgaguauucuuaguac

SEQ ID NO: 6861 - RNA, 20 nt, Artificial Sequence
  MKO10006861_A_Bhlhe22
  gRNA
cggcgcucucgccguacuug

SEQ ID NO: 6862 - RNA, 20 nt, Artificial Sequence
  MKO10006862_A_Bhlhe22
  gRNA
gacgccgggcguucgcgagu

SEQ ID NO: 6863 - RNA, 20 nt, Artificial Sequence
  MKO10006863_A_Bhlhe22
  gRNA
gaagaggucgucuucgcucg

SEQ ID NO: 6864 - RNA, 20 nt, Artificial Sequence
  MKO10006864_A_Bhlhe23
  gRNA
ucagcaucaacgcgcgcgaa

SEQ ID NO: 6865 - RNA, 20 nt, Artificial Sequence
  MKO10006865_A_Bhlhe23
  gRNA
uucucguguccccgccgcga

SEQ ID NO: 6866 - RNA, 20 nt, Artificial Sequence
  MKO10006866_A_Bhlhe23
  gRNA
ggcagcgauuuacccguucu

SEQ ID NO: 6867 - RNA, 20 nt, Artificial Sequence
  MKO10006867_A_Bhlhe40
  gRNA
gggcaaugcacucguuaauc

SEQ ID NO: 6868 - RNA, 20 nt, Artificial Sequence
  MKO10006868_A_Bhlhe40
  gRNA
gaguguucucaugcuucgcc

SEQ ID NO: 6869 - RNA, 20 nt, Artificial Sequence
  MKO10006869_A_Bhlhe40
  gRNA
cagcuuguaaaccgcucugc

SEQ ID NO: 6870 - RNA, 20 nt, Artificial Sequence
  MKO10006870_A_Bhlhe41
  gRNA
cgggguacagauacuugucc

SEQ ID NO: 6871 - RNA, 20 nt, Artificial Sequence
  MKO10006871_A_Bhlhe41
  gRNA
accucgcgcgcuuugagagc

SEQ ID NO: 6872 - RNA, 20 nt, Artificial Sequence
  MKO10006872_A_Bhlhe41
  gRNA
cuugaagcgagacgauacca

SEQ ID NO: 6873 - RNA, 20 nt, Artificial Sequence
  MKO10006873_A_Bhmt2
  gRNA
gcggugaagcuggcgcgugc

SEQ ID NO: 6874 - RNA, 20 nt, Artificial Sequence
  MKO10006874_A_Bhmt2
  gRNA
gacaugcacgacgugacacc

SEQ ID NO: 6875 - RNA, 20 nt, Artificial Sequence
  MKO10006875_A_Bhmt2
  gRNA
uguggacuucuugauugcag

SEQ ID NO: 6876 - RNA, 20 nt, Artificial Sequence
  MKO10006876_A_Bhmt
  gRNA
cguggacuuccucauugcag

SEQ ID NO: 6877 - RNA, 20 nt, Artificial Sequence
  MKO10006877_A_Bhmt
  gRNA
agcugccguggagcauccug

SEQ ID NO: 6878 - RNA, 20 nt, Artificial Sequence
  MKO10006878_A_Bhmt
  gRNA
accugccucaggaugcucca

SEQ ID NO: 6879 - RNA, 20 nt, Artificial Sequence
  MKO10006879_A_Bicc1
  gRNA
uaccacccuugccgaugacg

SEQ ID NO: 6880 - RNA, 20 nt, Artificial Sequence
  MKO10006880_A_Bicc1
  gRNA
uuuagccccgaucuucaguu

SEQ ID NO: 6881 - RNA, 20 nt, Artificial Sequence
  MKO10006881_A_Bicc1
  gRNA
acggagcacucccacgucau

SEQ ID NO: 6882 - RNA, 20 nt, Artificial Sequence
  MKO10006882_A_Bicd1
  gRNA
cuaauuuagguugaauacga

SEQ ID NO: 6883 - RNA, 20 nt, Artificial Sequence
  MKO10006883_A_Bicd1
  gRNA
caagcaacaguaugacgagc

SEQ ID NO: 6884 - RNA, 20 nt, Artificial Sequence
  MKO10006884_A_Bicd1
  gRNA
ccaccccgcuauggccgcag

SEQ ID NO: 6885 - RNA, 20 nt, Artificial Sequence
  MKO10006885_A_Bicd2
  gRNA
agugcgacaacuccuugcgc

SEQ ID NO: 6886 - RNA, 20 nt, Artificial Sequence
  MKO10006886_A_Bicd2
  gRNA
caacaaugacgccgaagccc

SEQ ID NO: 6887 - RNA, 20 nt, Artificial Sequence
  MKO10006887_A_Bicd2
  gRNA
ccgcacguaguacugcuccu

SEQ ID NO: 6888 - RNA, 20 nt, Artificial Sequence
  MKO10006888_A_Bid
  gRNA
gguccaucucaucgccuauu

SEQ ID NO: 6889 - RNA, 20 nt, Artificial Sequence
  MKO10006889_A_Bid
  gRNA
gccagacaucucgcccaaau

SEQ ID NO: 6890 - RNA, 20 nt, Artificial Sequence
  MKO10006890_A_Bid
  gRNA
ccuuaggucagcaacgguuc

SEQ ID NO: 6891 - RNA, 20 nt, Artificial Sequence
  MKO10006891_A_Bik
  gRNA
ggccugcaucggcgaugaga

SEQ ID NO: 6892 - RNA, 20 nt, Artificial Sequence
  MKO10006892_A_Bik
  gRNA
aacagucuugaugacgucuc

SEQ ID NO: 6893 - RNA, 20 nt, Artificial Sequence
  MKO10006893_A_Bik
  gRNA
gugucugcggagcccccguc

SEQ ID NO: 6894 - RNA, 20 nt, Artificial Sequence
  MKO10006894_A_Bin1
  gRNA
gaaggaucuucggaccuauc

SEQ ID NO: 6895 - RNA, 20 nt, Artificial Sequence
  MKO10006895_A_Bin1
  gRNA
gaagaagcugacccgagcgc

SEQ ID NO: 6896 - RNA, 20 nt, Artificial Sequence
  MKO10006896_A_Bin1
  gRNA
ccagcugcuuauugaaguuc

SEQ ID NO: 6897 - RNA, 20 nt, Artificial Sequence
  MKO10006897_A_Bin2
  gRNA
gucgcaguucagcgagauua

SEQ ID NO: 6898 - RNA, 20 nt, Artificial Sequence
  MKO10006898_A_Bin2
  gRNA
uuguucaaaucgcucgucuu

SEQ ID NO: 6899 - RNA, 20 nt, Artificial Sequence
  MKO10006899_A_Bin2
  gRNA
cagcaacuucuaccaacagc

SEQ ID NO: 6900 - RNA, 20 nt, Artificial Sequence
  MKO10006900_A_Bin3
  gRNA
gaaaagcaccgaugccgacc

SEQ ID NO: 6901 - RNA, 20 nt, Artificial Sequence
  MKO10006901_A_Bin3
  gRNA
ccacucacccaggucggcau

SEQ ID NO: 6902 - RNA, 20 nt, Artificial Sequence
  MKO10006902_A_Bin3
  gRNA
guccaacccacugugugagc

SEQ ID NO: 6903 - RNA, 20 nt, Artificial Sequence
  MKO10006903_A_Birc2
  gRNA
uuaggugugaguucuugaua

SEQ ID NO: 6904 - RNA, 20 nt, Artificial Sequence
  MKO10006904_A_Birc2
  gRNA
ggccaguguaauuacaaaac

SEQ ID NO: 6905 - RNA, 20 nt, Artificial Sequence
  MKO10006905_A_Birc2
  gRNA
agcauuucccuugacuaaaa

SEQ ID NO: 6906 - RNA, 20 nt, Artificial Sequence
  MKO10006906_A_Birc3
  gRNA
guccauauagucgugcauuu

SEQ ID NO: 6907 - RNA, 20 nt, Artificial Sequence
  MKO10006907_A_Birc3
  gRNA
cuauccucaucuacuugagc

SEQ ID NO: 6908 - RNA, 20 nt, Artificial Sequence
  MKO10006908_A_Birc3
  gRNA
ccguuaccuuggaaaccacu

SEQ ID NO: 6909 - RNA, 20 nt, Artificial Sequence
  MKO10006909_A_Birc5
  gRNA
uaccgagaacgagccugauu

SEQ ID NO: 6910 - RNA, 20 nt, Artificial Sequence
  MKO10006910_A_Birc5
  gRNA
aaaucaggcucguucucggu

SEQ ID NO: 6911 - RNA, 20 nt, Artificial Sequence
  MKO10006911_A_Birc5
  gRNA
uggcgaugcgguaguucuug

SEQ ID NO: 6912 - RNA, 20 nt, Artificial Sequence
  MKO10006912_A_Birc6
  gRNA
auuuguggaugauuacgccg

SEQ ID NO: 6913 - RNA, 20 nt, Artificial Sequence
  MKO10006913_A_Birc6
  gRNA
gcccaccuauagccaacaug

SEQ ID NO: 6914 - RNA, 20 nt, Artificial Sequence
  MKO10006914_A_Birc6
  gRNA
cccagugcacguccagaacu

SEQ ID NO: 6915 - RNA, 20 nt, Artificial Sequence
  MKO10006915_A_Birc7
  gRNA
ccagaccuacaccccuuugc

SEQ ID NO: 6916 - RNA, 20 nt, Artificial Sequence
  MKO10006916_A_Birc7
  gRNA
ccuggacagagcaugcccga

SEQ ID NO: 6917 - RNA, 20 nt, Artificial Sequence
  MKO10006917_A_Birc7
  gRNA
ccaggugucaguuccugcua

SEQ ID NO: 6918 - RNA, 20 nt, Artificial Sequence
  MKO10006918_A_Bivm
  gRNA
uggccacauaccaucgccua

SEQ ID NO: 6919 - RNA, 20 nt, Artificial Sequence
  MKO10006919_A_Bivm
  gRNA
auaaaaaagggcggcaucag

SEQ ID NO: 6920 - RNA, 20 nt, Artificial Sequence
  MKO10006920_A_Bivm
  gRNA
ccacaguacaagacuucaug

SEQ ID NO: 6921 - RNA, 20 nt, Artificial Sequence
  MKO10006921_A_Blcap
  gRNA
agcccaugaccccgguguug

SEQ ID NO: 6922 - RNA, 20 nt, Artificial Sequence
  MKO10006922_A_Blcap
  gRNA
ucaugggcugauuccggaag

SEQ ID NO: 6923 - RNA, 20 nt, Artificial Sequence
  MKO10006923_A_Blcap
  gRNA
agaucauguauugccuccag

SEQ ID NO: 6924 - RNA, 20 nt, Artificial Sequence
  MKO10006924_A_Blk
  gRNA
uuggccaggucacucgucac

SEQ ID NO: 6925 - RNA, 20 nt, Artificial Sequence
  MKO10006925_A_Blk
  gRNA
acuaugccgcugugaaugac

SEQ ID NO: 6926 - RNA, 20 nt, Artificial Sequence
  MKO10006926_A_Blk
  gRNA
guugcuggcuccgaugaaca

SEQ ID NO: 6927 - RNA, 20 nt, Artificial Sequence
  MKO10006927_A_Blmh
  gRNA
ucccgaaucgcauacgacag

SEQ ID NO: 6928 - RNA, 20 nt, Artificial Sequence
  MKO10006928_A_Blmh
  gRNA
agccucugucguaugcgauu

SEQ ID NO: 6929 - RNA, 20 nt, Artificial Sequence
  MKO10006929_A_Blmh
  gRNA
gacauauguccagcagaucg

SEQ ID NO: 6930 - RNA, 20 nt, Artificial Sequence
  MKO10006930_A_Blm
  gRNA
acaucuuuaucacuuaacgc

SEQ ID NO: 6931 - RNA, 20 nt, Artificial Sequence
  MKO10006931_A_Blm
  gRNA
guccugagcagucuguaccg

SEQ ID NO: 6932 - RNA, 20 nt, Artificial Sequence
  MKO10006932_A_Blm
  gRNA
uuaccuggaacauuucaacg

SEQ ID NO: 6933 - RNA, 20 nt, Artificial Sequence
  MKO10006933_A_Blnk
  gRNA
ccuaaugcguagucccuucg

SEQ ID NO: 6934 - RNA, 20 nt, Artificial Sequence
  MKO10006934_A_Blnk
  gRNA
ucggaguccgaauguucauc

SEQ ID NO: 6935 - RNA, 20 nt, Artificial Sequence
  MKO10006935_A_Blnk
  gRNA
cccuccaaguguuccucgaa

SEQ ID NO: 6936 - RNA, 20 nt, Artificial Sequence
  MKO10006936_A_Bloc1s1
  gRNA
gagguucauaccccacguug

SEQ ID NO: 6937 - RNA, 20 nt, Artificial Sequence
  MKO10006937_A_Bloc1s1
  gRNA
ugaggcccaccuuaagugcc

SEQ ID NO: 6938 - RNA, 20 nt, Artificial Sequence
  MKO10006938_A_Bloc1s1
  gRNA
ccaugaggugaagacucuac

SEQ ID NO: 6939 - RNA, 20 nt, Artificial Sequence
  MKO10006939_A_Bloc1s2
  gRNA
caccuugccagaugaugcug

SEQ ID NO: 6940 - RNA, 20 nt, Artificial Sequence
  MKO10006940_A_Bloc1s2
  gRNA
agaagccaaguacaagaagu

SEQ ID NO: 6941 - RNA, 20 nt, Artificial Sequence
  MKO10006941_A_Bloc1s2
  gRNA
caguuccccagucaaauaug

SEQ ID NO: 6942 - RNA, 20 nt, Artificial Sequence
  MKO10006942_A_Bloc1s3
  gRNA
agcgcgauccggcggagacu

SEQ ID NO: 6943 - RNA, 20 nt, Artificial Sequence
  MKO10006943_A_Bloc1s3
  gRNA
cccuacgcgcggccguccca

SEQ ID NO: 6944 - RNA, 20 nt, Artificial Sequence
  MKO10006944_A_Bloc1s3
  gRNA
cggccacaucgcgacccgca

SEQ ID NO: 6945 - RNA, 20 nt, Artificial Sequence
  MKO10006945_A_Bloc1s4
  gRNA
gcucccgaucauccgcacga

SEQ ID NO: 6946 - RNA, 20 nt, Artificial Sequence
  MKO10006946_A_Bloc1s4
  gRNA
cggcucguacgccgcgcgcu

SEQ ID NO: 6947 - RNA, 20 nt, Artificial Sequence
  MKO10006947_A_Bloc1s4
  gRNA
cgguagagaccucucgagac

SEQ ID NO: 6948 - RNA, 20 nt, Artificial Sequence
  MKO10006948_A_Bloc1s5
  gRNA
uaagaacgcgcaauucucga

SEQ ID NO: 6949 - RNA, 20 nt, Artificial Sequence
  MKO10006949_A_Bloc1s5
  gRNA
agcuagugagaagcgucguc

SEQ ID NO: 6950 - RNA, 20 nt, Artificial Sequence
  MKO10006950_A_Bloc1s5
  gRNA
auugcgcguucuuaagaacu

SEQ ID NO: 6951 - RNA, 20 nt, Artificial Sequence
  MKO10006951_A_Bloc1s6
  gRNA
gagggagcagcaacgcgaaa

SEQ ID NO: 6952 - RNA, 20 nt, Artificial Sequence
  MKO10006952_A_Bloc1s6
  gRNA
ucuacagcucuaucguccac

SEQ ID NO: 6953 - RNA, 20 nt, Artificial Sequence
  MKO10006953_A_Bloc1s6
  gRNA
gaagcacuaucacgccaagc

SEQ ID NO: 6954 - RNA, 20 nt, Artificial Sequence
  MKO10006954_A_Blvra
  gRNA
auugucauuugcggcagcgc

SEQ ID NO: 6955 - RNA, 20 nt, Artificial Sequence
  MKO10006955_A_Blvra
  gRNA
guucgaugugcuccucaugc

SEQ ID NO: 6956 - RNA, 20 nt, Artificial Sequence
  MKO10006956_A_Blvra
  gRNA
ugccgcaaaugacaaugcca

SEQ ID NO: 6957 - RNA, 20 nt, Artificial Sequence
  MKO10006957_A_Blvrb
  gRNA
acgugaccgaugaccacauc

SEQ ID NO: 6958 - RNA, 20 nt, Artificial Sequence
  MKO10006958_A_Blvrb
  gRNA
augcuuggauaugacccucg

SEQ ID NO: 6959 - RNA, 20 nt, Artificial Sequence
  MKO10006959_A_Blvrb
  gRNA
ccuuggucgggucccauagu

SEQ ID NO: 6960 - RNA, 20 nt, Artificial Sequence
  MKO10006960_A_Blzf1
  gRNA
uuccccagcugaagaacgcc

SEQ ID NO: 6961 - RNA, 20 nt, Artificial Sequence
  MKO10006961_A_Blzf1
  gRNA
ugaacgagagcaguuucguc

SEQ ID NO: 6962 - RNA, 20 nt, Artificial Sequence
  MKO10006962_A_Blzf1
  gRNA
agacguucaaagugauacug

SEQ ID NO: 6963 - RNA, 20 nt, Artificial Sequence
  MKO10006963_A_Bmf
  gRNA
cggacuccggcccauaagcc

SEQ ID NO: 6964 - RNA, 20 nt, Artificial Sequence
  MKO10006964_A_Bmf
  gRNA
agcagaaccgagaccgugcg

SEQ ID NO: 6965 - RNA, 20 nt, Artificial Sequence
  MKO10006965_A_Bmf
  gRNA
cuuguugcguaugaagccga

SEQ ID NO: 6966 - RNA, 20 nt, Artificial Sequence
  MKO10006966_A_Bmi1
  gRNA
gcagcucacccgucagcuga

SEQ ID NO: 6967 - RNA, 20 nt, Artificial Sequence
  MKO10006967_A_Bmi1
  gRNA
aacauguauuguacguuacu

SEQ ID NO: 6968 - RNA, 20 nt, Artificial Sequence
  MKO10006968_A_Bmi1
  gRNA
gcacuuccuaccuuauguuc

SEQ ID NO: 6969 - RNA, 20 nt, Artificial Sequence
  MKO10006969_A_Bmp10
  gRNA
ugauugaugauucguccgcu

SEQ ID NO: 6970 - RNA, 20 nt, Artificial Sequence
  MKO10006970_A_Bmp10
  gRNA
agagagugcagacgguagcg

SEQ ID NO: 6971 - RNA, 20 nt, Artificial Sequence
  MKO10006971_A_Bmp10
  gRNA
acaacaaauucgccacagac

SEQ ID NO: 6972 - RNA, 20 nt, Artificial Sequence
  MKO10006972_A_Bmp15
  gRNA
cuuguacaagauacucccgu

SEQ ID NO: 6973 - RNA, 20 nt, Artificial Sequence
  MKO10006973_A_Bmp15
  gRNA
ccgcacgauuggagcgaaaa

SEQ ID NO: 6974 - RNA, 20 nt, Artificial Sequence
  MKO10006974_A_Bmp15
  gRNA
gcucaaguuauaccaucguu

SEQ ID NO: 6975 - RNA, 20 nt, Artificial Sequence
  MKO10006975_A_Bmp1
  gRNA
acgagcacacgcggcccgac

SEQ ID NO: 6976 - RNA, 20 nt, Artificial Sequence
  MKO10006976_A_Bmp1
  gRNA
gcgggcagcgacguccagac

SEQ ID NO: 6977 - RNA, 20 nt, Artificial Sequence
  MKO10006977_A_Bmp1
  gRNA
guauucaccuaccgacccug

SEQ ID NO: 6978 - RNA, 20 nt, Artificial Sequence
  MKO10006978_A_Bmp2k
  gRNA
caaucgugcgacagcuucgc

SEQ ID NO: 6979 - RNA, 20 nt, Artificial Sequence
  MKO10006979_A_Bmp2k
  gRNA
ucccacugugaguccgcacc

SEQ ID NO: 6980 - RNA, 20 nt, Artificial Sequence
  MKO10006980_A_Bmp2k
  gRNA
caaaaauauugucgguuauu

SEQ ID NO: 6981 - RNA, 20 nt, Artificial Sequence
  MKO10006981_A_Bmp2
  gRNA
augccgcggcgaacuucuug

SEQ ID NO: 6982 - RNA, 20 nt, Artificial Sequence
  MKO10006982_A_Bmp2
  gRNA
auaugcuagaucuguaccgc

SEQ ID NO: 6983 - RNA, 20 nt, Artificial Sequence
  MKO10006983_A_Bmp2
  gRNA
gaucaaacuagaagccgugg

SEQ ID NO: 6984 - RNA, 20 nt, Artificial Sequence
  MKO10006984_A_Bmp3
  gRNA
uucgcuauggccggggcgcg

SEQ ID NO: 6985 - RNA, 20 nt, Artificial Sequence
  MKO10006985_A_Bmp3
  gRNA
gagccaagcgaccgcgcgac

SEQ ID NO: 6986 - RNA, 20 nt, Artificial Sequence
  MKO10006986_A_Bmp3
  gRNA
guguguaaccccuucguuug

SEQ ID NO: 6987 - RNA, 20 nt, Artificial Sequence
  MKO10006987_A_Bmp4
  gRNA
ccgucgccauucacuauacg

SEQ ID NO: 6988 - RNA, 20 nt, Artificial Sequence
  MKO10006988_A_Bmp4
  gRNA
cacgcgggaggacgccgcuc

SEQ ID NO: 6989 - RNA, 20 nt, Artificial Sequence
  MKO10006989_A_Bmp4
  gRNA
uagcaagagcgccgucauuc

SEQ ID NO: 6990 - RNA, 20 nt, Artificial Sequence
  MKO10006990_A_Bmp5
  gRNA
cuaugugaguuuccgagauc

SEQ ID NO: 6991 - RNA, 20 nt, Artificial Sequence
  MKO10006991_A_Bmp5
  gRNA
ggccuucuucaaggcaagcg

SEQ ID NO: 6992 - RNA, 20 nt, Artificial Sequence
  MKO10006992_A_Bmp5
  gRNA
auagaguucgugcuucuugc

SEQ ID NO: 6993 - RNA, 20 nt, Artificial Sequence
  MKO10006993_A_Bmp6
  gRNA
cccgggacacguccugcgac

SEQ ID NO: 6994 - RNA, 20 nt, Artificial Sequence
  MKO10006994_A_Bmp6
  gRNA
cccggguguccaacaaaaau

SEQ ID NO: 6995 - RNA, 20 nt, Artificial Sequence
  MKO10006995_A_Bmp6
  gRNA
ccgccgcacggggguugacg

SEQ ID NO: 6996 - RNA, 20 nt, Artificial Sequence
  MKO10006996_A_Bmp7
  gRNA
aacucccgauggugguaucg

SEQ ID NO: 6997 - RNA, 20 nt, Artificial Sequence
  MKO10006997_A_Bmp7
  gRNA
ugcggucaccgcuucgcccu

SEQ ID NO: 6998 - RNA, 20 nt, Artificial Sequence
  MKO10006998_A_Bmp7
  gRNA
acuacggagauggacuuccg

SEQ ID NO: 6999 - RNA, 20 nt, Artificial Sequence
  MKO10006999_A_Bmp8a
  gRNA
uggcccgccgucgucgucau

SEQ ID NO: 7000 - RNA, 20 nt, Artificial Sequence
  MKO10007000_A_Bmp8a
  gRNA
cggugcucgggcuaccggga

SEQ ID NO: 7001 - RNA, 20 nt, Artificial Sequence
  MKO10007001_A_Bmp8a
  gRNA
uucaguggucucgcugcccg

SEQ ID NO: 7002 - RNA, 20 nt, Artificial Sequence
  MKO10007002_A_Bmp8b
  gRNA
gcuguucgaggggcccgcac

SEQ ID NO: 7003 - RNA, 20 nt, Artificial Sequence
  MKO10007003_A_Bmp8b
  gRNA
guuuguuggagugcggcagc

SEQ ID NO: 7004 - RNA, 20 nt, Artificial Sequence
  MKO10007004_A_Bmp8b
  gRNA
acggcagagaaguuugccgc

SEQ ID NO: 7005 - RNA, 20 nt, Artificial Sequence
  MKO10007005_A_Bmper
  gRNA
accuuugcaucguucacagc

SEQ ID NO: 7006 - RNA, 20 nt, Artificial Sequence
  MKO10007006_A_Bmper
  gRNA
gccugcugugaacgaugcaa

SEQ ID NO: 7007 - RNA, 20 nt, Artificial Sequence
  MKO10007007_A_Bmper
  gRNA
agccgggguuugccacuuga

SEQ ID NO: 7008 - RNA, 20 nt, Artificial Sequence
  MKO10007008_A_Bmpr1a
  gRNA
caccgaaagcccagcuacgc

SEQ ID NO: 7009 - RNA, 20 nt, Artificial Sequence
  MKO10007009_A_Bmpr1a
  gRNA
auucuauuguccugcguagc

SEQ ID NO: 7010 - RNA, 20 nt, Artificial Sequence
  MKO10007010_A_Bmpr1a
  gRNA
uccucagguccguucuuuga

SEQ ID NO: 7011 - RNA, 20 nt, Artificial Sequence
  MKO10007011_A_Bmpr1b
  gRNA
gacgagacauacauuccucc

SEQ ID NO: 7012 - RNA, 20 nt, Artificial Sequence
  MKO10007012_A_Bmpr1b
  gRNA
aaagacaagaagcccgaccu

SEQ ID NO: 7013 - RNA, 20 nt, Artificial Sequence
  MKO10007013_A_Bmpr1b
  gRNA
gacugucuguaguuuacucu

SEQ ID NO: 7014 - RNA, 20 nt, Artificial Sequence
  MKO10007014_A_Bmpr2
  gRNA
accauaacacgugcucccuu

SEQ ID NO: 7015 - RNA, 20 nt, Artificial Sequence
  MKO10007015_A_Bmpr2
  gRNA
uugauagucgccuuauguuu

SEQ ID NO: 7016 - RNA, 20 nt, Artificial Sequence
  MKO10007016_A_Bmpr2
  gRNA
uccucuaggagaccggaaac

SEQ ID NO: 7017 - RNA, 20 nt, Artificial Sequence
  MKO10007017_A_Bms1
  gRNA
acuggagcccccaccaauag

SEQ ID NO: 7018 - RNA, 20 nt, Artificial Sequence
  MKO10007018_A_Bms1
  gRNA
cuuugauacgaugccugauu

SEQ ID NO: 7019 - RNA, 20 nt, Artificial Sequence
  MKO10007019_A_Bms1
  gRNA
ucuagcuaaaguagcagauc

SEQ ID NO: 7020 - RNA, 20 nt, Artificial Sequence
  MKO10007020_A_Bmx
  gRNA
cuguugaucaaguaucacag

SEQ ID NO: 7021 - RNA, 20 nt, Artificial Sequence
  MKO10007021_A_Bmx
  gRNA
cacugugauacuugaucaac

SEQ ID NO: 7022 - RNA, 20 nt, Artificial Sequence
  MKO10007022_A_Bmx
  gRNA
augaagagagccgaugucag

SEQ ID NO: 7023 - RNA, 20 nt, Artificial Sequence
  MKO10007023_A_Bmyc
  gRNA
agacacggcgaccgcuucgc

SEQ ID NO: 7024 - RNA, 20 nt, Artificial Sequence
  MKO10007024_A_Bmyc
  gRNA
ccgcgaccuggacuaugacu

SEQ ID NO: 7025 - RNA, 20 nt, Artificial Sequence
  MKO10007025_A_Bmyc
  gRNA
cuccacgugagccucgcuaa

SEQ ID NO: 7026 - RNA, 20 nt, Artificial Sequence
  MKO10007026_A_Bnc1
  gRNA
cgcacgccgugcagaacacc

SEQ ID NO: 7027 - RNA, 20 nt, Artificial Sequence
  MKO10007027_A_Bnc1
  gRNA
aagcacaagugcacgaucga

SEQ ID NO: 7028 - RNA, 20 nt, Artificial Sequence
  MKO10007028_A_Bnc1
  gRNA
gcuaauaucgaacaccacau

SEQ ID NO: 7029 - RNA, 20 nt, Artificial Sequence
  MKO10007029_A_Bnc2
  gRNA
ggcgucugaucacucuuaua

SEQ ID NO: 7030 - RNA, 20 nt, Artificial Sequence
  MKO10007030_A_Bnc2
  gRNA
gaagacgacgauccuaauga

SEQ ID NO: 7031 - RNA, 20 nt, Artificial Sequence
  MKO10007031_A_Bnc2
  gRNA
uacacugaucacacguccgc

SEQ ID NO: 7032 - RNA, 20 nt, Artificial Sequence
  MKO10007032_A_Bnip1
  gRNA
caagcuugccaucgacaacc

SEQ ID NO: 7033 - RNA, 20 nt, Artificial Sequence
  MKO10007033_A_Bnip1
  gRNA
cagaugauaccuuugccgua

SEQ ID NO: 7034 - RNA, 20 nt, Artificial Sequence
  MKO10007034_A_Bnip1
  gRNA
caggauauucgagauuguuc

SEQ ID NO: 7035 - RNA, 20 nt, Artificial Sequence
  MKO10007035_A_Bnip2
  gRNA
gacgccgcuggcgcauguuc

SEQ ID NO: 7036 - RNA, 20 nt, Artificial Sequence
  MKO10007036_A_Bnip2
  gRNA
caauccugaacaugcgccag

SEQ ID NO: 7037 - RNA, 20 nt, Artificial Sequence
  MKO10007037_A_Bnip2
  gRNA
ucaggcuccuuagaaguuaa

SEQ ID NO: 7038 - RNA, 20 nt, Artificial Sequence
  MKO10007038_A_Bnip3l
  gRNA
ggguacuuacccgagcccca

SEQ ID NO: 7039 - RNA, 20 nt, Artificial Sequence
  MKO10007039_A_Bnip3l
  gRNA
ucguccaacagguuccuggg

SEQ ID NO: 7040 - RNA, 20 nt, Artificial Sequence
  MKO10007040_A_Bnip3l
  gRNA
acacaccuaccugagagcug

SEQ ID NO: 7041 - RNA, 20 nt, Artificial Sequence
  MKO10007041_A_Bnip3
  gRNA
ccaagaguucucacugugac

SEQ ID NO: 7042 - RNA, 20 nt, Artificial Sequence
  MKO10007042_A_Bnip3
  gRNA
caucacuuaccccaagccaa

SEQ ID NO: 7043 - RNA, 20 nt, Artificial Sequence
  MKO10007043_A_Bnip3
  gRNA
ccugucacagugagaacucu

SEQ ID NO: 7044 - RNA, 20 nt, Artificial Sequence
  MKO10007044_A_Bnipl
  gRNA
ccggggaugcgugugcgaug

SEQ ID NO: 7045 - RNA, 20 nt, Artificial Sequence
  MKO10007045_A_Bnipl
  gRNA
gcggaaagacgcuuccgcau

SEQ ID NO: 7046 - RNA, 20 nt, Artificial Sequence
  MKO10007046_A_Bnipl
  gRNA
ccacaucgcacacgcauccc

SEQ ID NO: 7047 - RNA, 20 nt, Artificial Sequence
  MKO10007047_A_Boc
  gRNA
caagugugccgccuacaacc

SEQ ID NO: 7048 - RNA, 20 nt, Artificial Sequence
  MKO10007048_A_Boc
  gRNA
gcuuauugacaccaccagcg

SEQ ID NO: 7049 - RNA, 20 nt, Artificial Sequence
  MKO10007049_A_Boc
  gRNA
uccuuggcccaugugacucg

SEQ ID NO: 7050 - RNA, 20 nt, Artificial Sequence
  MKO10007050_A_Bod1l
  gRNA
cagugaugccaugucaaucu

SEQ ID NO: 7051 - RNA, 20 nt, Artificial Sequence
  MKO10007051_A_Bod1l
  gRNA
aaaagcugugcacgaguucc

SEQ ID NO: 7052 - RNA, 20 nt, Artificial Sequence
  MKO10007052_A_Bod1l
  gRNA
cagugaucucccuuguccag

SEQ ID NO: 7053 - RNA, 20 nt, Artificial Sequence
  MKO10007053_A_Bod1
  gRNA
gaccguccgggggcucgagu

SEQ ID NO: 7054 - RNA, 20 nt, Artificial Sequence
  MKO10007054_A_Bod1
  gRNA
uaauuucgugucaacacauc

SEQ ID NO: 7055 - RNA, 20 nt, Artificial Sequence
  MKO10007055_A_Bod1
  gRNA
ccuggccgacguggacacua

SEQ ID NO: 7056 - RNA, 20 nt, Artificial Sequence
  MKO10007056_A_Bok
  gRNA
gccacguuccgguauacgcu

SEQ ID NO: 7057 - RNA, 20 nt, Artificial Sequence
  MKO10007057_A_Bok
  gRNA
acaguccaccgcuagccccg

SEQ ID NO: 7058 - RNA, 20 nt, Artificial Sequence
  MKO10007058_A_Bok
  gRNA
agauccgucccagcguauac

SEQ ID NO: 7059 - RNA, 20 nt, Artificial Sequence
  MKO10007059_A_Bola1
  gRNA
ccacgcgcucguguguaucg

SEQ ID NO: 7060 - RNA, 20 nt, Artificial Sequence
  MKO10007060_A_Bola1
  gRNA
agccgcuauucgcgccaaau

SEQ ID NO: 7061 - RNA, 20 nt, Artificial Sequence
  MKO10007061_A_Bola1
  gRNA
accaaccggugccguugcaa

SEQ ID NO: 7062 - RNA, 20 nt, Artificial Sequence
  MKO10007062_A_Bola2
  gRNA
cgaacuuagccgacaccacc

SEQ ID NO: 7063 - RNA, 20 nt, Artificial Sequence
  MKO10007063_A_Bola2
  gRNA
ccugccgcagcuucucgcgg

SEQ ID NO: 7064 - RNA, 20 nt, Artificial Sequence
  MKO10007064_A_Bola2
  gRNA
acccgacagcggcgugaaug

SEQ ID NO: 7065 - RNA, 20 nt, Artificial Sequence
  MKO10007065_A_Bola3
  gRNA
ccgcggcucccgcgcagcag

SEQ ID NO: 7066 - RNA, 20 nt, Artificial Sequence
  MKO10007066_A_Bola3
  gRNA
cacugaccugauugaccauc

SEQ ID NO: 7067 - RNA, 20 nt, Artificial Sequence
  MKO10007067_A_Bola3
  gRNA
gaguucccccuccgucugag

SEQ ID NO: 7068 - RNA, 20 nt, Artificial Sequence
  MKO10007068_A_Boll
  gRNA
ccgucuugcgcaauuucuac

SEQ ID NO: 7069 - RNA, 20 nt, Artificial Sequence
  MKO10007069_A_Boll
  gRNA
ccaguagaaauugcgcaaga

SEQ ID NO: 7070 - RNA, 20 nt, Artificial Sequence
  MKO10007070_A_Boll
  gRNA
ucuagucucaugccagcggc

SEQ ID NO: 7071 - RNA, 20 nt, Artificial Sequence
  MKO10007071_A_Bop1
  gRNA
cgagcucaucucguguccgc

SEQ ID NO: 7072 - RNA, 20 nt, Artificial Sequence
  MKO10007072_A_Bop1
  gRNA
ggaauucaucguaccaugcc

SEQ ID NO: 7073 - RNA, 20 nt, Artificial Sequence
  MKO10007073_A_Bop1
  gRNA
augguugucuucgucaccgc

SEQ ID NO: 7074 - RNA, 20 nt, Artificial Sequence
  MKO10007074_A_Bora
  gRNA
cccuguagagaucgauccag

SEQ ID NO: 7075 - RNA, 20 nt, Artificial Sequence
  MKO10007075_A_Bora
  gRNA
ccuaccguugcacuucugug

SEQ ID NO: 7076 - RNA, 20 nt, Artificial Sequence
  MKO10007076_A_Bora
  gRNA
aucggcaggcuuccuaccua

SEQ ID NO: 7077 - RNA, 20 nt, Artificial Sequence
  MKO10007077_A_Bpgm
  gRNA
augagaaccugcgugccguu

SEQ ID NO: 7078 - RNA, 20 nt, Artificial Sequence
  MKO10007078_A_Bpgm
  gRNA
gauugcuccggaaaucuuaa

SEQ ID NO: 7079 - RNA, 20 nt, Artificial Sequence
  MKO10007079_A_Bpgm
  gRNA
ggugaggcccaacggcacgc

SEQ ID NO: 7080 - RNA, 20 nt, Artificial Sequence
  MKO10007080_A_Bphl
  gRNA
ucaccugcauuaccagcgcg

SEQ ID NO: 7081 - RNA, 20 nt, Artificial Sequence
  MKO10007081_A_Bphl
  gRNA
cccaucuuauauccgcaaga

SEQ ID NO: 7082 - RNA, 20 nt, Artificial Sequence
  MKO10007082_A_Bphl
  gRNA
guauccgagauguuucuaaa

SEQ ID NO: 7083 - RNA, 20 nt, Artificial Sequence
  MKO10007083_A_Bpifa1
  gRNA
acauagagacgauggccauc

SEQ ID NO: 7084 - RNA, 20 nt, Artificial Sequence
  MKO10007084_A_Bpifa1
  gRNA
cuuagccgugaaagacaauc

SEQ ID NO: 7085 - RNA, 20 nt, Artificial Sequence
  MKO10007085_A_Bpifa1
  gRNA
cucacucgaggauguuguuc

SEQ ID NO: 7086 - RNA, 20 nt, Artificial Sequence
  MKO10007086_A_Bpifa2
  gRNA
cauugaucugacggugcccu

SEQ ID NO: 7087 - RNA, 20 nt, Artificial Sequence
  MKO10007087_A_Bpifa2
  gRNA
ucgaccgucuugccaaugaa

SEQ ID NO: 7088 - RNA, 20 nt, Artificial Sequence
  MKO10007088_A_Bpifa2
  gRNA
cagaucaaugccauugccgu

SEQ ID NO: 7089 - RNA, 20 nt, Artificial Sequence
  MKO10007089_A_Bpifa3
  gRNA
uuugaugauauucgaauuga

SEQ ID NO: 7090 - RNA, 20 nt, Artificial Sequence
  MKO10007090_A_Bpifa3
  gRNA
uccaauuccaguuauugcac

SEQ ID NO: 7091 - RNA, 20 nt, Artificial Sequence
  MKO10007091_A_Bpifa3
  gRNA
cuccugaagcucaaugcaga

SEQ ID NO: 7092 - RNA, 20 nt, Artificial Sequence
  MKO10007092_A_Bpifa5
  gRNA
ggugacuguauauacccucc

SEQ ID NO: 7093 - RNA, 20 nt, Artificial Sequence
  MKO10007093_A_Bpifa5
  gRNA
uuggccuuaccuauuaagca

SEQ ID NO: 7094 - RNA, 20 nt, Artificial Sequence
  MKO10007094_A_Bpifa5
  gRNA
agucacuaauccccagcuac

SEQ ID NO: 7095 - RNA, 20 nt, Artificial Sequence
  MKO10007095_A_Bpifa6
  gRNA
ucgacauuguccagcuguca

SEQ ID NO: 7096 - RNA, 20 nt, Artificial Sequence
  MKO10007096_A_Bpifa6
  gRNA
cagguugauuaagcucaccc

SEQ ID NO: 7097 - RNA, 20 nt, Artificial Sequence
  MKO10007097_A_Bpifa6
  gRNA
aaagcuacaaacgcuacucc

SEQ ID NO: 7098 - RNA, 20 nt, Artificial Sequence
  MKO10007098_A_Bpifb1
  gRNA
gugcacgaagcuguccagua

SEQ ID NO: 7099 - RNA, 20 nt, Artificial Sequence
  MKO10007099_A_Bpifb1
  gRNA
ccguucugagauacaucaua

SEQ ID NO: 7100 - RNA, 20 nt, Artificial Sequence
  MKO10007100_A_Bpifb1
  gRNA
cuuggaccucggugcucauu

SEQ ID NO: 7101 - RNA, 20 nt, Artificial Sequence
  MKO10007101_A_Bpifb2
  gRNA
gaccccacagugucggacau

SEQ ID NO: 7102 - RNA, 20 nt, Artificial Sequence
  MKO10007102_A_Bpifb2
  gRNA
ccucccaggagcugcucgac

SEQ ID NO: 7103 - RNA, 20 nt, Artificial Sequence
  MKO10007103_A_Bpifb2
  gRNA
caagggucccaauagagucc

SEQ ID NO: 7104 - RNA, 20 nt, Artificial Sequence
  MKO10007104_A_Bpifb3
  gRNA
ugcugcagcgcuuaaggaca

SEQ ID NO: 7105 - RNA, 20 nt, Artificial Sequence
  MKO10007105_A_Bpifb3
  gRNA
uaagcgcugcagcacgcucc

SEQ ID NO: 7106 - RNA, 20 nt, Artificial Sequence
  MKO10007106_A_Bpifb3
  gRNA
cugcugcccacgccaaucuu

SEQ ID NO: 7107 - RNA, 20 nt, Artificial Sequence
  MKO10007107_A_Bpifb4
  gRNA
ggcucuaccggcgcgaacug

SEQ ID NO: 7108 - RNA, 20 nt, Artificial Sequence
  MKO10007108_A_Bpifb4
  gRNA
cggcugaccauggaccgcac

SEQ ID NO: 7109 - RNA, 20 nt, Artificial Sequence
  MKO10007109_A_Bpifb4
  gRNA
ggcauccuaagcaccguaca

SEQ ID NO: 7110 - RNA, 20 nt, Artificial Sequence
  MKO10007110_A_Bpifb5
  gRNA
aacgagcuccucucugacga

SEQ ID NO: 7111 - RNA, 20 nt, Artificial Sequence
  MKO10007111_A_Bpifb5
  gRNA
gccaucaagaacauacgaau

SEQ ID NO: 7112 - RNA, 20 nt, Artificial Sequence
  MKO10007112_A_Bpifb5
  gRNA
uccaauucguauguucuuga

SEQ ID NO: 7113 - RNA, 20 nt, Artificial Sequence
  MKO10007113_A_Bpifb6
  gRNA
gaggcuagcaauccgcagcc

SEQ ID NO: 7114 - RNA, 20 nt, Artificial Sequence
  MKO10007114_A_Bpifb6
  gRNA
acccugcgcaaaguccuccc

SEQ ID NO: 7115 - RNA, 20 nt, Artificial Sequence
  MKO10007115_A_Bpifb6
  gRNA
ggacaccuuacuuguuaggc

SEQ ID NO: 7116 - RNA, 20 nt, Artificial Sequence
  MKO10007116_A_Bpifb9a
  gRNA
cgguauaaaagaugccauuc

SEQ ID NO: 7117 - RNA, 20 nt, Artificial Sequence
  MKO10007117_A_Bpifb9a
  gRNA
uucauucacuuucuccugaa

SEQ ID NO: 7118 - RNA, 20 nt, Artificial Sequence
  MKO10007118_A_Bpifb9a
  gRNA
ucugccugugccucugcccu

SEQ ID NO: 7119 - RNA, 20 nt, Artificial Sequence
  MKO10007119_A_Bpifb9b
  gRNA
cgguauaaaagaugcgauuc

SEQ ID NO: 7120 - RNA, 20 nt, Artificial Sequence
  MKO10007120_A_Bpifb9b
  gRNA
gcugccugugccucugcccu

SEQ ID NO: 7121 - RNA, 20 nt, Artificial Sequence
  MKO10007121_A_Bpifb9b
  gRNA
aucuugagcacaucguuaag

SEQ ID NO: 7122 - RNA, 20 nt, Artificial Sequence
  MKO10007122_A_Bpifc
  gRNA
ucuccgagcagccgagacuc

SEQ ID NO: 7123 - RNA, 20 nt, Artificial Sequence
  MKO10007123_A_Bpifc
  gRNA
gccuuuacccguaaugacuu

SEQ ID NO: 7124 - RNA, 20 nt, Artificial Sequence
  MKO10007124_A_Bpifc
  gRNA
gacucagaaccguucaaauc

SEQ ID NO: 7125 - RNA, 20 nt, Artificial Sequence
  MKO10007125_A_Bpi
  gRNA
gccucaccuguagaauucgu

SEQ ID NO: 7126 - RNA, 20 nt, Artificial Sequence
  MKO10007126_A_Bpi
  gRNA
aggguuccuacgaauucuac

SEQ ID NO: 7127 - RNA, 20 nt, Artificial Sequence
  MKO10007127_A_Bpi
  gRNA
caucuccaccgaccugauuc

SEQ ID NO: 7128 - RNA, 20 nt, Artificial Sequence
  MKO10007128_A_Bpnt1
  gRNA
ccagccguauuacaacuacc

SEQ ID NO: 7129 - RNA, 20 nt, Artificial Sequence
  MKO10007129_A_Bpnt1
  gRNA
gcuucgggaacuuccgggcc

SEQ ID NO: 7130 - RNA, 20 nt, Artificial Sequence
  MKO10007130_A_Bpnt1
  gRNA
aguaccugguaguuguaaua

SEQ ID NO: 7131 - RNA, 20 nt, Artificial Sequence
  MKO10007131_A_Bptf
  gRNA
uacguucgacacgaaccuau

SEQ ID NO: 7132 - RNA, 20 nt, Artificial Sequence
  MKO10007132_A_Bptf
  gRNA
aauagguucgugucgaacgu

SEQ ID NO: 7133 - RNA, 20 nt, Artificial Sequence
  MKO10007133_A_Bptf
  gRNA
gaccugaccaacaaggcucg

SEQ ID NO: 7134 - RNA, 20 nt, Artificial Sequence
  MKO10007134_A_Braf
  gRNA
ucauagguacccgcaagaug

SEQ ID NO: 7135 - RNA, 20 nt, Artificial Sequence
  MKO10007135_A_Braf
  gRNA
gaggcccuauuggacaaauu

SEQ ID NO: 7136 - RNA, 20 nt, Artificial Sequence
  MKO10007136_A_Braf
  gRNA
guuguuccgugaugcaucug

SEQ ID NO: 7137 - RNA, 20 nt, Artificial Sequence
  MKO10007137_A_Brap
  gRNA
ucacauccgucauuucccga

SEQ ID NO: 7138 - RNA, 20 nt, Artificial Sequence
  MKO10007138_A_Brap
  gRNA
cccuucuagacaggcgacag

SEQ ID NO: 7139 - RNA, 20 nt, Artificial Sequence
  MKO10007139_A_Brap
  gRNA
cucuacuccgaaucaguaca

SEQ ID NO: 7140 - RNA, 20 nt, Artificial Sequence
  MKO10007140_A_Brau1
  gRNA
gggguuauggcagcgcccga

SEQ ID NO: 7141 - RNA, 20 nt, Artificial Sequence
  MKO10007141_A_Brau1
  gRNA
uccaugagcgcgugcacggc

SEQ ID NO: 7142 - RNA, 20 nt, Artificial Sequence
  MKO10007142_A_Brau1
  gRNA
acccuagggcucacguccug

SEQ ID NO: 7143 - RNA, 20 nt, Artificial Sequence
  MKO10007143_A_Brca1
  gRNA
ggcgucgaucauccagagcg

SEQ ID NO: 7144 - RNA, 20 nt, Artificial Sequence
  MKO10007144_A_Brca1
  gRNA
gcuaccggaaccgugucaga

SEQ ID NO: 7145 - RNA, 20 nt, Artificial Sequence
  MKO10007145_A_Brca1
  gRNA
guuaucucauucuuacacaa

SEQ ID NO: 7146 - RNA, 20 nt, Artificial Sequence
  MKO10007146_A_Brca2
  gRNA
uaggaccgauaagccucaau

SEQ ID NO: 7147 - RNA, 20 nt, Artificial Sequence
  MKO10007147_A_Brca2
  gRNA
aaagcuccucaaaccaauug

SEQ ID NO: 7148 - RNA, 20 nt, Artificial Sequence
  MKO10007148_A_Brca2
  gRNA
ggacuagcaacaucuaccac

SEQ ID NO: 7149 - RNA, 20 nt, Artificial Sequence
  MKO10007149_A_Brcc3
  gRNA
aaugcgcacaguccaagaaa

SEQ ID NO: 7150 - RNA, 20 nt, Artificial Sequence
  MKO10007150_A_Brcc3
  gRNA
uccauucugucaucaucuug

SEQ ID NO: 7151 - RNA, 20 nt, Artificial Sequence
  MKO10007151_A_Brcc3
  gRNA
ucuaguugaaugaugacaua

SEQ ID NO: 7152 - RNA, 20 nt, Artificial Sequence
  MKO10007152_A_Brd1
  gRNA
auuaaauaggauugcgaauc

SEQ ID NO: 7153 - RNA, 20 nt, Artificial Sequence
  MKO10007153_A_Brd1
  gRNA
ugcgcagcagcucaauuagc

SEQ ID NO: 7154 - RNA, 20 nt, Artificial Sequence
  MKO10007154_A_Brd1
  gRNA
uaauugagcugcugcgcaag

SEQ ID NO: 7155 - RNA, 20 nt, Artificial Sequence
  MKO10007155_A_Brd2
  gRNA
aguugguuuguuacccgucc

SEQ ID NO: 7156 - RNA, 20 nt, Artificial Sequence
  MKO10007156_A_Brd2
  gRNA
gggcacugguaauacugccc

SEQ ID NO: 7157 - RNA, 20 nt, Artificial Sequence
  MKO10007157_A_Brd2
  gRNA
caguauuaccagugcccauc

SEQ ID NO: 7158 - RNA, 20 nt, Artificial Sequence
  MKO10007158_A_Brd3
  gRNA
cacggggaucccggcagucc

SEQ ID NO: 7159 - RNA, 20 nt, Artificial Sequence
  MKO10007159_A_Brd3
  gRNA
agucuuucgcccgggcuugc

SEQ ID NO: 7160 - RNA, 20 nt, Artificial Sequence
  MKO10007160_A_Brd3
  gRNA
ucccacaccgccuguaguca

SEQ ID NO: 7161 - RNA, 20 nt, Artificial Sequence
  MKO10007161_A_Brd4
  gRNA
gggccugcguuguagacauu

SEQ ID NO: 7162 - RNA, 20 nt, Artificial Sequence
  MKO10007162_A_Brd4
  gRNA
gcuggaaaggccacgcaaac

SEQ ID NO: 7163 - RNA, 20 nt, Artificial Sequence
  MKO10007163_A_Brd4
  gRNA
gggguggucgcaaugauggg

SEQ ID NO: 7164 - RNA, 20 nt, Artificial Sequence
  MKO10007164_A_Brd7
  gRNA
ggcgcaauaaaauccgucac

SEQ ID NO: 7165 - RNA, 20 nt, Artificial Sequence
  MKO10007165_A_Brd7
  gRNA
ccucgcuccccccgacuuug

SEQ ID NO: 7166 - RNA, 20 nt, Artificial Sequence
  MKO10007166_A_Brd7
  gRNA
ccucaaagucggggggagcg

SEQ ID NO: 7167 - RNA, 20 nt, Artificial Sequence
  MKO10007167_A_Brd8
  gRNA
aucaagcccuuugcagaacc

SEQ ID NO: 7168 - RNA, 20 nt, Artificial Sequence
  MKO10007168_A_Brd8
  gRNA
gagcacaagcugcugaguac

SEQ ID NO: 7169 - RNA, 20 nt, Artificial Sequence
  MKO10007169_A_Brd8
  gRNA
augcuaaacacaacuucucu

SEQ ID NO: 7170 - RNA, 20 nt, Artificial Sequence
  MKO10007170_A_Brd9
  gRNA
ugagcgaucgucguaguagc

SEQ ID NO: 7171 - RNA, 20 nt, Artificial Sequence
  MKO10007171_A_Brd9
  gRNA
acgaucgcucagaccacgaa

SEQ ID NO: 7172 - RNA, 20 nt, Artificial Sequence
  MKO10007172_A_Brd9
  gRNA
gaggcugaugcuuucgaccc

SEQ ID NO: 7173 - RNA, 20 nt, Artificial Sequence
  MKO10007173_A_Brdt
  gRNA
aaagacauucucugccgcuu

SEQ ID NO: 7174 - RNA, 20 nt, Artificial Sequence
  MKO10007174_A_Brdt
  gRNA
gaucugugacucgcagucuc

SEQ ID NO: 7175 - RNA, 20 nt, Artificial Sequence
  MKO10007175_A_Brdt
  gRNA
acaauagcuguuugucgacu

SEQ ID NO: 7176 - RNA, 20 nt, Artificial Sequence
  MKO10007176_A_Bre
  gRNA
guuugaguaccagacgcucc

SEQ ID NO: 7177 - RNA, 20 nt, Artificial Sequence
  MKO10007177_A_Bre
  gRNA
uguccuuucagugcacucgg

SEQ ID NO: 7178 - RNA, 20 nt, Artificial Sequence
  MKO10007178_A_Bre
  gRNA
cugacacuuacugcucaauu

SEQ ID NO: 7179 - RNA, 20 nt, Artificial Sequence
  MKO10007179_A_Brf1
  gRNA
ugcaucaacgcaccagcuau

SEQ ID NO: 7180 - RNA, 20 nt, Artificial Sequence
  MKO10007180_A_Brf1
  gRNA
agacguuccugcucuuggcg

SEQ ID NO: 7181 - RNA, 20 nt, Artificial Sequence
  MKO10007181_A_Brf1
  gRNA
agguggcuuucacgugaacu

SEQ ID NO: 7182 - RNA, 20 nt, Artificial Sequence
  MKO10007182_A_Brf2
  gRNA
uuccaucucgaaaagccguu

SEQ ID NO: 7183 - RNA, 20 nt, Artificial Sequence
  MKO10007183_A_Brf2
  gRNA
gggccaguuauguugccgac

SEQ ID NO: 7184 - RNA, 20 nt, Artificial Sequence
  MKO10007184_A_Brf2
  gRNA
gaaguugcccucgucgcuaa

SEQ ID NO: 7185 - RNA, 20 nt, Artificial Sequence
  MKO10007185_A_Bri3bp
  gRNA
cgagaaccuugaccgcucca

SEQ ID NO: 7186 - RNA, 20 nt, Artificial Sequence
  MKO10007186_A_Bri3bp
  gRNA
agugcuaccgcucugcgucg

SEQ ID NO: 7187 - RNA, 20 nt, Artificial Sequence
  MKO10007187_A_Bri3bp
  gRNA
agaagcugcucgucgcgcgc

SEQ ID NO: 7188 - RNA, 20 nt, Artificial Sequence
  MKO10007188_A_Bri3
  gRNA
ccccguaagacgcccagaag

SEQ ID NO: 7189 - RNA, 20 nt, Artificial Sequence
  MKO10007189_A_Bri3
  gRNA
accgggugaccguucgacug

SEQ ID NO: 7190 - RNA, 20 nt, Artificial Sequence
  MKO10007190_A_Bri3
  gRNA
uccgaccacgacgauggagu

SEQ ID NO: 7191 - RNA, 20 nt, Artificial Sequence
  MKO10007191_A_Bricd5
  gRNA
gcccaaccaaacuacucuag

SEQ ID NO: 7192 - RNA, 20 nt, Artificial Sequence
  MKO10007192_A_Bricd5
  gRNA
gcauaguggguaucccggcc

SEQ ID NO: 7193 - RNA, 20 nt, Artificial Sequence
  MKO10007193_A_Bricd5
  gRNA
ccagaacauggcaaccaucg

SEQ ID NO: 7194 - RNA, 20 nt, Artificial Sequence
  MKO10007194_A_Brinp1
  gRNA
uaggucacagaaacacgcac

SEQ ID NO: 7195 - RNA, 20 nt, Artificial Sequence
  MKO10007195_A_Brinp1
  gRNA
ccagcguaaacuccaugauc

SEQ ID NO: 7196 - RNA, 20 nt, Artificial Sequence
  MKO10007196_A_Brinp1
  gRNA
uccuacuuugucgaccguga

SEQ ID NO: 7197 - RNA, 20 nt, Artificial Sequence
  MKO10007197_A_Brinp2
  gRNA
uuccaaggaggcggauauug

SEQ ID NO: 7198 - RNA, 20 nt, Artificial Sequence
  MKO10007198_A_Brinp2
  gRNA
cagccacgaaccgcucacgc

SEQ ID NO: 7199 - RNA, 20 nt, Artificial Sequence
  MKO10007199_A_Brinp2
  gRNA
guccgcaauauccgccuccu

SEQ ID NO: 7200 - RNA, 20 nt, Artificial Sequence
  MKO10007200_A_Brinp3
  gRNA
ggauauggugaagucugcga

SEQ ID NO: 7201 - RNA, 20 nt, Artificial Sequence
  MKO10007201_A_Brinp3
  gRNA
caauaguucgucuguuaccc

SEQ ID NO: 7202 - RNA, 20 nt, Artificial Sequence
  MKO10007202_A_Brinp3
  gRNA
ccuguacaaaacguuccuga

SEQ ID NO: 7203 - RNA, 20 nt, Artificial Sequence
  MKO10007203_A_Brip1
  gRNA
guaaagccugagucuccgau

SEQ ID NO: 7204 - RNA, 20 nt, Artificial Sequence
  MKO10007204_A_Brip1
  gRNA
gacuuuccuaucggagacuc

SEQ ID NO: 7205 - RNA, 20 nt, Artificial Sequence
  MKO10007205_A_Brip1
  gRNA
guccagguuugugucgcugu

SEQ ID NO: 7206 - RNA, 20 nt, Artificial Sequence
  MKO10007206_A_Brix1
  gRNA
cagaacaagacacuuaaugc

SEQ ID NO: 7207 - RNA, 20 nt, Artificial Sequence
  MKO10007207_A_Brix1
  gRNA
uugaugccucauucuaaagc

SEQ ID NO: 7208 - RNA, 20 nt, Artificial Sequence
  MKO10007208_A_Brix1
  gRNA
aggcuuucaaauucaccuca

SEQ ID NO: 7209 - RNA, 20 nt, Artificial Sequence
  MKO10007209_A_Brk1
  gRNA
ggccgccauggcgggacaag

SEQ ID NO: 7210 - RNA, 20 nt, Artificial Sequence
  MKO10007210_A_Brk1
  gRNA
uguacucuauucuccguuca

SEQ ID NO: 7211 - RNA, 20 nt, Artificial Sequence
  MKO10007211_A_Brk1
  gRNA
gaauagaguacauugaagcg

SEQ ID NO: 7212 - RNA, 20 nt, Artificial Sequence
  MKO10007212_A_Brms1l
  gRNA
cacagcaucgacauuaccuc

SEQ ID NO: 7213 - RNA, 20 nt, Artificial Sequence
  MKO10007213_A_Brms1l
  gRNA
aaacaugcagauucgcacaa

SEQ ID NO: 7214 - RNA, 20 nt, Artificial Sequence
  MKO10007214_A_Brms1l
  gRNA
cacaaugcugucgagaagcc

SEQ ID NO: 7215 - RNA, 20 nt, Artificial Sequence
  MKO10007215_A_Brms1
  gRNA
ccuccagucguaaacguagc

SEQ ID NO: 7216 - RNA, 20 nt, Artificial Sequence
  MKO10007216_A_Brms1
  gRNA
cagccagcuacguuuacgac

SEQ ID NO: 7217 - RNA, 20 nt, Artificial Sequence
  MKO10007217_A_Brms1
  gRNA
gcucaccuccagguguuguu

SEQ ID NO: 7218 - RNA, 20 nt, Artificial Sequence
  MKO10007218_A_Brox
  gRNA
cauugcaaggacacguuccg

SEQ ID NO: 7219 - RNA, 20 nt, Artificial Sequence
  MKO10007219_A_Brox
  gRNA
uaagugacuugagguccgcc

SEQ ID NO: 7220 - RNA, 20 nt, Artificial Sequence
  MKO10007220_A_Brox
  gRNA
uauagguuucauaaauucag

SEQ ID NO: 7221 - RNA, 20 nt, Artificial Sequence
  MKO10007221_A_Brpf1
  gRNA
ugucuugcggacgcuaaagg

SEQ ID NO: 7222 - RNA, 20 nt, Artificial Sequence
  MKO10007222_A_Brpf1
  gRNA
ccaaccgccugaccauccag

SEQ ID NO: 7223 - RNA, 20 nt, Artificial Sequence
  MKO10007223_A_Brpf1
  gRNA
cugaaacgacaaucacggaa

SEQ ID NO: 7224 - RNA, 20 nt, Artificial Sequence
  MKO10007224_A_Brpf3
  gRNA
ugaucgagcucauccgcaaa

SEQ ID NO: 7225 - RNA, 20 nt, Artificial Sequence
  MKO10007225_A_Brpf3
  gRNA
ggaacggugucccccucauc

SEQ ID NO: 7226 - RNA, 20 nt, Artificial Sequence
  MKO10007226_A_Brpf3
  gRNA
guccucaacaggaccguaaa

SEQ ID NO: 7227 - RNA, 20 nt, Artificial Sequence
  MKO10007227_A_Brs3
  gRNA
uccuuuauguguaguaucgu

SEQ ID NO: 7228 - RNA, 20 nt, Artificial Sequence
  MKO10007228_A_Brs3
  gRNA
guuccucagucgguauguuc

SEQ ID NO: 7229 - RNA, 20 nt, Artificial Sequence
  MKO10007229_A_Brs3
  gRNA
acaaagccaugcccgaaagc

SEQ ID NO: 7230 - RNA, 20 nt, Artificial Sequence
  MKO10007230_A_Brsk1
  gRNA
ucuuguucucguagacgucg

SEQ ID NO: 7231 - RNA, 20 nt, Artificial Sequence
  MKO10007231_A_Brsk1
  gRNA
uauggcgucccugcaagugg

SEQ ID NO: 7232 - RNA, 20 nt, Artificial Sequence
  MKO10007232_A_Brsk1
  gRNA
ccauaccaaagucugcgaug

SEQ ID NO: 7233 - RNA, 20 nt, Artificial Sequence
  MKO10007233_A_Brsk2
  gRNA
cccgggagcgaugacaucga

SEQ ID NO: 7234 - RNA, 20 nt, Artificial Sequence
  MKO10007234_A_Brsk2
  gRNA
ggcgcagcacgcgcaguaug

SEQ ID NO: 7235 - RNA, 20 nt, Artificial Sequence
  MKO10007235_A_Brsk2
  gRNA
cuggcucgcaccauauggag

SEQ ID NO: 7236 - RNA, 20 nt, Artificial Sequence
  MKO10007236_A_Brwd1
  gRNA
accggacgucgggccggcga

SEQ ID NO: 7237 - RNA, 20 nt, Artificial Sequence
  MKO10007237_A_Brwd1
  gRNA
cgccauggcggagccuucgc

SEQ ID NO: 7238 - RNA, 20 nt, Artificial Sequence
  MKO10007238_A_Brwd1
  gRNA
cggcacucaccugcgccgcu

SEQ ID NO: 7239 - RNA, 20 nt, Artificial Sequence
  MKO10007239_A_Brwd3
  gRNA
agcuguauuaccugaucgca

SEQ ID NO: 7240 - RNA, 20 nt, Artificial Sequence
  MKO10007240_A_Brwd3
  gRNA
ugauuccgcgccgcuuagac

SEQ ID NO: 7241 - RNA, 20 nt, Artificial Sequence
  MKO10007241_A_Brwd3
  gRNA
caccugagcggauuuguuac

SEQ ID NO: 7242 - RNA, 20 nt, Artificial Sequence
  MKO10007242_A_Bscl2
  gRNA
cuacuacuccuacaugccga

SEQ ID NO: 7243 - RNA, 20 nt, Artificial Sequence
  MKO10007243_A_Bscl2
  gRNA
acagcagcgugucgagcacc

SEQ ID NO: 7244 - RNA, 20 nt, Artificial Sequence
  MKO10007244_A_Bscl2
  gRNA
guggcugaccgucggcaugu

SEQ ID NO: 7245 - RNA, 20 nt, Artificial Sequence
  MKO10007245_A_Bsdc1
  gRNA
aauaccuuggugccgucaua

SEQ ID NO: 7246 - RNA, 20 nt, Artificial Sequence
  MKO10007246_A_Bsdc1
  gRNA
aucagguucguugcaguacg

SEQ ID NO: 7247 - RNA, 20 nt, Artificial Sequence
  MKO10007247_A_Bsdc1
  gRNA
acguacugcaacgaaccuga

SEQ ID NO: 7248 - RNA, 20 nt, Artificial Sequence
  MKO10007248_A_Bsg
  gRNA
uugacaucguuggccaccgc

SEQ ID NO: 7249 - RNA, 20 nt, Artificial Sequence
  MKO10007249_A_Bsg
  gRNA
uuggccgcucaagagcguga

SEQ ID NO: 7250 - RNA, 20 nt, Artificial Sequence
  MKO10007250_A_Bsg
  gRNA
guggacgcagaugaccgcuc

SEQ ID NO: 7251 - RNA, 20 nt, Artificial Sequence
  MKO10007251_A_Bsnd
  gRNA
uaugagccacgaucgacccc

SEQ ID NO: 7252 - RNA, 20 nt, Artificial Sequence
  MKO10007252_A_Bsnd
  gRNA
gcuccgguggucguccauag

SEQ ID NO: 7253 - RNA, 20 nt, Artificial Sequence
  MKO10007253_A_Bsnd
  gRNA
aggcgagccucguacugcuc

SEQ ID NO: 7254 - RNA, 20 nt, Artificial Sequence
  MKO10007254_A_Bsn
  gRNA
uguggaggccggcaacguag

SEQ ID NO: 7255 - RNA, 20 nt, Artificial Sequence
  MKO10007255_A_Bsn
  gRNA
acggccccuuaagagugcgg

SEQ ID NO: 7256 - RNA, 20 nt, Artificial Sequence
  MKO10007256_A_Bsn
  gRNA
aaguccccgcaggacgcugc

SEQ ID NO: 7257 - RNA, 20 nt, Artificial Sequence
  MKO10007257_A_Bsph1
  gRNA
gauuauuaugcaccaacuau

SEQ ID NO: 7258 - RNA, 20 nt, Artificial Sequence
  MKO10007258_A_Bsph1
  gRNA
gaucauaugucuguaccaga

SEQ ID NO: 7259 - RNA, 20 nt, Artificial Sequence
  MKO10007259_A_Bsph1
  gRNA
ucuuugaacaagacuuacca

SEQ ID NO: 7260 - RNA, 20 nt, Artificial Sequence
  MKO10007260_A_Bsph2
  gRNA
gcucauuaagaagugcacca

SEQ ID NO: 7261 - RNA, 20 nt, Artificial Sequence
  MKO10007261_A_Bsph2
  gRNA
uacaguaccgccaccuuccu

SEQ ID NO: 7262 - RNA, 20 nt, Artificial Sequence
  MKO10007262_A_Bsph2
  gRNA
auucaaaauauagcccuccu

SEQ ID NO: 7263 - RNA, 20 nt, Artificial Sequence
  MKO10007263_A_Bspry
  gRNA
agcuuaauuucuccgaaucc

SEQ ID NO: 7264 - RNA, 20 nt, Artificial Sequence
  MKO10007264_A_Bspry
  gRNA
aggucauggcuagugcagcg

SEQ ID NO: 7265 - RNA, 20 nt, Artificial Sequence
  MKO10007265_A_Bspry
  gRNA
caucuccaaguauauggccg

SEQ ID NO: 7266 - RNA, 20 nt, Artificial Sequence
  MKO10007266_A_Bst1
  gRNA
ggagaacacccgccgccucg

SEQ ID NO: 7267 - RNA, 20 nt, Artificial Sequence
  MKO10007267_A_Bst1
  gRNA
ccccauagcucauaacgagc

SEQ ID NO: 7268 - RNA, 20 nt, Artificial Sequence
  MKO10007268_A_Bst1
  gRNA
agacugugaaaacaacgccg

SEQ ID NO: 7269 - RNA, 20 nt, Artificial Sequence
  MKO10007269_A_Bst2
  gRNA
cgcucgcaacccgucucuac

SEQ ID NO: 7270 - RNA, 20 nt, Artificial Sequence
  MKO10007270_A_Bst2
  gRNA
uagagacggguugcgagcgc

SEQ ID NO: 7271 - RNA, 20 nt, Artificial Sequence
  MKO10007271_A_Bst2
  gRNA
gugacacuuugagcaccagu

SEQ ID NO: 7272 - RNA, 20 nt, Artificial Sequence
  MKO10007272_A_Bsx
  gRNA
uccggcccgucugccgcuuu

SEQ ID NO: 7273 - RNA, 20 nt, Artificial Sequence
  MKO10007273_A_Bsx
  gRNA
ccugucgacgccagagcgug

SEQ ID NO: 7274 - RNA, 20 nt, Artificial Sequence
  MKO10007274_A_Bsx
  gRNA
ugcgggaacagcgccgggac

SEQ ID NO: 7275 - RNA, 20 nt, Artificial Sequence
  MKO10007275_A_Buaf1
  gRNA
ugggauacccggauugcagc

SEQ ID NO: 7276 - RNA, 20 nt, Artificial Sequence
  MKO10007276_A_Buaf1
  gRNA
auaugcagauuguuacagca

SEQ ID NO: 7277 - RNA, 20 nt, Artificial Sequence
  MKO10007277_A_Buaf1
  gRNA
uagugaaaaacgugccugag

SEQ ID NO: 7278 - RNA, 20 nt, Artificial Sequence
  MKO10007278_A_Btbd10
  gRNA
agcuaccaucugagcuugac

SEQ ID NO: 7279 - RNA, 20 nt, Artificial Sequence
  MKO10007279_A_Btbd10
  gRNA
uuucacacgucccaaugaga

SEQ ID NO: 7280 - RNA, 20 nt, Artificial Sequence
  MKO10007280_A_Btbd10
  gRNA
cuccaggauuacuauaagac

SEQ ID NO: 7281 - RNA, 20 nt, Artificial Sequence
  MKO10007281_A_Btbd11
  gRNA
uugauguacgccugcguccg

SEQ ID NO: 7282 - RNA, 20 nt, Artificial Sequence
  MKO10007282_A_Btbd11
  gRNA
aaucaacaccaugagcgaac

SEQ ID NO: 7283 - RNA, 20 nt, Artificial Sequence
  MKO10007283_A_Btbd11
  gRNA
acgauguccgccaagccgcc

SEQ ID NO: 7284 - RNA, 20 nt, Artificial Sequence
  MKO10007284_A_Btbd16
  gRNA
uuggggaaaacgccaucggu

SEQ ID NO: 7285 - RNA, 20 nt, Artificial Sequence
  MKO10007285_A_Btbd16
  gRNA
uuguuggugcaaccaaccga

SEQ ID NO: 7286 - RNA, 20 nt, Artificial Sequence
  MKO10007286_A_Btbd16
  gRNA
gacgugauccuugaaugccu

SEQ ID NO: 7287 - RNA, 20 nt, Artificial Sequence
  MKO10007287_A_Btbd17
  gRNA
cagcuugcggccggucuacg

SEQ ID NO: 7288 - RNA, 20 nt, Artificial Sequence
  MKO10007288_A_Btbd17
  gRNA
guggucaugacgcgggucgc

SEQ ID NO: 7289 - RNA, 20 nt, Artificial Sequence
  MKO10007289_A_Btbd17
  gRNA
guggaaggcucggaccucgu

SEQ ID NO: 7290 - RNA, 20 nt, Artificial Sequence
  MKO10007290_A_Btbd1
  gRNA
ggguuuacugauauugacau

SEQ ID NO: 7291 - RNA, 20 nt, Artificial Sequence
  MKO10007291_A_Btbd1
  gRNA
uaccugaguaagcaacauaa

SEQ ID NO: 7292 - RNA, 20 nt, Artificial Sequence
  MKO10007292_A_Btbd1
  gRNA
uuuccagguccugcucaauc

SEQ ID NO: 7293 - RNA, 20 nt, Artificial Sequence
  MKO10007293_A_Btbd2
  gRNA
ucuucaaugcagucgugcgc

SEQ ID NO: 7294 - RNA, 20 nt, Artificial Sequence
  MKO10007294_A_Btbd2
  gRNA
gccgaaccucacgaaugccc

SEQ ID NO: 7295 - RNA, 20 nt, Artificial Sequence
  MKO10007295_A_Btbd2
  gRNA
cagcucaaucucgguggacg

SEQ ID NO: 7296 - RNA, 20 nt, Artificial Sequence
  MKO10007296_A_Btbd3
  gRNA
ccacaguacguccucgcugu

SEQ ID NO: 7297 - RNA, 20 nt, Artificial Sequence
  MKO10007297_A_Btbd3
  gRNA
auugccguccagcacuacac

SEQ ID NO: 7298 - RNA, 20 nt, Artificial Sequence
  MKO10007298_A_Btbd3
  gRNA
gggcgcuuaccuuucucgga

SEQ ID NO: 7299 - RNA, 20 nt, Artificial Sequence
  MKO10007299_A_Btbd6
  gRNA
uccauccuacgcugcgcgag

SEQ ID NO: 7300 - RNA, 20 nt, Artificial Sequence
  MKO10007300_A_Btbd6
  gRNA
aggcgcagccgagagcacga

SEQ ID NO: 7301 - RNA, 20 nt, Artificial Sequence
  MKO10007301_A_Btbd6
  gRNA
guacagcgaugagaucgacc

SEQ ID NO: 7302 - RNA, 20 nt, Artificial Sequence
  MKO10007302_A_Btbd7
  gRNA
acgccgaaaaucuaauagau

SEQ ID NO: 7303 - RNA, 20 nt, Artificial Sequence
  MKO10007303_A_Btbd7
  gRNA
auguguucaauccgcacaaa

SEQ ID NO: 7304 - RNA, 20 nt, Artificial Sequence
  MKO10007304_A_Btbd7
  gRNA
cagaugcgagaacuccucuc

SEQ ID NO: 7305 - RNA, 20 nt, Artificial Sequence
  MKO10007305_A_Btbd8
  gRNA
ucagacgaaguucuauaccg

SEQ ID NO: 7306 - RNA, 20 nt, Artificial Sequence
  MKO10007306_A_Btbd8
  gRNA
ccuccaccaguaauauccuc

SEQ ID NO: 7307 - RNA, 20 nt, Artificial Sequence
  MKO10007307_A_Btbd8
  gRNA
ugcagcaaaauaacucgacc

SEQ ID NO: 7308 - RNA, 20 nt, Artificial Sequence
  MKO10007308_A_Btbd9
  gRNA
auugaugaugacugccgcuc

SEQ ID NO: 7309 - RNA, 20 nt, Artificial Sequence
  MKO10007309_A_Btbd9
  gRNA
caucgugaaagccucggccg

SEQ ID NO: 7310 - RNA, 20 nt, Artificial Sequence
  MKO10007310_A_Btbd9
  gRNA
gccccguguagauauaucug

SEQ ID NO: 7311 - RNA, 20 nt, Artificial Sequence
  MKO10007311_A_Buc
  gRNA
uuugcucguccaccacgaag

SEQ ID NO: 7312 - RNA, 20 nt, Artificial Sequence
  MKO10007312_A_Buc
  gRNA
cacuuaccguuaagcaauau

SEQ ID NO: 7313 - RNA, 20 nt, Artificial Sequence
  MKO10007313_A_Buc
  gRNA
uggggcucggugugagcgag

SEQ ID NO: 7314 - RNA, 20 nt, Artificial Sequence
  MKO10007314_A_Btd
  gRNA
gugaugagguccacguuagc

SEQ ID NO: 7315 - RNA, 20 nt, Artificial Sequence
  MKO10007315_A_Btd
  gRNA
gcuugcguugggcgucagcu

SEQ ID NO: 7316 - RNA, 20 nt, Artificial Sequence
  MKO10007316_A_Btd
  gRNA
cuccgugucauugaaccgaa

SEQ ID NO: 7317 - RNA, 20 nt, Artificial Sequence
  MKO10007317_A_Btf3l4
  gRNA
ucagaguucacuaaagaaac

SEQ ID NO: 7318 - RNA, 20 nt, Artificial Sequence
  MKO10007318_A_Btf3l4
  gRNA
caauauagcugguauugaag

SEQ ID NO: 7319 - RNA, 20 nt, Artificial Sequence
  MKO10007319_A_Btf3l4
  gRNA
gugaauaugauuaaagacga

SEQ ID NO: 7320 - RNA, 20 nt, Artificial Sequence
  MKO10007320_A_Btf3
  gRNA
ucccauagggaacugcucgu

SEQ ID NO: 7321 - RNA, 20 nt, Artificial Sequence
  MKO10007321_A_Btf3
  gRNA
gaugaugaugaugaaguucc

SEQ ID NO: 7322 - RNA, 20 nt, Artificial Sequence
  MKO10007322_A_Btf3
  gRNA
ugucugcaccaagcugguug

SEQ ID NO: 7323 - RNA, 20 nt, Artificial Sequence
  MKO10007323_A_Bug1
  gRNA
gauaggcgagaucgccgccg

SEQ ID NO: 7324 - RNA, 20 nt, Artificial Sequence
  MKO10007324_A_Bug1
  gRNA
ggcggcgaucucgccuauca

SEQ ID NO: 7325 - RNA, 20 nt, Artificial Sequence
  MKO10007325_A_Bug1
  gRNA
uucccagaaaagccgugcaa

SEQ ID NO: 7326 - RNA, 20 nt, Artificial Sequence
  MKO10007326_A_Bug2
  gRNA
ccaucacauaguucuucgag

SEQ ID NO: 7327 - RNA, 20 nt, Artificial Sequence
  MKO10007327_A_Bug2
  gRNA
cccggagaucgccgccgccg

SEQ ID NO: 7328 - RNA, 20 nt, Artificial Sequence
  MKO10007328_A_Bug2
  gRNA
uaugaagugucuuaccgcau

SEQ ID NO: 7329 - RNA, 20 nt, Artificial Sequence
  MKO10007329_A_Bug3
  gRNA
gcgggucuuaccugguacac

SEQ ID NO: 7330 - RNA, 20 nt, Artificial Sequence
  MKO10007330_A_Bug3
  gRNA
aacaccaagccccguguacc

SEQ ID NO: 7331 - RNA, 20 nt, Artificial Sequence
  MKO10007331_A_Bug3
  gRNA
uuaccuguaggccugaccuu

SEQ ID NO: 7332 - RNA, 20 nt, Artificial Sequence
  MKO10007332_A_Bug4
  gRNA
cuguccacccugcgcgaagc

SEQ ID NO: 7333 - RNA, 20 nt, Artificial Sequence
  MKO10007333_A_Bug4
  gRNA
ccggccagcuucgcgcaggg

SEQ ID NO: 7334 - RNA, 20 nt, Artificial Sequence
  MKO10007334_A_Bug4
  gRNA
caacccaaagagcgucuacc

SEQ ID NO: 7335 - RNA, 20 nt, Artificial Sequence
  MKO10007335_A_Btk
  gRNA
aauccgguacaauagugacc

SEQ ID NO: 7336 - RNA, 20 nt, Artificial Sequence
  MKO10007336_A_Btk
  gRNA
guaccaggucacuauuguac

SEQ ID NO: 7337 - RNA, 20 nt, Artificial Sequence
  MKO10007337_A_Btk
  gRNA
cucuagguuguauaugauga

SEQ ID NO: 7338 - RNA, 20 nt, Artificial Sequence
  MKO10007338_A_Btla
  gRNA
cagugcaacuuacuauuacg

SEQ ID NO: 7339 - RNA, 20 nt, Artificial Sequence
  MKO10007339_A_Btla
  gRNA
cucguaauaguaaguugcac

SEQ ID NO: 7340 - RNA, 20 nt, Artificial Sequence
  MKO10007340_A_Btla
  gRNA
aagaauucccuaaauaaccg

SEQ ID NO: 7341 - RNA, 20 nt, Artificial Sequence
  MKO10007341_A_Btn1a1
  gRNA
cgacagcgguacuucuauac

SEQ ID NO: 7342 - RNA, 20 nt, Artificial Sequence
  MKO10007342_A_Btn1a1
  gRNA
auguauucugagcucgcguu

SEQ ID NO: 7343 - RNA, 20 nt, Artificial Sequence
  MKO10007343_A_Btn1a1
  gRNA
aaauuccuucuuccgcagac

SEQ ID NO: 7344 - RNA, 20 nt, Artificial Sequence
  MKO10007344_A_Btn2a2
  gRNA
gccuugucaagaaacaccgc

SEQ ID NO: 7345 - RNA, 20 nt, Artificial Sequence
  MKO10007345_A_Btn2a2
  gRNA
gcagguacaacuucaucaua

SEQ ID NO: 7346 - RNA, 20 nt, Artificial Sequence
  MKO10007346_A_Btn2a2
  gRNA
ugaugaaguuguaccugccc

SEQ ID NO: 7347 - RNA, 20 nt, Artificial Sequence
  MKO10007347_A_Btnl10
  gRNA
guacacaugcacgacugacg

SEQ ID NO: 7348 - RNA, 20 nt, Artificial Sequence
  MKO10007348_A_Btnl10
  gRNA
ggauguguaugacgagcaga

SEQ ID NO: 7349 - RNA, 20 nt, Artificial Sequence
  MKO10007349_A_Btnl10
  gRNA
aagguccagccacuccaccu

SEQ ID NO: 7350 - RNA, 20 nt, Artificial Sequence
  MKO10007350_A_Btnl1
  gRNA
aggugcagaugccggaauac

SEQ ID NO: 7351 - RNA, 20 nt, Artificial Sequence
  MKO10007351_A_Btnl1
  gRNA
cgaguguugugcuccucaag

SEQ ID NO: 7352 - RNA, 20 nt, Artificial Sequence
  MKO10007352_A_Btnl1
  gRNA
cagcucgcaugcacauccga

SEQ ID NO: 7353 - RNA, 20 nt, Artificial Sequence
  MKO10007353_A_Btnl2
  gRNA
acagcuuccguuagcguaau

SEQ ID NO: 7354 - RNA, 20 nt, Artificial Sequence
  MKO10007354_A_Btnl2
  gRNA
ggaauguccgauuacgcuaa

SEQ ID NO: 7355 - RNA, 20 nt, Artificial Sequence
  MKO10007355_A_Btnl2
  gRNA
gacaagcgugcuacuccaag

SEQ ID NO: 7356 - RNA, 20 nt, Artificial Sequence
  MKO10007356_A_Btnl4
  gRNA
guucagcacagagaccuugc

SEQ ID NO: 7357 - RNA, 20 nt, Artificial Sequence
  MKO10007357_A_Btnl4
  gRNA
caucauagaacacuccuugc

SEQ ID NO: 7358 - RNA, 20 nt, Artificial Sequence
  MKO10007358_A_Btnl4
  gRNA
guauucacagcgcaccuugc

SEQ ID NO: 7359 - RNA, 20 nt, Artificial Sequence
  MKO10007359_A_Btnl6
  gRNA
aacggggaaucuucaacgug

SEQ ID NO: 7360 - RNA, 20 nt, Artificial Sequence
  MKO10007360_A_Btnl6
  gRNA
uucugcaaggcugaucgugc

SEQ ID NO: 7361 - RNA, 20 nt, Artificial Sequence
  MKO10007361_A_Btnl6
  gRNA
cagauguauaucccacuauc

SEQ ID NO: 7362 - RNA, 20 nt, Artificial Sequence
  MKO10007362_A_Btnl9
  gRNA
gagacauccgugauuguccg

SEQ ID NO: 7363 - RNA, 20 nt, Artificial Sequence
  MKO10007363_A_Btnl9
  gRNA
gaauucgugauccagauugc

SEQ ID NO: 7364 - RNA, 20 nt, Artificial Sequence
  MKO10007364_A_Btnl9
  gRNA
cccauaucggcccucgucgg

SEQ ID NO: 7365 - RNA, 20 nt, Artificial Sequence
  MKO10007365_A_Btrc
  gRNA
ggcgauuauggacccggcag

SEQ ID NO: 7366 - RNA, 20 nt, Artificial Sequence
  MKO10007366_A_Btrc
  gRNA
ggagaaagcgcuuaaguuua

SEQ ID NO: 7367 - RNA, 20 nt, Artificial Sequence
  MKO10007367_A_Btrc
  gRNA
ugcugagaguuuccgcugcu

SEQ ID NO: 7368 - RNA, 20 nt, Artificial Sequence
  MKO10007368_A_Bub1b
  gRNA
caugacccgcccgugccgua

SEQ ID NO: 7369 - RNA, 20 nt, Artificial Sequence
  MKO10007369_A_Bub1b
  gRNA
uauaauagcgcgucucuccu

SEQ ID NO: 7370 - RNA, 20 nt, Artificial Sequence
  MKO10007370_A_Bub1b
  gRNA
gcgggucauguccacacuuc

SEQ ID NO: 7371 - RNA, 20 nt, Artificial Sequence
  MKO10007371_A_Bub1
  gRNA
cuauuccaagcacgccuuac

SEQ ID NO: 7372 - RNA, 20 nt, Artificial Sequence
  MKO10007372_A_Bub1
  gRNA
uacccguguagcuuugcaua

SEQ ID NO: 7373 - RNA, 20 nt, Artificial Sequence
  MKO10007373_A_Bub1
  gRNA
aucaaguauucuuuauuguc

SEQ ID NO: 7374 - RNA, 20 nt, Artificial Sequence
  MKO10007374_A_Bub3
  gRNA
guuaccaucacguucacuuc

SEQ ID NO: 7375 - RNA, 20 nt, Artificial Sequence
  MKO10007375_A_Bub3
  gRNA
gacuuucucccagccggaaa

SEQ ID NO: 7376 - RNA, 20 nt, Artificial Sequence
  MKO10007376_A_Bub3
  gRNA
cacgauuugaacacugauca

SEQ ID NO: 7377 - RNA, 20 nt, Artificial Sequence
  MKO10007377_A_Bud13
  gRNA
uguuuaggccacggugaaga

SEQ ID NO: 7378 - RNA, 20 nt, Artificial Sequence
  MKO10007378_A_Bud13
  gRNA
gucgugcucguacuugcugu

SEQ ID NO: 7379 - RNA, 20 nt, Artificial Sequence
  MKO10007379_A_Bud13
  gRNA
gcggauuguugaugaugaug

SEQ ID NO: 7380 - RNA, 20 nt, Artificial Sequence
  MKO10007380_A_Bud31
  gRNA
ggaguugauugaaccaacgu

SEQ ID NO: 7381 - RNA, 20 nt, Artificial Sequence
  MKO10007381_A_Bud31
  gRNA
cccgagucugaaugcagcgu

SEQ ID NO: 7382 - RNA, 20 nt, Artificial Sequence
  MKO10007382_A_Bud31
  gRNA
ugaucuaguucauccaacgu

SEQ ID NO: 7383 - RNA, 20 nt, Artificial Sequence
  MKO10007383_A_Bves
  gRNA
aaccuucuaaacaaauccgg

SEQ ID NO: 7384 - RNA, 20 nt, Artificial Sequence
  MKO10007384_A_Bves
  gRNA
ugaaccacuccgagucccuc

SEQ ID NO: 7385 - RNA, 20 nt, Artificial Sequence
  MKO10007385_A_Bves
  gRNA
gaguggcccagaccacauaa

SEQ ID NO: 7386 - RNA, 20 nt, Artificial Sequence
  MKO10007386_A_Bysl
  gRNA
gacugucaugucagagguau

SEQ ID NO: 7387 - RNA, 20 nt, Artificial Sequence
  MKO10007387_A_Bysl
  gRNA
uguagggccgggauugccac

SEQ ID NO: 7388 - RNA, 20 nt, Artificial Sequence
  MKO10007388_A_Bysl
  gRNA
ccgccauguaucaagccacc

SEQ ID NO: 7389 - RNA, 20 nt, Artificial Sequence
  MKO10007389_A_Bzrap1
  gRNA
ugcauaugcgggacuucgac

SEQ ID NO: 7390 - RNA, 20 nt, Artificial Sequence
  MKO10007390_A_Bzrap1
  gRNA
caggccggagcggcucccgc

SEQ ID NO: 7391 - RNA, 20 nt, Artificial Sequence
  MKO10007391_A_Bzrap1
  gRNA
ggcagucauugccaagcgcc

SEQ ID NO: 7392 - RNA, 20 nt, Artificial Sequence
  MKO10007392_A_Bzw1
  gRNA
uuuagccccgggugguacac

SEQ ID NO: 7393 - RNA, 20 nt, Artificial Sequence
  MKO10007393_A_Bzw1
  gRNA
cgcuacaaauaccuggagaa

SEQ ID NO: 7394 - RNA, 20 nt, Artificial Sequence
  MKO10007394_A_Bzw1
  gRNA
ccgacucugaaaaccccuuu

SEQ ID NO: 7395 - RNA, 20 nt, Artificial Sequence
  MKO10007395_A_Bzw2
  gRNA
ggaggaacacgcauagacga

SEQ ID NO: 7396 - RNA, 20 nt, Artificial Sequence
  MKO10007396_A_Bzw2
  gRNA
aaccauccgaaacuaugcuc

SEQ ID NO: 7397 - RNA, 20 nt, Artificial Sequence
  MKO10007397_A_Bzw2
  gRNA
caccagcuucauuaagcccc

SEQ ID NO: 7398 - RNA, 20 nt, Artificial Sequence
  MKO10007398_A_C030006K11Rik
  gRNA
cgggugguacaggcgcccau

SEQ ID NO: 7399 - RNA, 20 nt, Artificial Sequence
  MKO10007399_A_C030006K11Rik
  gRNA
aagccucguagcgcccgcug

SEQ ID NO: 7400 - RNA, 20 nt, Artificial Sequence
  MKO10007400_A_C030006K11Rik
  gRNA
gcguaacuuggcucuagucu

SEQ ID NO: 7401 - RNA, 20 nt, Artificial Sequence
  MKO10007401_A_C030039L03Rik
  gRNA
aaaauuugaucgucgacgaa

SEQ ID NO: 7402 - RNA, 20 nt, Artificial Sequence
  MKO10007402_A_C030039L03Rik
  gRNA
ggacaauccuauguucagca

SEQ ID NO: 7403 - RNA, 20 nt, Artificial Sequence
  MKO10007403_A_C030039L03Rik
  gRNA
guuauacaggaacauaaugu

SEQ ID NO: 7404 - RNA, 20 nt, Artificial Sequence
  MKO10007404_A_C030046E11Rik
  gRNA
gcuaaaucaucuacucaguu

SEQ ID NO: 7405 - RNA, 20 nt, Artificial Sequence
  MKO10007405_A_C030046E11Rik
  gRNA
auuugcaagcacccauuaug

SEQ ID NO: 7406 - RNA, 20 nt, Artificial Sequence
  MKO10007406_A_C030046E11Rik
  gRNA
uaaacuuacuugggauacac

SEQ ID NO: 7407 - RNA, 20 nt, Artificial Sequence
  MKO10007407_A_C130026I21Rik
  gRNA
gcaacaaugaacucagcagc

SEQ ID NO: 7408 - RNA, 20 nt, Artificial Sequence
  MKO10007408_A_C130026I21Rik
  gRNA
guccccuaggacaaucccag

SEQ ID NO: 7409 - RNA, 20 nt, Artificial Sequence
  MKO10007409_A_C130026I21Rik
  gRNA
ucugcuccgagaugaagucu

SEQ ID NO: 7410 - RNA, 20 nt, Artificial Sequence
  MKO10007410_A_C130050O18Rik
  gRNA
cuacauguccacgacaaacc

SEQ ID NO: 7411 - RNA, 20 nt, Artificial Sequence
  MKO10007411_A_C130050O18Rik
  gRNA
uguucaucuuagaccguacu

SEQ ID NO: 7412 - RNA, 20 nt, Artificial Sequence
  MKO10007412_A_C130050O18Rik
  gRNA
agugcugacagagcguugug

SEQ ID NO: 7413 - RNA, 20 nt, Artificial Sequence
  MKO10007413_A_C130060K24Rik
  gRNA
caaucaucaugugaacgaug

SEQ ID NO: 7414 - RNA, 20 nt, Artificial Sequence
  MKO10007414_A_C130060K24Rik
  gRNA
ucagugcuccgaacuauuca

SEQ ID NO: 7415 - RNA, 20 nt, Artificial Sequence
  MKO10007415_A_C130060K24Rik
  gRNA
uguagaucuucuggugcacg

SEQ ID NO: 7416 - RNA, 20 nt, Artificial Sequence
  MKO10007416_A_C130074G19Rik
  gRNA
uccagggagucguagcgcuc

SEQ ID NO: 7417 - RNA, 20 nt, Artificial Sequence
  MKO10007417_A_C130074G19Rik
  gRNA
gccugagcgcuacgacuccc

SEQ ID NO: 7418 - RNA, 20 nt, Artificial Sequence
  MKO10007418_A_C130074G19Rik
  gRNA
acgcugguggccacuccaaa

SEQ ID NO: 7419 - RNA, 20 nt, Artificial Sequence
  MKO10007419_A_C130079G13Rik
  gRNA
gaccauguugauacucuuga

SEQ ID NO: 7420 - RNA, 20 nt, Artificial Sequence
  MKO10007420_A_C130079G13Rik
  gRNA
gcaagguaucaagugauugu

SEQ ID NO: 7421 - RNA, 20 nt, Artificial Sequence
  MKO10007421_A_C130079G13Rik
  gRNA
ucccacacgcaucuguauua

SEQ ID NO: 7422 - RNA, 20 nt, Artificial Sequence
  MKO10007422_A_C1d
  gRNA
gauuugucaagaacgcacuc

SEQ ID NO: 7423 - RNA, 20 nt, Artificial Sequence
  MKO10007423_A_C1d
  gRNA
guguuacuaguuggacccau

SEQ ID NO: 7424 - RNA, 20 nt, Artificial Sequence
  MKO10007424_A_C1d
  gRNA
uagaaacgaguuguugcaga

SEQ ID NO: 7425 - RNA, 20 nt, Artificial Sequence
  MKO10007425_A_C1galt1c1
  gRNA
cgauaucucgaaaauuucag

SEQ ID NO: 7426 - RNA, 20 nt, Artificial Sequence
  MKO10007426_A_C1galt1c1
  gRNA
gaaaaugccgaagaugccga

SEQ ID NO: 7427 - RNA, 20 nt, Artificial Sequence
  MKO10007427_A_C1galt1c1
  gRNA
guguuuaauaccaaauccgu

SEQ ID NO: 7428 - RNA, 20 nt, Artificial Sequence
  MKO10007428_A_C1galt1
  gRNA
ugacgacacauacgucauug

SEQ ID NO: 7429 - RNA, 20 nt, Artificial Sequence
  MKO10007429_A_C1galt1
  gRNA
ucuagacuuaccucuauggg

SEQ ID NO: 7430 - RNA, 20 nt, Artificial Sequence
  MKO10007430_A_C1galt1
  gRNA
guuuaucaucuucguccaua

SEQ ID NO: 7431 - RNA, 20 nt, Artificial Sequence
  MKO10007431_A_C1qa
  gRNA
cacagaugaagcgacccgug

SEQ ID NO: 7432 - RNA, 20 nt, Artificial Sequence
  MKO10007432_A_C1qa
  gRNA
cggcagaacccaaugacgcu

SEQ ID NO: 7433 - RNA, 20 nt, Artificial Sequence
  MKO10007433_A_C1qa
  gRNA
gaugucugccgagcacccaa

SEQ ID NO: 7434 - RNA, 20 nt, Artificial Sequence
  MKO10007434_A_C1qbp
  gRNA
gacaucaacucccaacuuug

SEQ ID NO: 7435 - RNA, 20 nt, Artificial Sequence
  MKO10007435_A_C1qbp
  gRNA
aucagucaagaauucaacga

SEQ ID NO: 7436 - RNA, 20 nt, Artificial Sequence
  MKO10007436_A_C1qbp
  gRNA
uggcaagaagacccuuguac

SEQ ID NO: 7437 - RNA, 20 nt, Artificial Sequence
  MKO10007437_A_C1qb
  gRNA
cucauaguucucguucgcgu

SEQ ID NO: 7438 - RNA, 20 nt, Artificial Sequence
  MKO10007438_A_C1qb
  gRNA
cgugauuacgcauccauguc

SEQ ID NO: 7439 - RNA, 20 nt, Artificial Sequence
  MKO10007439_A_C1qb
  gRNA
ggggcccggugcagcugcuu

SEQ ID NO: 7440 - RNA, 20 nt, Artificial Sequence
  MKO10007440_A_C1qc
  gRNA
cgucuacuacacaucgcaua

SEQ ID NO: 7441 - RNA, 20 nt, Artificial Sequence
  MKO10007441_A_C1qc
  gRNA
uuguaucggcccuccacacc

SEQ ID NO: 7442 - RNA, 20 nt, Artificial Sequence
  MKO10007442_A_C1qc
  gRNA
gaucccauagcagccagcgc

SEQ ID NO: 7443 - RNA, 20 nt, Artificial Sequence
  MKO10007443_A_C1ql1
  gRNA
ugugcgaccccuaucccgcg

SEQ ID NO: 7444 - RNA, 20 nt, Artificial Sequence
  MKO10007444_A_C1ql1
  gRNA
aacaacuacgaugcggccag

SEQ ID NO: 7445 - RNA, 20 nt, Artificial Sequence
  MKO10007445_A_C1ql1
  gRNA
caacagcgugauccugcauc

SEQ ID NO: 7446 - RNA, 20 nt, Artificial Sequence
  MKO10007446_A_C1ql2
  gRNA
ccauacagcgucgcucccgc

SEQ ID NO: 7447 - RNA, 20 nt, Artificial Sequence
  MKO10007447_A_C1ql2
  gRNA
ugagcaccucguagccuucg

SEQ ID NO: 7448 - RNA, 20 nt, Artificial Sequence
  MKO10007448_A_C1ql2
  gRNA
uaggccccuaauccggauac

SEQ ID NO: 7449 - RNA, 20 nt, Artificial Sequence
  MKO10007449_A_C1ql3
  gRNA
cucguagugagccgacgugc

SEQ ID NO: 7450 - RNA, 20 nt, Artificial Sequence
  MKO10007450_A_C1ql3
  gRNA
agccuucgugcugccguuug

SEQ ID NO: 7451 - RNA, 20 nt, Artificial Sequence
  MKO10007451_A_C1ql3
  gRNA
cgacuaugccaguaacagug

SEQ ID NO: 7452 - RNA, 20 nt, Artificial Sequence
  MKO10007452_A_C1ql4
  gRNA
ccgccuuagacccgcguaga

SEQ ID NO: 7453 - RNA, 20 nt, Artificial Sequence
  MKO10007453_A_C1ql4
  gRNA
auucgggguacauagccggc

SEQ ID NO: 7454 - RNA, 20 nt, Artificial Sequence
  MKO10007454_A_C1ql4
  gRNA
cgucauucugcaccuagacg

SEQ ID NO: 7455 - RNA, 20 nt, Artificial Sequence
  MKO10007455_A_C1qtnf1
  gRNA
aaacuccgugucgaagacca

SEQ ID NO: 7456 - RNA, 20 nt, Artificial Sequence
  MKO10007456_A_C1qtnf1
  gRNA
uuaggcgagaaaggugaccg

SEQ ID NO: 7457 - RNA, 20 nt, Artificial Sequence
  MKO10007457_A_C1qtnf1
  gRNA
agagaaguauagcccucgcc

SEQ ID NO: 7458 - RNA, 20 nt, Artificial Sequence
  MKO10007458_A_C1qtnf2
  gRNA
cgccacggaaaaggccgacu

SEQ ID NO: 7459 - RNA, 20 nt, Artificial Sequence
  MKO10007459_A_C1qtnf2
  gRNA
ucgcucgcguggguagcucu

SEQ ID NO: 7460 - RNA, 20 nt, Artificial Sequence
  MKO10007460_A_C1qtnf2
  gRNA
cuggaagucccugcgagcaa

SEQ ID NO: 7461 - RNA, 20 nt, Artificial Sequence
  MKO10007461_A_C1qtnf3
  gRNA
uuugccgagccaugcucggg

SEQ ID NO: 7462 - RNA, 20 nt, Artificial Sequence
  MKO10007462_A_C1qtnf3
  gRNA
agauuuggggcccccguauc

SEQ ID NO: 7463 - RNA, 20 nt, Artificial Sequence
  MKO10007463_A_C1qtnf3
  gRNA
uugcaucucaccugauacgg

SEQ ID NO: 7464 - RNA, 20 nt, Artificial Sequence
  MKO10007464_A_C1qtnf4
  gRNA
agcgccgucgucguaaauca

SEQ ID NO: 7465 - RNA, 20 nt, Artificial Sequence
  MKO10007465_A_C1qtnf4
  gRNA
uucaccgacagcgucuugcg

SEQ ID NO: 7466 - RNA, 20 nt, Artificial Sequence
  MKO10007466_A_C1qtnf4
  gRNA
gcugaugaagaaccgcgacg

SEQ ID NO: 7467 - RNA, 20 nt, Artificial Sequence
  MKO10007467_A_C1qtnf5
  gRNA
gugcaccgucgcggccauca

SEQ ID NO: 7468 - RNA, 20 nt, Artificial Sequence
  MKO10007468_A_C1qtnf5
  gRNA
caucgcacccccugagagcg

SEQ ID NO: 7469 - RNA, 20 nt, Artificial Sequence
  MKO10007469_A_C1qtnf5
  gRNA
gacggccgugauggccgcga

SEQ ID NO: 7470 - RNA, 20 nt, Artificial Sequence
  MKO10007470_A_C1qtnf6
  gRNA
cugcaugaugcugcguucgc

SEQ ID NO: 7471 - RNA, 20 nt, Artificial Sequence
  MKO10007471_A_C1qtnf6
  gRNA
ucgacgaugcugugaccccg

SEQ ID NO: 7472 - RNA, 20 nt, Artificial Sequence
  MKO10007472_A_C1qtnf6
  gRNA
acagcaucgucgacagccuu

SEQ ID NO: 7473 - RNA, 20 nt, Artificial Sequence
  MKO10007473_A_C1qtnf7
  gRNA
cuaugucgauacagauuacc

SEQ ID NO: 7474 - RNA, 20 nt, Artificial Sequence
  MKO10007474_A_C1qtnf7
  gRNA
caagacucgucacguagagc

SEQ ID NO: 7475 - RNA, 20 nt, Artificial Sequence
  MKO10007475_A_C1qtnf7
  gRNA
caaaugaacuuccccguugc

SEQ ID NO: 7476 - RNA, 20 nt, Artificial Sequence
  MKO10007476_A_C1qtnf9
  gRNA
uccccgucgcuacauuguag

SEQ ID NO: 7477 - RNA, 20 nt, Artificial Sequence
  MKO10007477_A_C1qtnf9
  gRNA
gguuugccgauggggcccau

SEQ ID NO: 7478 - RNA, 20 nt, Artificial Sequence
  MKO10007478_A_C1qtnf9
  gRNA
cacgagaaguguauucuccc

SEQ ID NO: 7479 - RNA, 20 nt, Artificial Sequence
  MKO10007479_A_C1ra
  gRNA
cugcuucuaugacuauguua

SEQ ID NO: 7480 - RNA, 20 nt, Artificial Sequence
  MKO10007480_A_C1ra
  gRNA
ucauagaagcagccuucaga

SEQ ID NO: 7481 - RNA, 20 nt, Artificial Sequence
  MKO10007481_A_C1ra
  gRNA
cucaccuacagccugguagu

SEQ ID NO: 7482 - RNA, 20 nt, Artificial Sequence
  MKO10007482_A_C1rb
  gRNA
cugccucuaugacuauguua

SEQ ID NO: 7483 - RNA, 20 nt, Artificial Sequence
  MKO10007483_A_C1rb
  gRNA
cuaccuuaacauagucauag

SEQ ID NO: 7484 - RNA, 20 nt, Artificial Sequence
  MKO10007484_A_C1rb
  gRNA
gggagcacucaccuacagcc

SEQ ID NO: 7485 - RNA, 20 nt, Artificial Sequence
  MKO10007485_A_C1rl
  gRNA
uacucaccuggcacgcauuc

SEQ ID NO: 7486 - RNA, 20 nt, Artificial Sequence
  MKO10007486_A_C1rl
  gRNA
gagguuccugaaugcgugcc

SEQ ID NO: 7487 - RNA, 20 nt, Artificial Sequence
  MKO10007487_A_C1rl
  gRNA
cugccaagauccuuauuaua

SEQ ID NO: 7488 - RNA, 20 nt, Artificial Sequence
  MKO10007488_A_C1s
  gRNA
gcccguaaaccguucuucgu

SEQ ID NO: 7489 - RNA, 20 nt, Artificial Sequence
  MKO10007489_A_C1s
  gRNA
cagacuucuccaacgaagaa

SEQ ID NO: 7490 - RNA, 20 nt, Artificial Sequence
  MKO10007490_A_C1s
  gRNA
gguacgccuggggauaauua

SEQ ID NO: 7491 - RNA, 20 nt, Artificial Sequence
  MKO10007491_A_C230052I12Rik
  gRNA
uggaccggaccggucccauc

SEQ ID NO: 7492 - RNA, 20 nt, Artificial Sequence
  MKO10007492_A_C230052I12Rik
  gRNA
gguccgguccacgugccacu

SEQ ID NO: 7493 - RNA, 20 nt, Artificial Sequence
  MKO10007493_A_C230052I12Rik
  gRNA
caacgcuuccguccaagaac

SEQ ID NO: 7494 - RNA, 20 nt, Artificial Sequence
  MKO10007494_A_C2cd2l
  gRNA
uuaccauggugcgcucugau

SEQ ID NO: 7495 - RNA, 20 nt, Artificial Sequence
  MKO10007495_A_C2cd2l
  gRNA
ucuccauggagacggcagcg

SEQ ID NO: 7496 - RNA, 20 nt, Artificial Sequence
  MKO10007496_A_C2cd2l
  gRNA
gucccccgcugccgucucca

SEQ ID NO: 7497 - RNA, 20 nt, Artificial Sequence
  MKO10007497_A_C2cd2
  gRNA
cuggguugacuugacuacac

SEQ ID NO: 7498 - RNA, 20 nt, Artificial Sequence
  MKO10007498_A_C2cd2
  gRNA
ucugagcaccaaacccacgc

SEQ ID NO: 7499 - RNA, 20 nt, Artificial Sequence
  MKO10007499_A_C2cd2
  gRNA
caguguagucaagucaaccc

SEQ ID NO: 7500 - RNA, 20 nt, Artificial Sequence
  MKO10007500_A_C2cd3
  gRNA
gugagaacaacuacccguua

SEQ ID NO: 7501 - RNA, 20 nt, Artificial Sequence
  MKO10007501_A_C2cd3
  gRNA
cccagucuaugaucccguca

SEQ ID NO: 7502 - RNA, 20 nt, Artificial Sequence
  MKO10007502_A_C2cd3
  gRNA
caguuuaccucguaucugac

SEQ ID NO: 7503 - RNA, 20 nt, Artificial Sequence
  MKO10007503_A_C2cd4a
  gRNA
acuucgagccccucgacguc

SEQ ID NO: 7504 - RNA, 20 nt, Artificial Sequence
  MKO10007504_A_C2cd4a
  gRNA
acgccgccuccuacgcuccc

SEQ ID NO: 7505 - RNA, 20 nt, Artificial Sequence
  MKO10007505_A_C2cd4a
  gRNA
cgggcgacccagacgcugcc

SEQ ID NO: 7506 - RNA, 20 nt, Artificial Sequence
  MKO10007506_A_C2cd4b
  gRNA
gguucggccgcgcagcgcca

SEQ ID NO: 7507 - RNA, 20 nt, Artificial Sequence
  MKO10007507_A_C2cd4b
  gRNA
aagcggugauucgagagcgc

SEQ ID NO: 7508 - RNA, 20 nt, Artificial Sequence
  MKO10007508_A_C2cd4b
  gRNA
ucuguugagccgcgcgcugc

SEQ ID NO: 7509 - RNA, 20 nt, Artificial Sequence
  MKO10007509_A_C2cd4c
  gRNA
uccgucgccgcuugucccgc

SEQ ID NO: 7510 - RNA, 20 nt, Artificial Sequence
  MKO10007510_A_C2cd4c
  gRNA
ccggagcaucaauugcugcg

SEQ ID NO: 7511 - RNA, 20 nt, Artificial Sequence
  MKO10007511_A_C2cd4c
  gRNA
cggccgagggccuguaugac

SEQ ID NO: 7512 - RNA, 20 nt, Artificial Sequence
  MKO10007512_A_C2cd4d
  gRNA
cggacuaguguccgccgagc

SEQ ID NO: 7513 - RNA, 20 nt, Artificial Sequence
  MKO10007513_A_C2cd4d
  gRNA
accgggagguuccggccgcc

SEQ ID NO: 7514 - RNA, 20 nt, Artificial Sequence
  MKO10007514_A_C2cd4d
  gRNA
cgccgcgaguccuuguucca

SEQ ID NO: 7515 - RNA, 20 nt, Artificial Sequence
  MKO10007515_A_C2cd5
  gRNA
ccuccacgaaggcauccguc

SEQ ID NO: 7516 - RNA, 20 nt, Artificial Sequence
  MKO10007516_A_C2cd5
  gRNA
ccgcggagaaaucaauguug

SEQ ID NO: 7517 - RNA, 20 nt, Artificial Sequence
  MKO10007517_A_C2cd5
  gRNA
cguuugcacuguaaguaucg

SEQ ID NO: 7518 - RNA, 20 nt, Artificial Sequence
  MKO10007518_A_C2
  gRNA
uuggggcgacaguaccgcac

SEQ ID NO: 7519 - RNA, 20 nt, Artificial Sequence
  MKO10007519_A_C2
  gRNA
aagauacucacgucggcaaa

SEQ ID NO: 7520 - RNA, 20 nt, Artificial Sequence
  MKO10007520_A_C2
  gRNA
gugcgguacugucgccccaa

SEQ ID NO: 7521 - RNA, 20 nt, Artificial Sequence
  MKO10007521_A_C330006A16Rik
  gRNA
cgcacgcuagugcgcguccu

SEQ ID NO: 7522 - RNA, 20 nt, Artificial Sequence
  MKO10007522_A_C330006A16Rik
  gRNA
ccccuccgcccgcgacgaca

SEQ ID NO: 7523 - RNA, 20 nt, Artificial Sequence
  MKO10007523_A_C330006A16Rik
  gRNA
uuguagccagcugucgucgu

SEQ ID NO: 7524 - RNA, 20 nt, Artificial Sequence
  MKO10007524_A_C330007P06Rik
  gRNA
augauaauuaccuucuuagg

SEQ ID NO: 7525 - RNA, 20 nt, Artificial Sequence
  MKO10007525_A_C330007P06Rik
  gRNA
ucuagguuaugaugaccaaa

SEQ ID NO: 7526 - RNA, 20 nt, Artificial Sequence
  MKO10007526_A_C330007P06Rik
  gRNA
aguuagagaaauugcccaug

SEQ ID NO: 7527 - RNA, 20 nt, Artificial Sequence
  MKO10007527_A_C330018D20Rik
  gRNA
uucuccagccguauaaagac

SEQ ID NO: 7528 - RNA, 20 nt, Artificial Sequence
  MKO10007528_A_C330018D20Rik
  gRNA
auccccgucuuccauuugaa

SEQ ID NO: 7529 - RNA, 20 nt, Artificial Sequence
  MKO10007529_A_C330018D20Rik
  gRNA
cucgaugcaucaucagaaau

SEQ ID NO: 7530 - RNA, 20 nt, Artificial Sequence
  MKO10007530_A_C330021F23Rik
  gRNA
auauaguuauuaggggcccg

SEQ ID NO: 7531 - RNA, 20 nt, Artificial Sequence
  MKO10007531_A_C330021F23Rik
  gRNA
cgucgaaaaggucaugcugu

SEQ ID NO: 7532 - RNA, 20 nt, Artificial Sequence
  MKO10007532_A_C330021F23Rik
  gRNA
uagagccaacagagaaacau

SEQ ID NO: 7533 - RNA, 20 nt, Artificial Sequence
  MKO10007533_A_C330027C09Rik
  gRNA
aaucugaauagugugcuguc

SEQ ID NO: 7534 - RNA, 20 nt, Artificial Sequence
  MKO10007534_A_C330027C09Rik
  gRNA
gagcuaacaaugccuugucu

SEQ ID NO: 7535 - RNA, 20 nt, Artificial Sequence
  MKO10007535_A_C330027C09Rik
  gRNA
uuugccaauaguccuagaca

SEQ ID NO: 7536 - RNA, 20 nt, Artificial Sequence
  MKO10007536_A_C3ar1
  gRNA
gugcgugagcucuucgcuga

SEQ ID NO: 7537 - RNA, 20 nt, Artificial Sequence
  MKO10007537_A_C3ar1
  gRNA
caugauugucauacgugaau

SEQ ID NO: 7538 - RNA, 20 nt, Artificial Sequence
  MKO10007538_A_C3ar1
  gRNA
agaaccgccuucgccaucug

SEQ ID NO: 7539 - RNA, 20 nt, Artificial Sequence
  MKO10007539_A_C3
  gRNA
gaugacgacugucuugccca

SEQ ID NO: 7540 - RNA, 20 nt, Artificial Sequence
  MKO10007540_A_C3
  gRNA
acaaaggcaagaugccgugu

SEQ ID NO: 7541 - RNA, 20 nt, Artificial Sequence
  MKO10007541_A_C3
  gRNA
gagcgaagagaccaucguac

SEQ ID NO: 7542 - RNA, 20 nt, Artificial Sequence
  MKO10007542_A_C4a
  gRNA
ggugaagguaucuuguaaga

SEQ ID NO: 7543 - RNA, 20 nt, Artificial Sequence
  MKO10007543_A_C4a
  gRNA
uuuggggacuccccugucag

SEQ ID NO: 7544 - RNA, 20 nt, Artificial Sequence
  MKO10007544_A_C4a
  gRNA
ggagcuguacccccacugac

SEQ ID NO: 7545 - RNA, 20 nt, Artificial Sequence
  MKO10007545_A_C4bp
  gRNA
guccgauucacgucacuugc

SEQ ID NO: 7546 - RNA, 20 nt, Artificial Sequence
  MKO10007546_A_C4bp
  gRNA
gaaaucucccauucucccga

SEQ ID NO: 7547 - RNA, 20 nt, Artificial Sequence
  MKO10007547_A_C4bp
  gRNA
gaaaaacauugccguaaucc

SEQ ID NO: 7548 - RNA, 20 nt, Artificial Sequence
  MKO10007548_A_C4b
  gRNA
uaauuuggggaccccccugu

SEQ ID NO: 7549 - RNA, 20 nt, Artificial Sequence
  MKO10007549_A_C4b
  gRNA
ggagcuguacccccaccgac

SEQ ID NO: 7550 - RNA, 20 nt, Artificial Sequence
  MKO10007550_A_C4b
  gRNA
uugcucuucucuucccgacg

SEQ ID NO: 7551 - RNA, 20 nt, Artificial Sequence
  MKO10007551_A_C530008M17Rik
  gRNA
agccgacgaucccgcccgcc

SEQ ID NO: 7552 - RNA, 20 nt, Artificial Sequence
  MKO10007552_A_C530008M17Rik
  gRNA
acccgcuaaggacgcgagcu

SEQ ID NO: 7553 - RNA, 20 nt, Artificial Sequence
  MKO10007553_A_C530008M17Rik
  gRNA
aucgagguugacacuuucga

SEQ ID NO: 7554 - RNA, 20 nt, Artificial Sequence
  MKO10007554_A_C5ar1
  gRNA
gagagcguuucguaugaugc

SEQ ID NO: 7555 - RNA, 20 nt, Artificial Sequence
  MKO10007555_A_C5ar1
  gRNA
gacgggccgucaacgccauc

SEQ ID NO: 7556 - RNA, 20 nt, Artificial Sequence
  MKO10007556_A_C5ar1
  gRNA
gcgcguggccuugcgacucc

SEQ ID NO: 7557 - RNA, 20 nt, Artificial Sequence
  MKO10007557_A_C5ar2
  gRNA
ccgcugcaaugauuacccgc

SEQ ID NO: 7558 - RNA, 20 nt, Artificial Sequence
  MKO10007558_A_C5ar2
  gRNA
ggcggcgggccaucugccgu

SEQ ID NO: 7559 - RNA, 20 nt, Artificial Sequence
  MKO10007559_A_C5ar2
  gRNA
gaggcagagaacagcgcagc

SEQ ID NO: 7560 - RNA, 20 nt, Artificial Sequence
  MKO10007560_A_C6
  gRNA
uaguagugaacgauuacuau

SEQ ID NO: 7561 - RNA, 20 nt, Artificial Sequence
  MKO10007561_A_C6
  gRNA
cgauaagcuuuguaucaagc

SEQ ID NO: 7562 - RNA, 20 nt, Artificial Sequence
  MKO10007562_A_C6
  gRNA
ugaaacacgguauggauuac

SEQ ID NO: 7563 - RNA, 20 nt, Artificial Sequence
  MKO10007563_A_C77080
  gRNA
ggagagcgcauccuccgcgg

SEQ ID NO: 7564 - RNA, 20 nt, Artificial Sequence
  MKO10007564_A_C77080
  gRNA
ugcgcugaaucaucuccgag

SEQ ID NO: 7565 - RNA, 20 nt, Artificial Sequence
  MKO10007565_A_C77080
  gRNA
agugacaaccgucagggcgc

SEQ ID NO: 7566 - RNA, 20 nt, Artificial Sequence
  MKO10007566_A_C77370
  gRNA
cccaggaucguugagcaccg

SEQ ID NO: 7567 - RNA, 20 nt, Artificial Sequence
  MKO10007567_A_C77370
  gRNA
auaugauguugacucgcuag

SEQ ID NO: 7568 - RNA, 20 nt, Artificial Sequence
  MKO10007568_A_C77370
  gRNA
cagcaauaacuuuaucuugu

SEQ ID NO: 7569 - RNA, 20 nt, Artificial Sequence
  MKO10007569_A_C78339
  gRNA
ucacaacucgaagcccuagc

SEQ ID NO: 7570 - RNA, 20 nt, Artificial Sequence
  MKO10007570_A_C78339
  gRNA
auucuugaucaaagcucgua

SEQ ID NO: 7571 - RNA, 20 nt, Artificial Sequence
  MKO10007571_A_C78339
  gRNA
ggaauuacuaaaacccgacu

SEQ ID NO: 7572 - RNA, 20 nt, Artificial Sequence
  MKO10007572_A_C7
  gRNA
auaaccgguaaguucuaugu

SEQ ID NO: 7573 - RNA, 20 nt, Artificial Sequence
  MKO10007573_A_C7
  gRNA
ggugacaagcuuauuaauuu

SEQ ID NO: 7574 - RNA, 20 nt, Artificial Sequence
  MKO10007574_A_C7
  gRNA
acagccucguucagguuugc

SEQ ID NO: 7575 - RNA, 20 nt, Artificial Sequence
  MKO10007575_A_C86695
  gRNA
cacggccagcggaugcccug

SEQ ID NO: 7576 - RNA, 20 nt, Artificial Sequence
  MKO10007576_A_C86695
  gRNA
gacccuguauagaguuccac

SEQ ID NO: 7577 - RNA, 20 nt, Artificial Sequence
  MKO10007577_A_C86695
  gRNA
auuuccaaugaagccgcaaa

SEQ ID NO: 7578 - RNA, 20 nt, Artificial Sequence
  MKO10007578_A_C87414
  gRNA
uucuucaucaauggccccac

SEQ ID NO: 7579 - RNA, 20 nt, Artificial Sequence
  MKO10007579_A_C87414
  gRNA
auuggugugucugccagcaa

SEQ ID NO: 7580 - RNA, 20 nt, Artificial Sequence
  MKO10007580_A_C87414
  gRNA
ucugcagugcuauagugagu

SEQ ID NO: 7581 - RNA, 20 nt, Artificial Sequence
  MKO10007581_A_C87436
  gRNA
ucgggcaccauagcgaaaua

SEQ ID NO: 7582 - RNA, 20 nt, Artificial Sequence
  MKO10007582_A_C87436
  gRNA
ccccgacuaccgaugcuucg

SEQ ID NO: 7583 - RNA, 20 nt, Artificial Sequence
  MKO10007583_A_C87436
  gRNA
uucaaugaugacguaaccac

SEQ ID NO: 7584 - RNA, 20 nt, Artificial Sequence
  MKO10007584_A_C87499
  gRNA
ucccguugcauuaaaugucg

SEQ ID NO: 7585 - RNA, 20 nt, Artificial Sequence
  MKO10007585_A_C87499
  gRNA
gccuaccuggagcgaaccuu

SEQ ID NO: 7586 - RNA, 20 nt, Artificial Sequence
  MKO10007586_A_C87499
  gRNA
gcugauaaagaaccccaacc

SEQ ID NO: 7587 - RNA, 20 nt, Artificial Sequence
  MKO10007587_A_C87977
  gRNA
cuaauauuacucccacaaaa

SEQ ID NO: 7588 - RNA, 20 nt, Artificial Sequence
  MKO10007588_A_C87977
  gRNA
uggguuauacauuuaugaua

SEQ ID NO: 7589 - RNA, 20 nt, Artificial Sequence
  MKO10007589_A_C87977
  gRNA
ugcuucucugucgugaacuc

SEQ ID NO: 7590 - RNA, 20 nt, Artificial Sequence
  MKO10007590_A_C8a
  gRNA
cguuaucuccguuacacacc

SEQ ID NO: 7591 - RNA, 20 nt, Artificial Sequence
  MKO10007591_A_C8a
  gRNA
ucgcugccugaaacgccacc

SEQ ID NO: 7592 - RNA, 20 nt, Artificial Sequence
  MKO10007592_A_C8a
  gRNA
ucucauccuccccauaguag

SEQ ID NO: 7593 - RNA, 20 nt, Artificial Sequence
  MKO10007593_A_C8b
  gRNA
cucgaucaccgguauuaugc

SEQ ID NO: 7594 - RNA, 20 nt, Artificial Sequence
  MKO10007594_A_C8b
  gRNA
gcuuccgccacacuccguac

SEQ ID NO: 7595 - RNA, 20 nt, Artificial Sequence
  MKO10007595_A_C8b
  gRNA
guguagcuuucuacguugua

SEQ ID NO: 7596 - RNA, 20 nt, Artificial Sequence
  MKO10007596_A_C8g
  gRNA
auguguuugagcggcgaguc

SEQ ID NO: 7597 - RNA, 20 nt, Artificial Sequence
  MKO10007597_A_C8g
  gRNA
gccgcagucucacgggcccg

SEQ ID NO: 7598 - RNA, 20 nt, Artificial Sequence
  MKO10007598_A_C8g
  gRNA
cucgccgcucaaacacaucc

SEQ ID NO: 7599 - RNA, 20 nt, Artificial Sequence
  MKO10007599_A_C920025E04Rik
  gRNA
auuuccacaccgucguaucc

SEQ ID NO: 7600 - RNA, 20 nt, Artificial Sequence
  MKO10007600_A_C920025E04Rik
  gRNA
uggucgcgguccaggagcgc

SEQ ID NO: 7601 - RNA, 20 nt, Artificial Sequence
  MKO10007601_A_C920025E04Rik
  gRNA
gaggccgggccgggauacga

SEQ ID NO: 7602 - RNA, 20 nt, Artificial Sequence
  MKO10007602_A_C9
  gRNA
cauucugcagucuaucggua

SEQ ID NO: 7603 - RNA, 20 nt, Artificial Sequence
  MKO10007603_A_C9
  gRNA
cccaugccgugaccgaguag

SEQ ID NO: 7604 - RNA, 20 nt, Artificial Sequence
  MKO10007604_A_C9
  gRNA
uuucccauuaaacuguccga

SEQ ID NO: 7605 - RNA, 20 nt, Artificial Sequence
  MKO10007605_A_CK137956
  gRNA
gcagacagcgccgaguaugc

SEQ ID NO: 7606 - RNA, 20 nt, Artificial Sequence
  MKO10007606_A_CK137956
  gRNA
aaucucgucaccagccauua

SEQ ID NO: 7607 - RNA, 20 nt, Artificial Sequence
  MKO10007607_A_CK137956
  gRNA
cucuaccuucccgcaguauc

SEQ ID NO: 7608 - RNA, 20 nt, Artificial Sequence
  MKO10007608_A_Caap1
  gRNA
gaugcucccugauguacuga

SEQ ID NO: 7609 - RNA, 20 nt, Artificial Sequence
  MKO10007609_A_Caap1
  gRNA
uuuauaaggugacaaugguu

SEQ ID NO: 7610 - RNA, 20 nt, Artificial Sequence
  MKO10007610_A_Caap1
  gRNA
ggaugaaguagaaucuacac

SEQ ID NO: 7611 - RNA, 20 nt, Artificial Sequence
  MKO10007611_A_Cab39l
  gRNA
ccacagauugccuuacgcug

SEQ ID NO: 7612 - RNA, 20 nt, Artificial Sequence
  MKO10007612_A_Cab39l
  gRNA
uagcauaaucccacagcgua

SEQ ID NO: 7613 - RNA, 20 nt, Artificial Sequence
  MKO10007613_A_Cab39l
  gRNA
ucuguguggaacgaacgaca

SEQ ID NO: 7614 - RNA, 20 nt, Artificial Sequence
  MKO10007614_A_Cab39
  gRNA
cuaauagggcaaaaaagacg

SEQ ID NO: 7615 - RNA, 20 nt, Artificial Sequence
  MKO10007615_A_Cab39
  gRNA
gccguacagaauuucuuuca

SEQ ID NO: 7616 - RNA, 20 nt, Artificial Sequence
  MKO10007616_A_Cab39
  gRNA
ugagcuguaagucagcuacc

SEQ ID NO: 7617 - RNA, 20 nt, Artificial Sequence
  MKO10007617_A_Cabin1
  gRNA
aaauuggacacgucgcccug

SEQ ID NO: 7618 - RNA, 20 nt, Artificial Sequence
  MKO10007618_A_Cabin1
  gRNA
auuccacagacgucaaccuu

SEQ ID NO: 7619 - RNA, 20 nt, Artificial Sequence
  MKO10007619_A_Cabin1
  gRNA
ccagcuggcggcccagcgag

SEQ ID NO: 7620 - RNA, 20 nt, Artificial Sequence
  MKO10007620_A_Cables1
  gRNA
acgaagagguuccggcggcg

SEQ ID NO: 7621 - RNA, 20 nt, Artificial Sequence
  MKO10007621_A_Cables1
  gRNA
ccgacugccgcucguacucc

SEQ ID NO: 7622 - RNA, 20 nt, Artificial Sequence
  MKO10007622_A_Cables1
  gRNA
uucagaugucgaacacucuc

SEQ ID NO: 7623 - RNA, 20 nt, Artificial Sequence
  MKO10007623_A_Cables2
  gRNA
ggguauauaccucugcaccg

SEQ ID NO: 7624 - RNA, 20 nt, Artificial Sequence
  MKO10007624_A_Cables2
  gRNA
agaagaaacagaaacgccgc

SEQ ID NO: 7625 - RNA, 20 nt, Artificial Sequence
  MKO10007625_A_Cables2
  gRNA
caguuucuuaccugauccgu

SEQ ID NO: 7626 - RNA, 20 nt, Artificial Sequence
  MKO10007626_A_Cabp1
  gRNA
ggacagaucguuacgaccag

SEQ ID NO: 7627 - RNA, 20 nt, Artificial Sequence
  MKO10007627_A_Cabp1
  gRNA
ucauaucugccgucuccgcc

SEQ ID NO: 7628 - RNA, 20 nt, Artificial Sequence
  MKO10007628_A_Cabp1
  gRNA
cauggcggugcagacaagcg

SEQ ID NO: 7629 - RNA, 20 nt, Artificial Sequence
  MKO10007629_A_Cabp2
  gRNA
cgagaccgggacggcuacau

SEQ ID NO: 7630 - RNA, 20 nt, Artificial Sequence
  MKO10007630_A_Cabp2
  gRNA
ugauggcugcaucagcguag

SEQ ID NO: 7631 - RNA, 20 nt, Artificial Sequence
  MKO10007631_A_Cabp2
  gRNA
guagcccaguguccgcaugc

SEQ ID NO: 7632 - RNA, 20 nt, Artificial Sequence
  MKO10007632_A_Cabp4
  gRNA
gcuacgcaucgccuuccgag

SEQ ID NO: 7633 - RNA, 20 nt, Artificial Sequence
  MKO10007633_A_Cabp4
  gRNA
uccuauacaggaucgugaac

SEQ ID NO: 7634 - RNA, 20 nt, Artificial Sequence
  MKO10007634_A_Cabp4
  gRNA
gcaugcagucaccuagcucg

SEQ ID NO: 7635 - RNA, 20 nt, Artificial Sequence
  MKO10007635_A_Cabp5
  gRNA
cacgguucauucggauuugc

SEQ ID NO: 7636 - RNA, 20 nt, Artificial Sequence
  MKO10007636_A_Cabp5
  gRNA
gggcaaucucaugagaacga

SEQ ID NO: 7637 - RNA, 20 nt, Artificial Sequence
  MKO10007637_A_Cabp5
  gRNA
ugaaggcaucucgcaucucc

SEQ ID NO: 7638 - RNA, 20 nt, Artificial Sequence
  MKO10007638_A_Cabp7
  gRNA
uucaagguauucgaccggga

SEQ ID NO: 7639 - RNA, 20 nt, Artificial Sequence
  MKO10007639_A_Cabp7
  gRNA
caccauccaugucuagccgc

SEQ ID NO: 7640 - RNA, 20 nt, Artificial Sequence
  MKO10007640_A_Cabp7
  gRNA
cacucuaggugacggccaag

SEQ ID NO: 7641 - RNA, 20 nt, Artificial Sequence
  MKO10007641_A_Cabs1
  gRNA
cucagaaacugacaacguca

SEQ ID NO: 7642 - RNA, 20 nt, Artificial Sequence
  MKO10007642_A_Cabs1
  gRNA
cucuauaguagauacccuua

SEQ ID NO: 7643 - RNA, 20 nt, Artificial Sequence
  MKO10007643_A_Cabs1
  gRNA
aaugaugaggaaucgacuga

SEQ ID NO: 7644 - RNA, 20 nt, Artificial Sequence
  MKO10007644_A_Cabyr
  gRNA
uaagcguacucggcagagac

SEQ ID NO: 7645 - RNA, 20 nt, Artificial Sequence
  MKO10007645_A_Cabyr
  gRNA
uagucggucuuaggaguagu

SEQ ID NO: 7646 - RNA, 20 nt, Artificial Sequence
  MKO10007646_A_Cabyr
  gRNA
ggugacaaacguacucccuu

SEQ ID NO: 7647 - RNA, 20 nt, Artificial Sequence
  MKO10007647_A_Cacfd1
  gRNA
agcguuuagcaugagcggcu

SEQ ID NO: 7648 - RNA, 20 nt, Artificial Sequence
  MKO10007648_A_Cacfd1
  gRNA
agggagccucgcacaacaac

SEQ ID NO: 7649 - RNA, 20 nt, Artificial Sequence
  MKO10007649_A_Cacfd1
  gRNA
ccgcuccuagcacucccgcc

SEQ ID NO: 7650 - RNA, 20 nt, Artificial Sequence
  MKO10007650_A_Cachd1
  gRNA
cccgaauuuaagucucgucc

SEQ ID NO: 7651 - RNA, 20 nt, Artificial Sequence
  MKO10007651_A_Cachd1
  gRNA
gcagcuacgagcaccgcagu

SEQ ID NO: 7652 - RNA, 20 nt, Artificial Sequence
  MKO10007652_A_Cachd1
  gRNA
guucaaccgcuaccuggaug

SEQ ID NO: 7653 - RNA, 20 nt, Artificial Sequence
  MKO10007653_A_Cacna1a
  gRNA
gacgagaugccgggccgcua

SEQ ID NO: 7654 - RNA, 20 nt, Artificial Sequence
  MKO10007654_A_Cacna1a
  gRNA
gaaccgcccucaguguccgu

SEQ ID NO: 7655 - RNA, 20 nt, Artificial Sequence
  MKO10007655_A_Cacna1a
  gRNA
cuuugcagaauggcccgcuu

SEQ ID NO: 7656 - RNA, 20 nt, Artificial Sequence
  MKO10007656_A_Cacna1b
  gRNA
ugacauuccagccguuccga

SEQ ID NO: 7657 - RNA, 20 nt, Artificial Sequence
  MKO10007657_A_Cacna1b
  gRNA
aguccgugcgcgcugcgcaa

SEQ ID NO: 7658 - RNA, 20 nt, Artificial Sequence
  MKO10007658_A_Cacna1b
  gRNA
acgcuaagcgcaucaccgaa

SEQ ID NO: 7659 - RNA, 20 nt, Artificial Sequence
  MKO10007659_A_Cacna1c
  gRNA
caaccgccacacggccgccc

SEQ ID NO: 7660 - RNA, 20 nt, Artificial Sequence
  MKO10007660_A_Cacna1c
  gRNA
cuccucgcagguuccaacua

SEQ ID NO: 7661 - RNA, 20 nt, Artificial Sequence
  MKO10007661_A_Cacna1c
  gRNA
guuggagucgucuuccggaa

SEQ ID NO: 7662 - RNA, 20 nt, Artificial Sequence
  MKO10007662_A_Cacna1d
  gRNA
acuccugauacaagucgaag

SEQ ID NO: 7663 - RNA, 20 nt, Artificial Sequence
  MKO10007663_A_Cacna1d
  gRNA
ugcaaucgaugcugcuagac

SEQ ID NO: 7664 - RNA, 20 nt, Artificial Sequence
  MKO10007664_A_Cacna1d
  gRNA
agaccacuucgacuuguauc

SEQ ID NO: 7665 - RNA, 20 nt, Artificial Sequence
  MKO10007665_A_Cacna1e
  gRNA
guucauaccuccguaauggc

SEQ ID NO: 7666 - RNA, 20 nt, Artificial Sequence
  MKO10007666_A_Cacna1e
  gRNA
gaccccaaugucucgaagac

SEQ ID NO: 7667 - RNA, 20 nt, Artificial Sequence
  MKO10007667_A_Cacna1e
  gRNA
aacccacuucaacacccacg

SEQ ID NO: 7668 - RNA, 20 nt, Artificial Sequence
  MKO10007668_A_Cacna1f
  gRNA
accgacgaaugggauuagua

SEQ ID NO: 7669 - RNA, 20 nt, Artificial Sequence
  MKO10007669_A_Cacna1f
  gRNA
gcucgacuucaucaucgucg

SEQ ID NO: 7670 - RNA, 20 nt, Artificial Sequence
  MKO10007670_A_Cacna1f
  gRNA
cccagcgccuauauucgcaa

SEQ ID NO: 7671 - RNA, 20 nt, Artificial Sequence
  MKO10007671_A_Cacna1g
  gRNA
uccgugugcugcgaccgcuc

SEQ ID NO: 7672 - RNA, 20 nt, Artificial Sequence
  MKO10007672_A_Cacna1g
  gRNA
cucacugggcacccgguuaa

SEQ ID NO: 7673 - RNA, 20 nt, Artificial Sequence
  MKO10007673_A_Cacna1g
  gRNA
gcggagcuggugucuccgca

SEQ ID NO: 7674 - RNA, 20 nt, Artificial Sequence
  MKO10007674_A_Cacna1h
  gRNA
accugacgaaggcgcugucc

SEQ ID NO: 7675 - RNA, 20 nt, Artificial Sequence
  MKO10007675_A_Cacna1h
  gRNA
ccccucaggcaugcgaaucc

SEQ ID NO: 7676 - RNA, 20 nt, Artificial Sequence
  MKO10007676_A_Cacna1h
  gRNA
guucgagcacauuagcaugc

SEQ ID NO: 7677 - RNA, 20 nt, Artificial Sequence
  MKO10007677_A_Cacna1i
  gRNA
aggcacuccauaucgucaca

SEQ ID NO: 7678 - RNA, 20 nt, Artificial Sequence
  MKO10007678_A_Cacna1i
  gRNA
caucaucggcgugcagcucu

SEQ ID NO: 7679 - RNA, 20 nt, Artificial Sequence
  MKO10007679_A_Cacna1i
  gRNA
guaccagccaugugacgaua

SEQ ID NO: 7680 - RNA, 20 nt, Artificial Sequence
  MKO10007680_A_Cacna1s
  gRNA
aacaaggcccgcgggggccu

SEQ ID NO: 7681 - RNA, 20 nt, Artificial Sequence
  MKO10007681_A_Cacna1s
  gRNA
gaucuucauggcggcuucaa

SEQ ID NO: 7682 - RNA, 20 nt, Artificial Sequence
  MKO10007682_A_Cacna1s
  gRNA
ugagcacgcggaaugcucga

SEQ ID NO: 7683 - RNA, 20 nt, Artificial Sequence
  MKO10007683_A_Cacna2d1
  gRNA
ccgacuuacgugacgggcga

SEQ ID NO: 7684 - RNA, 20 nt, Artificial Sequence
  MKO10007684_A_Cacna2d1
  gRNA
gcugaucggccccucgagcg

SEQ ID NO: 7685 - RNA, 20 nt, Artificial Sequence
  MKO10007685_A_Cacna2d1
  gRNA
gcccaacaaugcacgccaac

SEQ ID NO: 7686 - RNA, 20 nt, Artificial Sequence
  MKO10007686_A_Cacna2d2
  gRNA
cggugcggaccgcucgcccc

SEQ ID NO: 7687 - RNA, 20 nt, Artificial Sequence
  MKO10007687_A_Cacna2d2
  gRNA
cucggaccugcggcgcuucu

SEQ ID NO: 7688 - RNA, 20 nt, Artificial Sequence
  MKO10007688_A_Cacna2d2
  gRNA
ugauguuguccugccagcga

SEQ ID NO: 7689 - RNA, 20 nt, Artificial Sequence
  MKO10007689_A_Cacna2d3
  gRNA
gcccgaguacuuggcagcga

SEQ ID NO: 7690 - RNA, 20 nt, Artificial Sequence
  MKO10007690_A_Cacna2d3
  gRNA
gauguuccacaagaaguccg

SEQ ID NO: 7691 - RNA, 20 nt, Artificial Sequence
  MKO10007691_A_Cacna2d3
  gRNA
ccuuuguuguacauguucgu

SEQ ID NO: 7692 - RNA, 20 nt, Artificial Sequence
  MKO10007692_A_Cacna2d4
  gRNA
guuguacagauuccugccga

SEQ ID NO: 7693 - RNA, 20 nt, Artificial Sequence
  MKO10007693_A_Cacna2d4
  gRNA
cagguugcugaagugcgcgu

SEQ ID NO: 7694 - RNA, 20 nt, Artificial Sequence
  MKO10007694_A_Cacna2d4
  gRNA
ccaguuuaacuacuacaacu

SEQ ID NO: 7695 - RNA, 20 nt, Artificial Sequence
  MKO10007695_A_Cacnb1
  gRNA
cuguccaguuugaccgggcu

SEQ ID NO: 7696 - RNA, 20 nt, Artificial Sequence
  MKO10007696_A_Cacnb1
  gRNA
ucaccuuggcuuucucgagc

SEQ ID NO: 7697 - RNA, 20 nt, Artificial Sequence
  MKO10007697_A_Cacnb1
  gRNA
guccgaacagcaaaagccac

SEQ ID NO: 7698 - RNA, 20 nt, Artificial Sequence
  MKO10007698_A_Cacnb2
  gRNA
caccggaacgucauccuccu

SEQ ID NO: 7699 - RNA, 20 nt, Artificial Sequence
  MKO10007699_A_Cacnb2
  gRNA
cuggcggacaaaacuguuug

SEQ ID NO: 7700 - RNA, 20 nt, Artificial Sequence
  MKO10007700_A_Cacnb2
  gRNA
ugacguuccggugccuggca

SEQ ID NO: 7701 - RNA, 20 nt, Artificial Sequence
  MKO10007701_A_Cacnb3
  gRNA
gucgguugccaaugucaccc

SEQ ID NO: 7702 - RNA, 20 nt, Artificial Sequence
  MKO10007702_A_Cacnb3
  gRNA
ggagagugcccggcgagaag

SEQ ID NO: 7703 - RNA, 20 nt, Artificial Sequence
  MKO10007703_A_Cacnb3
  gRNA
gaucgggaggcuagugaaag

SEQ ID NO: 7704 - RNA, 20 nt, Artificial Sequence
  MKO10007704_A_Cacnb4
  gRNA
gaacgggcacaucuucgucc

SEQ ID NO: 7705 - RNA, 20 nt, Artificial Sequence
  MKO10007705_A_Cacnb4
  gRNA
guccgauggccugcuuguau

SEQ ID NO: 7706 - RNA, 20 nt, Artificial Sequence
  MKO10007706_A_Cacnb4
  gRNA
aucggacuccgaugucuccu

SEQ ID NO: 7707 - RNA, 20 nt, Artificial Sequence
  MKO10007707_A_Cacng1
  gRNA
cacacgaaccuucgcuguuu

SEQ ID NO: 7708 - RNA, 20 nt, Artificial Sequence
  MKO10007708_A_Cacng1
  gRNA
gaagcguaugauugacagcg

SEQ ID NO: 7709 - RNA, 20 nt, Artificial Sequence
  MKO10007709_A_Cacng1
  gRNA
gcaccacaaugaaacgugcg

SEQ ID NO: 7710 - RNA, 20 nt, Artificial Sequence
  MKO10007710_A_Cacng2
  gRNA
guccuucaucaucgccgaga

SEQ ID NO: 7711 - RNA, 20 nt, Artificial Sequence
  MKO10007711_A_Cacng2
  gRNA
gcuucguaguccgcgucuuc

SEQ ID NO: 7712 - RNA, 20 nt, Artificial Sequence
  MKO10007712_A_Cacng2
  gRNA
uuaugacccauuccggauua

SEQ ID NO: 7713 - RNA, 20 nt, Artificial Sequence
  MKO10007713_A_Cacng3
  gRNA
uugcgcgccugccgcccuac

SEQ ID NO: 7714 - RNA, 20 nt, Artificial Sequence
  MKO10007714_A_Cacng3
  gRNA
agagucauugcauaacaauc

SEQ ID NO: 7715 - RNA, 20 nt, Artificial Sequence
  MKO10007715_A_Cacng3
  gRNA
cauuaaacuaaaagcugcga

SEQ ID NO: 7716 - RNA, 20 nt, Artificial Sequence
  MKO10007716_A_Cacng4
  gRNA
accauggugcgaugcgaccg

SEQ ID NO: 7717 - RNA, 20 nt, Artificial Sequence
  MKO10007717_A_Cacng4
  gRNA
cgucgccgguaccuguagcu

SEQ ID NO: 7718 - RNA, 20 nt, Artificial Sequence
  MKO10007718_A_Cacng4
  gRNA
gucacacgggagucguccgc

SEQ ID NO: 7719 - RNA, 20 nt, Artificial Sequence
  MKO10007719_A_Cacng5
  gRNA
ucgggcacauccguccgcac

SEQ ID NO: 7720 - RNA, 20 nt, Artificial Sequence
  MKO10007720_A_Cacng5
  gRNA
agcaacugcuccgauuacuc

SEQ ID NO: 7721 - RNA, 20 nt, Artificial Sequence
  MKO10007721_A_Cacng5
  gRNA
ggaugugcccgauguugcuc

SEQ ID NO: 7722 - RNA, 20 nt, Artificial Sequence
  MKO10007722_A_Cacng6
  gRNA
ggcaaucgugggugcuacgc

SEQ ID NO: 7723 - RNA, 20 nt, Artificial Sequence
  MKO10007723_A_Cacng6
  gRNA
agaccgacgccggacagcug

SEQ ID NO: 7724 - RNA, 20 nt, Artificial Sequence
  MKO10007724_A_Cacng6
  gRNA
cgcuggucuaauccugcugc

SEQ ID NO: 7725 - RNA, 20 nt, Artificial Sequence
  MKO10007725_A_Cacng7
  gRNA
accauucuugcguucguuuc

SEQ ID NO: 7726 - RNA, 20 nt, Artificial Sequence
  MKO10007726_A_Cacng7
  gRNA
agagauguaucgcccgcacc

SEQ ID NO: 7727 - RNA, 20 nt, Artificial Sequence
  MKO10007727_A_Cacng7
  gRNA
acgucgcuagagaugucgga

SEQ ID NO: 7728 - RNA, 20 nt, Artificial Sequence
  MKO10007728_A_Cacng8
  gRNA
acgccgcggccucuuuggac

SEQ ID NO: 7729 - RNA, 20 nt, Artificial Sequence
  MKO10007729_A_Cacng8
  gRNA
cgcacgccccuacacgggcg

SEQ ID NO: 7730 - RNA, 20 nt, Artificial Sequence
  MKO10007730_A_Cacng8
  gRNA
ggacuacgaccacgacagcg

SEQ ID NO: 7731 - RNA, 20 nt, Artificial Sequence
  MKO10007731_A_Cacuin
  gRNA
guaagggucacaggcgcucg

SEQ ID NO: 7732 - RNA, 20 nt, Artificial Sequence
  MKO10007732_A_Cacuin
  gRNA
agcuaagcccaucgaccucc

SEQ ID NO: 7733 - RNA, 20 nt, Artificial Sequence
  MKO10007733_A_Cacuin
  gRNA
acgagcgccugugacccuua

SEQ ID NO: 7734 - RNA, 20 nt, Artificial Sequence
  MKO10007734_A_Cacul1
  gRNA
aggcuggcggaaacuguccg

SEQ ID NO: 7735 - RNA, 20 nt, Artificial Sequence
  MKO10007735_A_Cacul1
  gRNA
uucucggccuggauccggga

SEQ ID NO: 7736 - RNA, 20 nt, Artificial Sequence
  MKO10007736_A_Cacul1
  gRNA
guauauagucaccaggacuc

SEQ ID NO: 7737 - RNA, 20 nt, Artificial Sequence
  MKO10007737_A_Cacybp
  gRNA
caccugauggacgccaguca

SEQ ID NO: 7738 - RNA, 20 nt, Artificial Sequence
  MKO10007738_A_Cacybp
  gRNA
ggugcccacugagaacgugc

SEQ ID NO: 7739 - RNA, 20 nt, Artificial Sequence
  MKO10007739_A_Cacybp
  gRNA
uuauaggucauuugaucuuc

SEQ ID NO: 7740 - RNA, 20 nt, Artificial Sequence
  MKO10007740_A_Cadm1
  gRNA
auaucgaucaucaaguuacg

SEQ ID NO: 7741 - RNA, 20 nt, Artificial Sequence
  MKO10007741_A_Cadm1
  gRNA
gcaagccagcgacgaccauc

SEQ ID NO: 7742 - RNA, 20 nt, Artificial Sequence
  MKO10007742_A_Cadm1
  gRNA
acugacgaaugucucaaucu

SEQ ID NO: 7743 - RNA, 20 nt, Artificial Sequence
  MKO10007743_A_Cadm2
  gRNA
ucgagcugguucgcgcuucu

SEQ ID NO: 7744 - RNA, 20 nt, Artificial Sequence
  MKO10007744_A_Cadm2
  gRNA
agccugcggcugauauaaga

SEQ ID NO: 7745 - RNA, 20 nt, Artificial Sequence
  MKO10007745_A_Cadm2
  gRNA
aaccaucuuauaucagccgc

SEQ ID NO: 7746 - RNA, 20 nt, Artificial Sequence
  MKO10007746_A_Cadm3
  gRNA
gcugaauccgauuaucucga

SEQ ID NO: 7747 - RNA, 20 nt, Artificial Sequence
  MKO10007747_A_Cadm3
  gRNA
gcucagcagacccuauacuu

SEQ ID NO: 7748 - RNA, 20 nt, Artificial Sequence
  MKO10007748_A_Cadm3
  gRNA
ccccagcccuucgagauaau

SEQ ID NO: 7749 - RNA, 20 nt, Artificial Sequence
  MKO10007749_A_Cadm4
  gRNA
gcgcugguaucgggaucgca

SEQ ID NO: 7750 - RNA, 20 nt, Artificial Sequence
  MKO10007750_A_Cadm4
  gRNA
accgcugcggggcgcgaccg

SEQ ID NO: 7751 - RNA, 20 nt, Artificial Sequence
  MKO10007751_A_Cadm4
  gRNA
cgucguccuugcgauccaca

SEQ ID NO: 7752 - RNA, 20 nt, Artificial Sequence
  MKO10007752_A_Cadps2
  gRNA
ucgccccucgcugaguaccg

SEQ ID NO: 7753 - RNA, 20 nt, Artificial Sequence
  MKO10007753_A_Cadps2
  gRNA
gcucgacccgucuuccagcg

SEQ ID NO: 7754 - RNA, 20 nt, Artificial Sequence
  MKO10007754_A_Cadps2
  gRNA
ccaaauaugacgccauuuac

SEQ ID NO: 7755 - RNA, 20 nt, Artificial Sequence
  MKO10007755_A_Cadps
  gRNA
agacaggcgcgcuccagacg

SEQ ID NO: 7756 - RNA, 20 nt, Artificial Sequence
  MKO10007756_A_Cadps
  gRNA
uccuucucgcucaccaccga

SEQ ID NO: 7757 - RNA, 20 nt, Artificial Sequence
  MKO10007757_A_Cadps
  gRNA
aaguuugaugccaucuaccg

SEQ ID NO: 7758 - RNA, 20 nt, Artificial Sequence
  MKO10007758_A_Cad
  gRNA
augccguaguugccgaugag

SEQ ID NO: 7759 - RNA, 20 nt, Artificial Sequence
  MKO10007759_A_Cad
  gRNA
acuccacggguauucaaugc

SEQ ID NO: 7760 - RNA, 20 nt, Artificial Sequence
  MKO10007760_A_Cad
  gRNA
cccccugcauugaauacccg

SEQ ID NO: 7761 - RNA, 20 nt, Artificial Sequence
  MKO10007761_A_Cage1
  gRNA
gguccauuacgugcgcuuac

SEQ ID NO: 7762 - RNA, 20 nt, Artificial Sequence
  MKO10007762_A_Cage1
  gRNA
uuuccuguaagcgcacguaa

SEQ ID NO: 7763 - RNA, 20 nt, Artificial Sequence
  MKO10007763_A_Cage1
  gRNA
agaagugccgucguagaugu

SEQ ID NO: 7764 - RNA, 20 nt, Artificial Sequence
  MKO10007764_A_Calb1
  gRNA
gcuucugcaggcgcgaaaga

SEQ ID NO: 7765 - RNA, 20 nt, Artificial Sequence
  MKO10007765_A_Calb1
  gRNA
caucgaaaccgaggaacuua

SEQ ID NO: 7766 - RNA, 20 nt, Artificial Sequence
  MKO10007766_A_Calb1
  gRNA
cucgcucaccuuaaguuccu

SEQ ID NO: 7767 - RNA, 20 nt, Artificial Sequence
  MKO10007767_A_Calb2
  gRNA
cucuccaaaauugucgcucu

SEQ ID NO: 7768 - RNA, 20 nt, Artificial Sequence
  MKO10007768_A_Calb2
  gRNA
auguccaagagcgacaauuu

SEQ ID NO: 7769 - RNA, 20 nt, Artificial Sequence
  MKO10007769_A_Calb2
  gRNA
caccuccauaaacucagcgc

SEQ ID NO: 7770 - RNA, 20 nt, Artificial Sequence
  MKO10007770_A_Calca
  gRNA
auucccacaccgcuuagauc

SEQ ID NO: 7771 - RNA, 20 nt, Artificial Sequence
  MKO10007771_A_Calca
  gRNA
ugaagaagaaguucgccugc

SEQ ID NO: 7772 - RNA, 20 nt, Artificial Sequence
  MKO10007772_A_Calca
  gRNA
cuucaaccccaauugaaguu

SEQ ID NO: 7773 - RNA, 20 nt, Artificial Sequence
  MKO10007773_A_Calcb
  gRNA
uuuaccugaaaggggcagcc

SEQ ID NO: 7774 - RNA, 20 nt, Artificial Sequence
  MKO10007774_A_Calcb
  gRNA
cgccgagggugcccaggucu

SEQ ID NO: 7775 - RNA, 20 nt, Artificial Sequence
  MKO10007775_A_Calcb
  gRNA
uuuggagagcagccuagacc

SEQ ID NO: 7776 - RNA, 20 nt, Artificial Sequence
  MKO10007776_A_Calcoco1
  gRNA
cgugugauaaucucgaacgc

SEQ ID NO: 7777 - RNA, 20 nt, Artificial Sequence
  MKO10007777_A_Calcoco1
  gRNA
ggcgguucacauaccggaac

SEQ ID NO: 7778 - RNA, 20 nt, Artificial Sequence
  MKO10007778_A_Calcoco1
  gRNA
gagauuaucacacguucgug

SEQ ID NO: 7779 - RNA, 20 nt, Artificial Sequence
  MKO10007779_A_Calcoco2
  gRNA
gugcagaucauuccaccaau

SEQ ID NO: 7780 - RNA, 20 nt, Artificial Sequence
  MKO10007780_A_Calcoco2
  gRNA
cagcaggaaauccaauucaa

SEQ ID NO: 7781 - RNA, 20 nt, Artificial Sequence
  MKO10007781_A_Calcoco2
  gRNA
uaagaccuuagaacacaaag

SEQ ID NO: 7782 - RNA, 20 nt, Artificial Sequence
  MKO10007782_A_Calcrl
  gRNA
ccagcauagccauccguccc

SEQ ID NO: 7783 - RNA, 20 nt, Artificial Sequence
  MKO10007783_A_Calcrl
  gRNA
gccgaaaccaguguccaucu

SEQ ID NO: 7784 - RNA, 20 nt, Artificial Sequence
  MKO10007784_A_Calcrl
  gRNA
auccggauaguaauagaaca

SEQ ID NO: 7785 - RNA, 20 nt, Artificial Sequence
  MKO10007785_A_Calcr
  gRNA
aucuccgcaaaccgaagaug

SEQ ID NO: 7786 - RNA, 20 nt, Artificial Sequence
  MKO10007786_A_Calcr
  gRNA
gggugaaccuguucacgaga

SEQ ID NO: 7787 - RNA, 20 nt, Artificial Sequence
  MKO10007787_A_Calcr
  gRNA
gucuguacugcaaccgcacc

SEQ ID NO: 7788 - RNA, 20 nt, Artificial Sequence
  MKO10007788_A_Cald1
  gRNA
gagacgucaaaaacgccuuc

SEQ ID NO: 7789 - RNA, 20 nt, Artificial Sequence
  MKO10007789_A_Cald1
  gRNA
cugccagggaacggcgccgc

SEQ ID NO: 7790 - RNA, 20 nt, Artificial Sequence
  MKO10007790_A_Cald1
  gRNA
gaggagcugcgccgacgccg

SEQ ID NO: 7791 - RNA, 20 nt, Artificial Sequence
  MKO10007791_A_Calhm1
  gRNA
gaccacauuacuagcguucg

SEQ ID NO: 7792 - RNA, 20 nt, Artificial Sequence
  MKO10007792_A_Calhm1
  gRNA
uaccacgaacgcuaguaaug

SEQ ID NO: 7793 - RNA, 20 nt, Artificial Sequence
  MKO10007793_A_Calhm1
  gRNA
guccuuggcccggcgaccug

SEQ ID NO: 7794 - RNA, 20 nt, Artificial Sequence
  MKO10007794_A_Calhm2
  gRNA
uagucgccgagugccaguac

SEQ ID NO: 7795 - RNA, 20 nt, Artificial Sequence
  MKO10007795_A_Calhm2
  gRNA
caaccuaucgagcuuccgag

SEQ ID NO: 7796 - RNA, 20 nt, Artificial Sequence
  MKO10007796_A_Calhm2
  gRNA
ggcucaguaccguaccaacg

SEQ ID NO: 7797 - RNA, 20 nt, Artificial Sequence
  MKO10007797_A_Calm1
  gRNA
cgucaccaucuuuaucgaau

SEQ ID NO: 7798 - RNA, 20 nt, Artificial Sequence
  MKO10007798_A_Calm1
  gRNA
gacggacaagucaacuauga

SEQ ID NO: 7799 - RNA, 20 nt, Artificial Sequence
  MKO10007799_A_Calm1
  gRNA
ggggaccgucaugcggucac

SEQ ID NO: 7800 - RNA, 20 nt, Artificial Sequence
  MKO10007800_A_Calm2
  gRNA
gacggucagguaaacuacga

SEQ ID NO: 7801 - RNA, 20 nt, Artificial Sequence
  MKO10007801_A_Calm2
  gRNA
gccuuaccuuaucaaacaca

SEQ ID NO: 7802 - RNA, 20 nt, Artificial Sequence
  MKO10007802_A_Calm2
  gRNA
caucuguuaacuucucgcca

SEQ ID NO: 7803 - RNA, 20 nt, Artificial Sequence
  MKO10007803_A_Calm3
  gRNA
gauggccaggucaauuauga

SEQ ID NO: 7804 - RNA, 20 nt, Artificial Sequence
  MKO10007804_A_Calm3
  gRNA
acucaccuucauaauugacc

SEQ ID NO: 7805 - RNA, 20 nt, Artificial Sequence
  MKO10007805_A_Calm3
  gRNA
caucuccauccuugucgaag

SEQ ID NO: 7806 - RNA, 20 nt, Artificial Sequence
  MKO10007806_A_Calm4
  gRNA
caaguuccucgacgcugaua

SEQ ID NO: 7807 - RNA, 20 nt, Artificial Sequence
  MKO10007807_A_Calm4
  gRNA
guuaggcgagucccuuuccc

SEQ ID NO: 7808 - RNA, 20 nt, Artificial Sequence
  MKO10007808_A_Calm4
  gRNA
gcuggaggacaugauccgug

SEQ ID NO: 7809 - RNA, 20 nt, Artificial Sequence
  MKO10007809_A_Calm5
  gRNA
ggauggccauaucaacgucc

SEQ ID NO: 7810 - RNA, 20 nt, Artificial Sequence
  MKO10007810_A_Calm5
  gRNA
gaugggagagccgcuuuccc

SEQ ID NO: 7811 - RNA, 20 nt, Artificial Sequence
  MKO10007811_A_Calm5
  gRNA
aagguacagagaugucucac

SEQ ID NO: 7812 - RNA, 20 nt, Artificial Sequence
  MKO10007812_A_Calml3
  gRNA
ugccauccuugucgaacacu

SEQ ID NO: 7813 - RNA, 20 nt, Artificial Sequence
  MKO10007813_A_Calml3
  gRNA
gcaaaucgccgaguucaaag

SEQ ID NO: 7814 - RNA, 20 nt, Artificial Sequence
  MKO10007814_A_Calml3
  gRNA
aguggacgaaaugauacagg

SEQ ID NO: 7815 - RNA, 20 nt, Artificial Sequence
  MKO10007815_A_Calml4
  gRNA
cucccuuaguagucucgcac

SEQ ID NO: 7816 - RNA, 20 nt, Artificial Sequence
  MKO10007816_A_Calml4
  gRNA
auuccugugcgagacuacua

SEQ ID NO: 7817 - RNA, 20 nt, Artificial Sequence
  MKO10007817_A_Calml4
  gRNA
accuaccauuaauuuggucc

SEQ ID NO: 7818 - RNA, 20 nt, Artificial Sequence
  MKO10007818_A_Caln1
  gRNA
auagccagcuccacuucgcu

SEQ ID NO: 7819 - RNA, 20 nt, Artificial Sequence
  MKO10007819_A_Caln1
  gRNA
cgacaugcagagagucacgc

SEQ ID NO: 7820 - RNA, 20 nt, Artificial Sequence
  MKO10007820_A_Caln1
  gRNA
gcaguuggcuaauaucuccg

SEQ ID NO: 7821 - RNA, 20 nt, Artificial Sequence
  MKO10007821_A_Calr3
  gRNA
uacugcgucagguagccagc

SEQ ID NO: 7822 - RNA, 20 nt, Artificial Sequence
  MKO10007822_A_Calr3
  gRNA
aagaccagaucuuucuuacg

SEQ ID NO: 7823 - RNA, 20 nt, Artificial Sequence
  MKO10007823_A_Calr3
  gRNA
gugccagcaagccgagugac

SEQ ID NO: 7824 - RNA, 20 nt, Artificial Sequence
  MKO10007824_A_Calr4
  gRNA
aaauaaaagaccccuacgcc

SEQ ID NO: 7825 - RNA, 20 nt, Artificial Sequence
  MKO10007825_A_Calr4
  gRNA
aguucuacgcccuuuccacc

SEQ ID NO: 7826 - RNA, 20 nt, Artificial Sequence
  MKO10007826_A_Calr4
  gRNA
aucgccucauuccagucauc

SEQ ID NO: 7827 - RNA, 20 nt, Artificial Sequence
  MKO10007827_A_Calr
  gRNA
uacgugaagcuguuuccgag

SEQ ID NO: 7828 - RNA, 20 nt, Artificial Sequence
  MKO10007828_A_Calr
  gRNA
uacauagguccggacaucug

SEQ ID NO: 7829 - RNA, 20 nt, Artificial Sequence
  MKO10007829_A_Calr
  gRNA
cagaugccuggaccaaccgc

SEQ ID NO: 7830 - RNA, 20 nt, Artificial Sequence
  MKO10007830_A_Calu
  gRNA
caugaaagacauagucgugc

SEQ ID NO: 7831 - RNA, 20 nt, Artificial Sequence
  MKO10007831_A_Calu
  gRNA
uuucgagauaagaaccggga

SEQ ID NO: 7832 - RNA, 20 nt, Artificial Sequence
  MKO10007832_A_Calu
  gRNA
gacagagcgagaacaguucg

SEQ ID NO: 7833 - RNA, 20 nt, Artificial Sequence
  MKO10007833_A_Caly
  gRNA
aaacaacuaccggaccgcca

SEQ ID NO: 7834 - RNA, 20 nt, Artificial Sequence
  MKO10007834_A_Caly
  gRNA
cgaacgccaccgcagcaucc

SEQ ID NO: 7835 - RNA, 20 nt, Artificial Sequence
  MKO10007835_A_Caly
  gRNA
ucagccgucauucucagacc

SEQ ID NO: 7836 - RNA, 20 nt, Artificial Sequence
  MKO10007836_A_Camk1d
  gRNA
agaacucuucgaucggauag

SEQ ID NO: 7837 - RNA, 20 nt, Artificial Sequence
  MKO10007837_A_Camk1d
  gRNA
cuuauacuacagucaagacg

SEQ ID NO: 7838 - RNA, 20 nt, Artificial Sequence
  MKO10007838_A_Camk1d
  gRNA
gaugugauguccacggccug

SEQ ID NO: 7839 - RNA, 20 nt, Artificial Sequence
  MKO10007839_A_Camk1g
  gRNA
cuggacucacccacguagcc

SEQ ID NO: 7840 - RNA, 20 nt, Artificial Sequence
  MKO10007840_A_Camk1g
  gRNA
gagcaccacccacuacuacc

SEQ ID NO: 7841 - RNA, 20 nt, Artificial Sequence
  MKO10007841_A_Camk1g
  gRNA
uuugaccggauccuagagcg

SEQ ID NO: 7842 - RNA, 20 nt, Artificial Sequence
  MKO10007842_A_Camk1
  gRNA
agagcuguuugaccgaauug

SEQ ID NO: 7843 - RNA, 20 nt, Artificial Sequence
  MKO10007843_A_Camk1
  gRNA
ugucaaguaccugcacgacc

SEQ ID NO: 7844 - RNA, 20 nt, Artificial Sequence
  MKO10007844_A_Camk1
  gRNA
cauccagacuguaguacagc

SEQ ID NO: 7845 - RNA, 20 nt, Artificial Sequence
  MKO10007845_A_Camk2a
  gRNA
cuaccuuacagugcgcaaac

SEQ ID NO: 7846 - RNA, 20 nt, Artificial Sequence
  MKO10007846_A_Camk2a
  gRNA
aauagaaucgaugaaagucc

SEQ ID NO: 7847 - RNA, 20 nt, Artificial Sequence
  MKO10007847_A_Camk2a
  gRNA
cacaggaagaugugcgaccc

SEQ ID NO: 7848 - RNA, 20 nt, Artificial Sequence
  MKO10007848_A_Camk2b
  gRNA
ugccaauauccucguauagc

SEQ ID NO: 7849 - RNA, 20 nt, Artificial Sequence
  MKO10007849_A_Camk2b
  gRNA
cgacgaguaccagcuauacg

SEQ ID NO: 7850 - RNA, 20 nt, Artificial Sequence
  MKO10007850_A_Camk2b
  gRNA
gcacuuacagaucgaagacc

SEQ ID NO: 7851 - RNA, 20 nt, Artificial Sequence
  MKO10007851_A_Camk2d
  gRNA
cucaaagagcugauacucgu

SEQ ID NO: 7852 - RNA, 20 nt, Artificial Sequence
  MKO10007852_A_Camk2d
  gRNA
cgacgaguaucagcucuuug

SEQ ID NO: 7853 - RNA, 20 nt, Artificial Sequence
  MKO10007853_A_Camk2d
  gRNA
gagacuucacgacaguauau

SEQ ID NO: 7854 - RNA, 20 nt, Artificial Sequence
  MKO10007854_A_Camk2g
  gRNA
accaagaaguuguccgcccg

SEQ ID NO: 7855 - RNA, 20 nt, Artificial Sequence
  MKO10007855_A_Camk2g
  gRNA
ugccgagcuccucgaaaagc

SEQ ID NO: 7856 - RNA, 20 nt, Artificial Sequence
  MKO10007856_A_Camk2g
  gRNA
accucgggcggacaacuucu

SEQ ID NO: 7857 - RNA, 20 nt, Artificial Sequence
  MKO10007857_A_Camk2n1
  gRNA
gaucuucucgugccgccugc

SEQ ID NO: 7858 - RNA, 20 nt, Artificial Sequence
  MKO10007858_A_Camk2n1
  gRNA
gcucagcuucucgucgccgu

SEQ ID NO: 7859 - RNA, 20 nt, Artificial Sequence
  MKO10007859_A_Camk2n1
  gRNA
gcugaaaaccaugaccgaca

SEQ ID NO: 7860 - RNA, 20 nt, Artificial Sequence
  MKO10007860_A_Camk2n2
  gRNA
cggcgcgucuacacuccgga

SEQ ID NO: 7861 - RNA, 20 nt, Artificial Sequence
  MKO10007861_A_Camk2n2
  gRNA
ccggauagacgacgugcuga

SEQ ID NO: 7862 - RNA, 20 nt, Artificial Sequence
  MKO10007862_A_Camk2n2
  gRNA
gccgcguaccucucuuggcu

SEQ ID NO: 7863 - RNA, 20 nt, Artificial Sequence
  MKO10007863_A_Camk4
  gRNA
auacuacagugagcgcgaug

SEQ ID NO: 7864 - RNA, 20 nt, Artificial Sequence
  MKO10007864_A_Camk4
  gRNA
ugacgcggugaagcagaucc

SEQ ID NO: 7865 - RNA, 20 nt, Artificial Sequence
  MKO10007865_A_Camk4
  gRNA
uguucgggugugagagacgc

SEQ ID NO: 7866 - RNA, 20 nt, Artificial Sequence
  MKO10007866_A_Camkk1
  gRNA
acaggccguccuccccccag

SEQ ID NO: 7867 - RNA, 20 nt, Artificial Sequence
  MKO10007867_A_Camkk1
  gRNA
ucuccugauacacacgcucc

SEQ ID NO: 7868 - RNA, 20 nt, Artificial Sequence
  MKO10007868_A_Camkk1
  gRNA
ucugucuucacuuucguugu

SEQ ID NO: 7869 - RNA, 20 nt, Artificial Sequence
  MKO10007869_A_Camkk2
  gRNA
ccccaucgagcaaguguacc

SEQ ID NO: 7870 - RNA, 20 nt, Artificial Sequence
  MKO10007870_A_Camkk2
  gRNA
ucaucccaacguggugaagc

SEQ ID NO: 7871 - RNA, 20 nt, Artificial Sequence
  MKO10007871_A_Camkk2
  gRNA
caaaaagaagcugauccgac

SEQ ID NO: 7872 - RNA, 20 nt, Artificial Sequence
  MKO10007872_A_Camkmt
  gRNA
ccaaauacagcaucuccgua

SEQ ID NO: 7873 - RNA, 20 nt, Artificial Sequence
  MKO10007873_A_Camkmt
  gRNA
ucuaggcaucuggccauccg

SEQ ID NO: 7874 - RNA, 20 nt, Artificial Sequence
  MKO10007874_A_Camkmt
  gRNA
ccuuacggagaugcuguauu

SEQ ID NO: 7875 - RNA, 20 nt, Artificial Sequence
  MKO10007875_A_Camkv
  gRNA
ccuugcggccaucacgcuuc

SEQ ID NO: 7876 - RNA, 20 nt, Artificial Sequence
  MKO10007876_A_Camkv
  gRNA
cucgcuccgaguaguagccc

SEQ ID NO: 7877 - RNA, 20 nt, Artificial Sequence
  MKO10007877_A_Camkv
  gRNA
acucgcucaagauugugcac

SEQ ID NO: 7878 - RNA, 20 nt, Artificial Sequence
  MKO10007878_A_Caml
  gRNA
acuccgagcaacgcaucaac

SEQ ID NO: 7879 - RNA, 20 nt, Artificial Sequence
  MKO10007879_A_Caml
  gRNA
ggaaagacccgcgacgccgu

SEQ ID NO: 7880 - RNA, 20 nt, Artificial Sequence
  MKO10007880_A_Caml
  gRNA
gggugcgcucugcucgcucu

SEQ ID NO: 7881 - RNA, 20 nt, Artificial Sequence
  MKO10007881_A_Camp
  gRNA
caccaaucucuaccgucucc

SEQ ID NO: 7882 - RNA, 20 nt, Artificial Sequence
  MKO10007882_A_Camp
  gRNA
uaagguggugaagcagugua

SEQ ID NO: 7883 - RNA, 20 nt, Artificial Sequence
  MKO10007883_A_Camp
  gRNA
agccuggugcacagcccuuu

SEQ ID NO: 7884 - RNA, 20 nt, Artificial Sequence
  MKO10007884_A_Camsap1
  gRNA
cgauguaaaacgggucucgg

SEQ ID NO: 7885 - RNA, 20 nt, Artificial Sequence
  MKO10007885_A_Camsap1
  gRNA
gggcauccaccaucgccaug

SEQ ID NO: 7886 - RNA, 20 nt, Artificial Sequence
  MKO10007886_A_Camsap1
  gRNA
gucacccuacuucccguugu

SEQ ID NO: 7887 - RNA, 20 nt, Artificial Sequence
  MKO10007887_A_Camsap2
  gRNA
uccagcgcgacaguacagcu

SEQ ID NO: 7888 - RNA, 20 nt, Artificial Sequence
  MKO10007888_A_Camsap2
  gRNA
cuuuauagaaaaugugcccg

SEQ ID NO: 7889 - RNA, 20 nt, Artificial Sequence
  MKO10007889_A_Camsap2
  gRNA
agaucugcccuaugauauug

SEQ ID NO: 7890 - RNA, 20 nt, Artificial Sequence
  MKO10007890_A_Camsap3
  gRNA
guuaccugcucccccgaaug

SEQ ID NO: 7891 - RNA, 20 nt, Artificial Sequence
  MKO10007891_A_Camsap3
  gRNA
cuacaccgaucaguacgcac

SEQ ID NO: 7892 - RNA, 20 nt, Artificial Sequence
  MKO10007892_A_Camsap3
  gRNA
guacgauuucucucgagcca

SEQ ID NO: 7893 - RNA, 20 nt, Artificial Sequence
  MKO10007893_A_Camua1
  gRNA
uaguuccgcagaauacacuu

SEQ ID NO: 7894 - RNA, 20 nt, Artificial Sequence
  MKO10007894_A_Camua1
  gRNA
aacaccgugccaccuauaga

SEQ ID NO: 7895 - RNA, 20 nt, Artificial Sequence
  MKO10007895_A_Camua1
  gRNA
cuaccucauuaguguuccag

SEQ ID NO: 7896 - RNA, 20 nt, Artificial Sequence
  MKO10007896_A_Camua2
  gRNA
ucaccuucuuacgauuguag

SEQ ID NO: 7897 - RNA, 20 nt, Artificial Sequence
  MKO10007897_A_Camua2
  gRNA
ggaugggaagacuacccgag

SEQ ID NO: 7898 - RNA, 20 nt, Artificial Sequence
  MKO10007898_A_Camua2
  gRNA
ccacucaucguguuucucaa

SEQ ID NO: 7899 - RNA, 20 nt, Artificial Sequence
  MKO10007899_A_Cand1
  gRNA
uguccacgaucgucuccacu

SEQ ID NO: 7900 - RNA, 20 nt, Artificial Sequence
  MKO10007900_A_Cand1
  gRNA
uauuuccgcagcucauaacu

SEQ ID NO: 7901 - RNA, 20 nt, Artificial Sequence
  MKO10007901_A_Cand1
  gRNA
cugcgagacauuuccagcau

SEQ ID NO: 7902 - RNA, 20 nt, Artificial Sequence
  MKO10007902_A_Cand2
  gRNA
aagcgcacuguugucgcacu

SEQ ID NO: 7903 - RNA, 20 nt, Artificial Sequence
  MKO10007903_A_Cand2
  gRNA
ggucagcaagcuccacgaag

SEQ ID NO: 7904 - RNA, 20 nt, Artificial Sequence
  MKO10007904_A_Cand2
  gRNA
cuccuugucugaccgcaugu

SEQ ID NO: 7905 - RNA, 20 nt, Artificial Sequence
  MKO10007905_A_Cant1
  gRNA
ccacgaacgcuacagcgaga

SEQ ID NO: 7906 - RNA, 20 nt, Artificial Sequence
  MKO10007906_A_Cant1
  gRNA
ccuucucgcuguagcguucg

SEQ ID NO: 7907 - RNA, 20 nt, Artificial Sequence
  MKO10007907_A_Cant1
  gRNA
cuuaccugguggucggaucc

SEQ ID NO: 7908 - RNA, 20 nt, Artificial Sequence
  MKO10007908_A_Canx
  gRNA
ggaacucucaccaucauauu

SEQ ID NO: 7909 - RNA, 20 nt, Artificial Sequence
  MKO10007909_A_Canx
  gRNA
caggcugagcucugccgucu

SEQ ID NO: 7910 - RNA, 20 nt, Artificial Sequence
  MKO10007910_A_Canx
  gRNA
acaaagcuuccaggggauaa

SEQ ID NO: 7911 - RNA, 20 nt, Artificial Sequence
  MKO10007911_A_Cap1
  gRNA
uuacacaaaucguguccuca

SEQ ID NO: 7912 - RNA, 20 nt, Artificial Sequence
  MKO10007912_A_Cap1
  gRNA
ccucuacaggcugcgaaacc

SEQ ID NO: 7913 - RNA, 20 nt, Artificial Sequence
  MKO10007913_A_Cap1
  gRNA
caggcggagaugguccacac

SEQ ID NO: 7914 - RNA, 20 nt, Artificial Sequence
  MKO10007914_A_Cap2
  gRNA
cagugaaagcaucgccgccc

SEQ ID NO: 7915 - RNA, 20 nt, Artificial Sequence
  MKO10007915_A_Cap2
  gRNA
cacagguguggcaccguccg

SEQ ID NO: 7916 - RNA, 20 nt, Artificial Sequence
  MKO10007916_A_Cap2
  gRNA
uucuugaaucuucuccgaua

SEQ ID NO: 7917 - RNA, 20 nt, Artificial Sequence
  MKO10007917_A_Capg
  gRNA
ugcgucucacccgguacuug

SEQ ID NO: 7918 - RNA, 20 nt, Artificial Sequence
  MKO10007918_A_Capg
  gRNA
agaacauccgugcgaccgag

SEQ ID NO: 7919 - RNA, 20 nt, Artificial Sequence
  MKO10007919_A_Capg
  gRNA
caacauccuugagcgcaaca

SEQ ID NO: 7920 - RNA, 20 nt, Artificial Sequence
  MKO10007920_A_Capn10
  gRNA
ugcugcggauucacaacccc

SEQ ID NO: 7921 - RNA, 20 nt, Artificial Sequence
  MKO10007921_A_Capn10
  gRNA
ucggcagcuacuccaccuga

SEQ ID NO: 7922 - RNA, 20 nt, Artificial Sequence
  MKO10007922_A_Capn10
  gRNA
uccaaacugccaaauccgac

SEQ ID NO: 7923 - RNA, 20 nt, Artificial Sequence
  MKO10007923_A_Capn11
  gRNA
gcacugguugaacguggucg

SEQ ID NO: 7924 - RNA, 20 nt, Artificial Sequence
  MKO10007924_A_Capn11
  gRNA
cgugcacgccucccaucgcc

SEQ ID NO: 7925 - RNA, 20 nt, Artificial Sequence
  MKO10007925_A_Capn11
  gRNA
guucuugacaccgauagacc

SEQ ID NO: 7926 - RNA, 20 nt, Artificial Sequence
  MKO10007926_A_Capn12
  gRNA
accuccucgcauuaccucgu

SEQ ID NO: 7927 - RNA, 20 nt, Artificial Sequence
  MKO10007927_A_Capn12
  gRNA
ccuuggccaaugcguggcga

SEQ ID NO: 7928 - RNA, 20 nt, Artificial Sequence
  MKO10007928_A_Capn12
  gRNA
cuuguccaggggggaccacc

SEQ ID NO: 7929 - RNA, 20 nt, Artificial Sequence
  MKO10007929_A_Capn13
  gRNA
gcgaauagcuuugguccauc

SEQ ID NO: 7930 - RNA, 20 nt, Artificial Sequence
  MKO10007930_A_Capn13
  gRNA
cggucuucacugucgucagu

SEQ ID NO: 7931 - RNA, 20 nt, Artificial Sequence
  MKO10007931_A_Capn13
  gRNA
agcuauucgcaccaguaugc

SEQ ID NO: 7932 - RNA, 20 nt, Artificial Sequence
  MKO10007932_A_Capn15
  gRNA
ggcugaacgucccgaccucg

SEQ ID NO: 7933 - RNA, 20 nt, Artificial Sequence
  MKO10007933_A_Capn15
  gRNA
cuucauguuaccucccccgc

SEQ ID NO: 7934 - RNA, 20 nt, Artificial Sequence
  MKO10007934_A_Capn15
  gRNA
cagcuccacuaacccccgag

SEQ ID NO: 7935 - RNA, 20 nt, Artificial Sequence
  MKO10007935_A_Capn1
  gRNA
cgcuccagaauucguugccc

SEQ ID NO: 7936 - RNA, 20 nt, Artificial Sequence
  MKO10007936_A_Capn1
  gRNA
ccuucgaggacuuuaccggu

SEQ ID NO: 7937 - RNA, 20 nt, Artificial Sequence
  MKO10007937_A_Capn1
  gRNA
gaacaccagcuucccguccu

SEQ ID NO: 7938 - RNA, 20 nt, Artificial Sequence
  MKO10007938_A_Capn2
  gRNA
gcugacccccaguucauuau

SEQ ID NO: 7939 - RNA, 20 nt, Artificial Sequence
  MKO10007939_A_Capn2
  gRNA
gagcagcuccccguccuuag

SEQ ID NO: 7940 - RNA, 20 nt, Artificial Sequence
  MKO10007940_A_Capn2
  gRNA
gaagucuucaaagccuuccg

SEQ ID NO: 7941 - RNA, 20 nt, Artificial Sequence
  MKO10007941_A_Capn3
  gRNA
aguuucacugaaaacuacgc

SEQ ID NO: 7942 - RNA, 20 nt, Artificial Sequence
  MKO10007942_A_Capn3
  gRNA
uucuugcaguucuggcgcua

SEQ ID NO: 7943 - RNA, 20 nt, Artificial Sequence
  MKO10007943_A_Capn3
  gRNA
uuaucauugguggagccaac

SEQ ID NO: 7944 - RNA, 20 nt, Artificial Sequence
  MKO10007944_A_Capn5
  gRNA
uggacguaaucgucgaugac

SEQ ID NO: 7945 - RNA, 20 nt, Artificial Sequence
  MKO10007945_A_Capn5
  gRNA
cguccacucccgcucgcccc

SEQ ID NO: 7946 - RNA, 20 nt, Artificial Sequence
  MKO10007946_A_Capn5
  gRNA
caggcgcaccuugcgcacau

SEQ ID NO: 7947 - RNA, 20 nt, Artificial Sequence
  MKO10007947_A_Capn6
  gRNA
cuguacaaaacguucaccaa

SEQ ID NO: 7948 - RNA, 20 nt, Artificial Sequence
  MKO10007948_A_Capn6
  gRNA
gauauucgcaagcuccgucu

SEQ ID NO: 7949 - RNA, 20 nt, Artificial Sequence
  MKO10007949_A_Capn6
  gRNA
gcagcaaauuagaccuccuu

SEQ ID NO: 7950 - RNA, 20 nt, Artificial Sequence
  MKO10007950_A_Capn7
  gRNA
ccuugcgcaucacaugacug

SEQ ID NO: 7951 - RNA, 20 nt, Artificial Sequence
  MKO10007951_A_Capn7
  gRNA
gcugacuugaguuugcaaaa

SEQ ID NO: 7952 - RNA, 20 nt, Artificial Sequence
  MKO10007952_A_Capn7
  gRNA
agagaagaucaaugaguauc

SEQ ID NO: 7953 - RNA, 20 nt, Artificial Sequence
  MKO10007953_A_Capn8
  gRNA
uccaacccucaguuuaucgu

SEQ ID NO: 7954 - RNA, 20 nt, Artificial Sequence
  MKO10007954_A_Capn8
  gRNA
guccgucagcuuugggcuac

SEQ ID NO: 7955 - RNA, 20 nt, Artificial Sequence
  MKO10007955_A_Capn8
  gRNA
caucauauggaagcgaccca

SEQ ID NO: 7956 - RNA, 20 nt, Artificial Sequence
  MKO10007956_A_Capn9
  gRNA
uaggcuuaacgggaguuaug

SEQ ID NO: 7957 - RNA, 20 nt, Artificial Sequence
  MKO10007957_A_Capn9
  gRNA
ugagaacuuccaaauccgag

SEQ ID NO: 7958 - RNA, 20 nt, Artificial Sequence
  MKO10007958_A_Capn9
  gRNA
gccccuccaagaaugaauuc

SEQ ID NO: 7959 - RNA, 20 nt, Artificial Sequence
  MKO10007959_A_Capns1
  gRNA
gugaagaaguccgucaguuc

SEQ ID NO: 7960 - RNA, 20 nt, Artificial Sequence
  MKO10007960_A_Capns1
  gRNA
cauugacacuugucggagca

SEQ ID NO: 7961 - RNA, 20 nt, Artificial Sequence
  MKO10007961_A_Capns1
  gRNA
ggucugcuuaccggaggcuc

SEQ ID NO: 7962 - RNA, 20 nt, Artificial Sequence
  MKO10007962_A_Capns2
  gRNA
gaaucaggccaucccuaucu

SEQ ID NO: 7963 - RNA, 20 nt, Artificial Sequence
  MKO10007963_A_Capns2
  gRNA
caucuucgucagcauaccga

SEQ ID NO: 7964 - RNA, 20 nt, Artificial Sequence
  MKO10007964_A_Capns2
  gRNA
aagcucgaaacauagcaucc

SEQ ID NO: 7965 - RNA, 20 nt, Artificial Sequence
  MKO10007965_A_Caprin1
  gRNA
ggguaaacuugaugauuacc

SEQ ID NO: 7966 - RNA, 20 nt, Artificial Sequence
  MKO10007966_A_Caprin1
  gRNA
cugagcgugacaugaguuua

SEQ ID NO: 7967 - RNA, 20 nt, Artificial Sequence
  MKO10007967_A_Caprin1
  gRNA
ggaugccguaucuaaguacc

SEQ ID NO: 7968 - RNA, 20 nt, Artificial Sequence
  MKO10007968_A_Caprin2
  gRNA
caacuacuuaccaacugguc

SEQ ID NO: 7969 - RNA, 20 nt, Artificial Sequence
  MKO10007969_A_Caprin2
  gRNA
uauaaagaucgccuuaaaaa

SEQ ID NO: 7970 - RNA, 20 nt, Artificial Sequence
  MKO10007970_A_Caprin2
  gRNA
acaaggaugacugcuccauc

SEQ ID NO: 7971 - RNA, 20 nt, Artificial Sequence
  MKO10007971_A_Caps2
  gRNA
ucauuucacuugcguacugc

SEQ ID NO: 7972 - RNA, 20 nt, Artificial Sequence
  MKO10007972_A_Caps2
  gRNA
cagcgccaacaggcaaauac

SEQ ID NO: 7973 - RNA, 20 nt, Artificial Sequence
  MKO10007973_A_Caps2
  gRNA
uguagucgaugcugacuguu

SEQ ID NO: 7974 - RNA, 20 nt, Artificial Sequence
  MKO10007974_A_Capsl
  gRNA
ugccgucucuaucgaaucuc

SEQ ID NO: 7975 - RNA, 20 nt, Artificial Sequence
  MKO10007975_A_Capsl
  gRNA
ggauugccaucucccgguca

SEQ ID NO: 7976 - RNA, 20 nt, Artificial Sequence
  MKO10007976_A_Capsl
  gRNA
uccacuacaggugacccccg

SEQ ID NO: 7977 - RNA, 20 nt, Artificial Sequence
  MKO10007977_A_Capza1
  gRNA
cuuaacaguacagaagccgu

SEQ ID NO: 7978 - RNA, 20 nt, Artificial Sequence
  MKO10007978_A_Capza1
  gRNA
gaguuuaaugaaguauucaa

SEQ ID NO: 7979 - RNA, 20 nt, Artificial Sequence
  MKO10007979_A_Capza1
  gRNA
aaggucuuaauuacagagca

SEQ ID NO: 7980 - RNA, 20 nt, Artificial Sequence
  MKO10007980_A_Capza2
  gRNA
guaaaagagcauuauccgaa

SEQ ID NO: 7981 - RNA, 20 nt, Artificial Sequence
  MKO10007981_A_Capza2
  gRNA
uucaucauucacgccccucc

SEQ ID NO: 7982 - RNA, 20 nt, Artificial Sequence
  MKO10007982_A_Capza2
  gRNA
cucacagugcagaccccauu

SEQ ID NO: 7983 - RNA, 20 nt, Artificial Sequence
  MKO10007983_A_Capza3
  gRNA
uccgaaugauuccgugacuu

SEQ ID NO: 7984 - RNA, 20 nt, Artificial Sequence
  MKO10007984_A_Capza3
  gRNA
ugacacgcacuuugauugac

SEQ ID NO: 7985 - RNA, 20 nt, Artificial Sequence
  MKO10007985_A_Capza3
  gRNA
ggguugccgucgaugcagag

SEQ ID NO: 7986 - RNA, 20 nt, Artificial Sequence
  MKO10007986_A_Capzb
  gRNA
ccucagcgaucugaucgacc

SEQ ID NO: 7987 - RNA, 20 nt, Artificial Sequence
  MKO10007987_A_Capzb
  gRNA
ccaggucgaucagaucgcug

SEQ ID NO: 7988 - RNA, 20 nt, Artificial Sequence
  MKO10007988_A_Capzb
  gRNA
ucacucacaggucucgguau

SEQ ID NO: 7989 - RNA, 20 nt, Artificial Sequence
  MKO10007989_A_Car10
  gRNA
ugacauuuguguauagcucg

SEQ ID NO: 7990 - RNA, 20 nt, Artificial Sequence
  MKO10007990_A_Car10
  gRNA
cccccaguguugaugcgaag

SEQ ID NO: 7991 - RNA, 20 nt, Artificial Sequence
  MKO10007991_A_Car10
  gRNA
caugacauacagucaccgcc

SEQ ID NO: 7992 - RNA, 20 nt, Artificial Sequence
  MKO10007992_A_Car11
  gRNA
cggaccugcaccugaucccg

SEQ ID NO: 7993 - RNA, 20 nt, Artificial Sequence
  MKO10007993_A_Car11
  gRNA
agugaacugcgccugcuauu

SEQ ID NO: 7994 - RNA, 20 nt, Artificial Sequence
  MKO10007994_A_Car11
  gRNA
cuuguagcuccaccaguccu

SEQ ID NO: 7995 - RNA, 20 nt, Artificial Sequence
  MKO10007995_A_Car12
  gRNA
cuuaccaacauagguccacu

SEQ ID NO: 7996 - RNA, 20 nt, Artificial Sequence
  MKO10007996_A_Car12
  gRNA
uccaagaaguacccaucgug

SEQ ID NO: 7997 - RNA, 20 nt, Artificial Sequence
  MKO10007997_A_Car12
  gRNA
accgccagugacaaguccga

SEQ ID NO: 7998 - RNA, 20 nt, Artificial Sequence
  MKO10007998_A_Car13
  gRNA
agcucaugaguccgaugggc

SEQ ID NO: 7999 - RNA, 20 nt, Artificial Sequence
  MKO10007999_A_Car13
  gRNA
uuggauuuaguucugcgugg

SEQ ID NO: 8000 - RNA, 20 nt, Artificial Sequence
  MKO10008000_A_Car13
  gRNA
caacguugacuuugacgaca

SEQ ID NO: 8001 - RNA, 20 nt, Artificial Sequence
  MKO10008001_A_Car14
  gRNA
ggccaaugguccugaccgug

SEQ ID NO: 8002 - RNA, 20 nt, Artificial Sequence
  MKO10008002_A_Car14
  gRNA
ggucagagaggaucccucga

SEQ ID NO: 8003 - RNA, 20 nt, Artificial Sequence
  MKO10008003_A_Car14
  gRNA
ccccgguaccuccgcagccg

SEQ ID NO: 8004 - RNA, 20 nt, Artificial Sequence
  MKO10008004_A_Car15
  gRNA
gcuuaagaguguagucccgc

SEQ ID NO: 8005 - RNA, 20 nt, Artificial Sequence
  MKO10008005_A_Car15
  gRNA
gccaguauagcaaacccauc

SEQ ID NO: 8006 - RNA, 20 nt, Artificial Sequence
  MKO10008006_A_Car15
  gRNA
cuggagaacgauggccacac

SEQ ID NO: 8007 - RNA, 20 nt, Artificial Sequence
  MKO10008007_A_Car1
  gRNA
gagcaucaaguacuuucugc

SEQ ID NO: 8008 - RNA, 20 nt, Artificial Sequence
  MKO10008008_A_Car1
  gRNA
ugccaaagaaauuguuaacg

SEQ ID NO: 8009 - RNA, 20 nt, Artificial Sequence
  MKO10008009_A_Car1
  gRNA
gaugacaguagcaaccaauc

SEQ ID NO: 8010 - RNA, 20 nt, Artificial Sequence
  MKO10008010_A_Car2
  gRNA
gucaucaaacucaacguuaa

SEQ ID NO: 8011 - RNA, 20 nt, Artificial Sequence
  MKO10008011_A_Car2
  gRNA
aaagcugugcagcaaccgga

SEQ ID NO: 8012 - RNA, 20 nt, Artificial Sequence
  MKO10008012_A_Car2
  gRNA
cccaaaacagccaauccauc

SEQ ID NO: 8013 - RNA, 20 nt, Artificial Sequence
  MKO10008013_A_Car3
  gRNA
cggaguaaaauacgcugcug

SEQ ID NO: 8014 - RNA, 20 nt, Artificial Sequence
  MKO10008014_A_Car3
  gRNA
ccaaccacagcgaugccauc

SEQ ID NO: 8015 - RNA, 20 nt, Artificial Sequence
  MKO10008015_A_Car3
  gRNA
uaaaguucaugccagugauc

SEQ ID NO: 8016 - RNA, 20 nt, Artificial Sequence
  MKO10008016_A_Car4
  gRNA
agaccugcccgcccgguacg

SEQ ID NO: 8017 - RNA, 20 nt, Artificial Sequence
  MKO10008017_A_Car4
  gRNA
gcaacuguacagccucguac

SEQ ID NO: 8018 - RNA, 20 nt, Artificial Sequence
  MKO10008018_A_Car4
  gRNA
cugacacccuucauccucgu

SEQ ID NO: 8019 - RNA, 20 nt, Artificial Sequence
  MKO10008019_A_Car5a
  gRNA
caguguguaugacccgcagc

SEQ ID NO: 8020 - RNA, 20 nt, Artificial Sequence
  MKO10008020_A_Car5a
  gRNA
ucugcaggacgcggcaucau

SEQ ID NO: 8021 - RNA, 20 nt, Artificial Sequence
  MKO10008021_A_Car5a
  gRNA
uugcuugcagggaucagcgg

SEQ ID NO: 8022 - RNA, 20 nt, Artificial Sequence
  MKO10008022_A_Car5b
  gRNA
ggugauugucgaucacccgc

SEQ ID NO: 8023 - RNA, 20 nt, Artificial Sequence
  MKO10008023_A_Car5b
  gRNA
aaucacccaucaacauccga

SEQ ID NO: 8024 - RNA, 20 nt, Artificial Sequence
  MKO10008024_A_Car5b
  gRNA
uuugccaucaauuaagcaca

SEQ ID NO: 8025 - RNA, 20 nt, Artificial Sequence
  MKO10008025_A_Car6
  gRNA
cuccuccgucuucacgucga

SEQ ID NO: 8026 - RNA, 20 nt, Artificial Sequence
  MKO10008026_A_Car6
  gRNA
cgacugccuuuccccgccgc

SEQ ID NO: 8027 - RNA, 20 nt, Artificial Sequence
  MKO10008027_A_Car6
  gRNA
cgggaccuaugagaaugcca

SEQ ID NO: 8028 - RNA, 20 nt, Artificial Sequence
  MKO10008028_A_Car7
  gRNA
ccugacagacgcccucuaca

SEQ ID NO: 8029 - RNA, 20 nt, Artificial Sequence
  MKO10008029_A_Car7
  gRNA
ugucgcgcuucuugccccag

SEQ ID NO: 8030 - RNA, 20 nt, Artificial Sequence
  MKO10008030_A_Car7
  gRNA
caucaauaucauauccagcc

SEQ ID NO: 8031 - RNA, 20 nt, Artificial Sequence
  MKO10008031_A_Car8
  gRNA
ucccggcacaccacauaauu

SEQ ID NO: 8032 - RNA, 20 nt, Artificial Sequence
  MKO10008032_A_Car8
  gRNA
uugaaugguguguccaucgu

SEQ ID NO: 8033 - RNA, 20 nt, Artificial Sequence
  MKO10008033_A_Car8
  gRNA
acuguuuggcagcaucgaug

SEQ ID NO: 8034 - RNA, 20 nt, Artificial Sequence
  MKO10008034_A_Car9
  gRNA
uugcagagugcggcagaaug

SEQ ID NO: 8035 - RNA, 20 nt, Artificial Sequence
  MKO10008035_A_Car9
  gRNA
guccccgguagacauccgcc

SEQ ID NO: 8036 - RNA, 20 nt, Artificial Sequence
  MKO10008036_A_Car9
  gRNA
caguacugaggugcaccacg

SEQ ID NO: 8037 - RNA, 20 nt, Artificial Sequence
  MKO10008037_A_Card10
  gRNA
gcucaccgguacgguuagcg

SEQ ID NO: 8038 - RNA, 20 nt, Artificial Sequence
  MKO10008038_A_Card10
  gRNA
ccgugccgcgcuaaccguac

SEQ ID NO: 8039 - RNA, 20 nt, Artificial Sequence
  MKO10008039_A_Card10
  gRNA
cuacaugaucgccaugcgcc

SEQ ID NO: 8040 - RNA, 20 nt, Artificial Sequence
  MKO10008040_A_Card11
  gRNA
ucaucuuguaguaucgcucc

SEQ ID NO: 8041 - RNA, 20 nt, Artificial Sequence
  MKO10008041_A_Card11
  gRNA
cuacaaugacgagcucguca

SEQ ID NO: 8042 - RNA, 20 nt, Artificial Sequence
  MKO10008042_A_Card11
  gRNA
ccguccaagaucaaccgugc

SEQ ID NO: 8043 - RNA, 20 nt, Artificial Sequence
  MKO10008043_A_Card14
  gRNA
ugcugaccucacguuucaug

SEQ ID NO: 8044 - RNA, 20 nt, Artificial Sequence
  MKO10008044_A_Card14
  gRNA
ccgcuccaugaccuucagcc

SEQ ID NO: 8045 - RNA, 20 nt, Artificial Sequence
  MKO10008045_A_Card14
  gRNA
gggcccguaccucuuccuga

SEQ ID NO: 8046 - RNA, 20 nt, Artificial Sequence
  MKO10008046_A_Card6
  gRNA
agcuuucuagaucgccacga

SEQ ID NO: 8047 - RNA, 20 nt, Artificial Sequence
  MKO10008047_A_Card6
  gRNA
aagacagucucgacaucuuc

SEQ ID NO: 8048 - RNA, 20 nt, Artificial Sequence
  MKO10008048_A_Card6
  gRNA
ccauucgggugauacugcug

SEQ ID NO: 8049 - RNA, 20 nt, Artificial Sequence
  MKO10008049_A_Card9
  gRNA
ccuggcggagguccuuccgu

SEQ ID NO: 8050 - RNA, 20 nt, Artificial Sequence
  MKO10008050_A_Card9
  gRNA
acccacagguggaccggcuc

SEQ ID NO: 8051 - RNA, 20 nt, Artificial Sequence
  MKO10008051_A_Card9
  gRNA
cgcgucuucuccaugaucau

SEQ ID NO: 8052 - RNA, 20 nt, Artificial Sequence
  MKO10008052_A_Carf
  gRNA
ucaaaagcaucggaccugua

SEQ ID NO: 8053 - RNA, 20 nt, Artificial Sequence
  MKO10008053_A_Carf
  gRNA
aucccucgugcuacccaaaa

SEQ ID NO: 8054 - RNA, 20 nt, Artificial Sequence
  MKO10008054_A_Carf
  gRNA
auaugauucacucacaucac

SEQ ID NO: 8055 - RNA, 20 nt, Artificial Sequence
  MKO10008055_A_Carhsp1
  gRNA
caggacagugcgggcuucgc

SEQ ID NO: 8056 - RNA, 20 nt, Artificial Sequence
  MKO10008056_A_Carhsp1
  gRNA
uauuggauaccccucgcacc

SEQ ID NO: 8057 - RNA, 20 nt, Artificial Sequence
  MKO10008057_A_Carhsp1
  gRNA
uaacucacucagagaugugc

SEQ ID NO: 8058 - RNA, 20 nt, Artificial Sequence
  MKO10008058_A_Carkd
  gRNA
aucgaucuuaccucccccgc

SEQ ID NO: 8059 - RNA, 20 nt, Artificial Sequence
  MKO10008059_A_Carkd
  gRNA
ccauacagcacaugcgacaa

SEQ ID NO: 8060 - RNA, 20 nt, Artificial Sequence
  MKO10008060_A_Carkd
  gRNA
cgccaugggaguccgcugug

SEQ ID NO: 8061 - RNA, 20 nt, Artificial Sequence
  MKO10008061_A_Carm1
  gRNA
cguucgcgucgccgauagug

SEQ ID NO: 8062 - RNA, 20 nt, Artificial Sequence
  MKO10008062_A_Carm1
  gRNA
cucacuaucggcgacgcgaa

SEQ ID NO: 8063 - RNA, 20 nt, Artificial Sequence
  MKO10008063_A_Carm1
  gRNA
cugcaggaucgcacgcuggu

SEQ ID NO: 8064 - RNA, 20 nt, Artificial Sequence
  MKO10008064_A_Carns1
  gRNA
accguaguaguacacagucc

SEQ ID NO: 8065 - RNA, 20 nt, Artificial Sequence
  MKO10008065_A_Carns1
  gRNA
cuggcgccaggauaucagcc

SEQ ID NO: 8066 - RNA, 20 nt, Artificial Sequence
  MKO10008066_A_Carns1
  gRNA
cagcugggacagcuccgaug

SEQ ID NO: 8067 - RNA, 20 nt, Artificial Sequence
  MKO10008067_A_Cars2
  gRNA
ggcgaugagcauuaccgacg

SEQ ID NO: 8068 - RNA, 20 nt, Artificial Sequence
  MKO10008068_A_Cars2
  gRNA
cuguagcugucgaguaugca

SEQ ID NO: 8069 - RNA, 20 nt, Artificial Sequence
  MKO10008069_A_Cars2
  gRNA
caugcauacucgacagcuac

SEQ ID NO: 8070 - RNA, 20 nt, Artificial Sequence
  MKO10008070_A_Cars
  gRNA
uucuuaccuuguuccgggug

SEQ ID NO: 8071 - RNA, 20 nt, Artificial Sequence
  MKO10008071_A_Cars
  gRNA
ugucuaugaugcgucucaca

SEQ ID NO: 8072 - RNA, 20 nt, Artificial Sequence
  MKO10008072_A_Cars
  gRNA
acaucuccuucgauauccug

SEQ ID NO: 8073 - RNA, 20 nt, Artificial Sequence
  MKO10008073_A_Cartpt
  gRNA
uucgaucugcaacauagcgc

SEQ ID NO: 8074 - RNA, 20 nt, Artificial Sequence
  MKO10008074_A_Cartpt
  gRNA
ccguacuucuucucguagau

SEQ ID NO: 8075 - RNA, 20 nt, Artificial Sequence
  MKO10008075_A_Cartpt
  gRNA
ggaugaugcgucccacgaga

SEQ ID NO: 8076 - RNA, 20 nt, Artificial Sequence
  MKO10008076_A_Casc1
  gRNA
ugaccaaagccgagcgacug

SEQ ID NO: 8077 - RNA, 20 nt, Artificial Sequence
  MKO10008077_A_Casc1
  gRNA
cugcaucagccgcagucgcu

SEQ ID NO: 8078 - RNA, 20 nt, Artificial Sequence
  MKO10008078_A_Casc1
  gRNA
uuaggcucccaaaucaaaaa

SEQ ID NO: 8079 - RNA, 20 nt, Artificial Sequence
  MKO10008079_A_Casc3
  gRNA
uucuuugagcacgaucuucg

SEQ ID NO: 8080 - RNA, 20 nt, Artificial Sequence
  MKO10008080_A_Casc3
  gRNA
ucaucgucauccaagugcuu

SEQ ID NO: 8081 - RNA, 20 nt, Artificial Sequence
  MKO10008081_A_Casc3
  gRNA
gucaccgugccuuuagacuc

SEQ ID NO: 8082 - RNA, 20 nt, Artificial Sequence
  MKO10008082_A_Casc4
  gRNA
gcgcuuggagaagcgcaauu

SEQ ID NO: 8083 - RNA, 20 nt, Artificial Sequence
  MKO10008083_A_Casc4
  gRNA
auuacggucgccucagcagc

SEQ ID NO: 8084 - RNA, 20 nt, Artificial Sequence
  MKO10008084_A_Casc4
  gRNA
cguauucuagccgcuugaca

SEQ ID NO: 8085 - RNA, 20 nt, Artificial Sequence
  MKO10008085_A_Casc5
  gRNA
ccucuucaggaccucaaaug

SEQ ID NO: 8086 - RNA, 20 nt, Artificial Sequence
  MKO10008086_A_Casc5
  gRNA
gaggaaugcugucuucuaac

SEQ ID NO: 8087 - RNA, 20 nt, Artificial Sequence
  MKO10008087_A_Casc5
  gRNA
uccugaagaggacuccuugg

SEQ ID NO: 8088 - RNA, 20 nt, Artificial Sequence
  MKO10008088_A_Casd1
  gRNA
ugugaauaccuucucucgag

SEQ ID NO: 8089 - RNA, 20 nt, Artificial Sequence
  MKO10008089_A_Casd1
  gRNA
gauaaacacauugcguuuau

SEQ ID NO: 8090 - RNA, 20 nt, Artificial Sequence
  MKO10008090_A_Casd1
  gRNA
gaaaucugccgcucgagaga

SEQ ID NO: 8091 - RNA, 20 nt, Artificial Sequence
  MKO10008091_A_Caskin1
  gRNA
ggccguugcacuacgccgcc

SEQ ID NO: 8092 - RNA, 20 nt, Artificial Sequence
  MKO10008092_A_Caskin1
  gRNA
cccuacgcggccgaacucac

SEQ ID NO: 8093 - RNA, 20 nt, Artificial Sequence
  MKO10008093_A_Caskin1
  gRNA
gccugugaguucggccgcgu

SEQ ID NO: 8094 - RNA, 20 nt, Artificial Sequence
  MKO10008094_A_Caskin2
  gRNA
aaugcccguacugcgcagcc

SEQ ID NO: 8095 - RNA, 20 nt, Artificial Sequence
  MKO10008095_A_Caskin2
  gRNA
cuugagccgcccaaauucac

SEQ ID NO: 8096 - RNA, 20 nt, Artificial Sequence
  MKO10008096_A_Caskin2
  gRNA
cgcugucaacgcugccucgc

SEQ ID NO: 8097 - RNA, 20 nt, Artificial Sequence
  MKO10008097_A_Cask
  gRNA
aucguaaagcgagcugaugc

SEQ ID NO: 8098 - RNA, 20 nt, Artificial Sequence
  MKO10008098_A_Cask
  gRNA
cucagaugggaugcuuuaca

SEQ ID NO: 8099 - RNA, 20 nt, Artificial Sequence
  MKO10008099_A_Cask
  gRNA
uauacagugaagcuguagcc

SEQ ID NO: 8100 - RNA, 20 nt, Artificial Sequence
  MKO10008100_A_Casp12
  gRNA
gauccaaucuacaagaucaa

SEQ ID NO: 8101 - RNA, 20 nt, Artificial Sequence
  MKO10008101_A_Casp12
  gRNA
gaaucacaucuaaugcugac

SEQ ID NO: 8102 - RNA, 20 nt, Artificial Sequence
  MKO10008102_A_Casp12
  gRNA
uggccacauugccaauuccc

SEQ ID NO: 8103 - RNA, 20 nt, Artificial Sequence
  MKO10008103_A_Casp14
  gRNA
gauguggaggguauccguau

SEQ ID NO: 8104 - RNA, 20 nt, Artificial Sequence
  MKO10008104_A_Casp14
  gRNA
ggguuccgagguagacaugg

SEQ ID NO: 8105 - RNA, 20 nt, Artificial Sequence
  MKO10008105_A_Casp14
  gRNA
uccuauagacaugacgagaa

SEQ ID NO: 8106 - RNA, 20 nt, Artificial Sequence
  MKO10008106_A_Casp1
  gRNA
cgagugguuguauucauuau

SEQ ID NO: 8107 - RNA, 20 nt, Artificial Sequence
  MKO10008107_A_Casp1
  gRNA
ggaauucuggagcuucaauc

SEQ ID NO: 8108 - RNA, 20 nt, Artificial Sequence
  MKO10008108_A_Casp1
  gRNA
acuugcaaacauuacugcua

SEQ ID NO: 8109 - RNA, 20 nt, Artificial Sequence
  MKO10008109_A_Casp2
  gRNA
aagcagcuccgccuauccac

SEQ ID NO: 8110 - RNA, 20 nt, Artificial Sequence
  MKO10008110_A_Casp2
  gRNA
uauucagcacguacucccac

SEQ ID NO: 8111 - RNA, 20 nt, Artificial Sequence
  MKO10008111_A_Casp2
  gRNA
ucaccagcugguagugugcc

SEQ ID NO: 8112 - RNA, 20 nt, Artificial Sequence
  MKO10008112_A_Casp3
  gRNA
caaggaaugucaucucgcuc

SEQ ID NO: 8113 - RNA, 20 nt, Artificial Sequence
  MKO10008113_A_Casp3
  gRNA
cacaguccagcuccguaccc

SEQ ID NO: 8114 - RNA, 20 nt, Artificial Sequence
  MKO10008114_A_Casp3
  gRNA
cacccaggccugccggggua

SEQ ID NO: 8115 - RNA, 20 nt, Artificial Sequence
  MKO10008115_A_Casp4
  gRNA
ggccaauggccguacacgaa

SEQ ID NO: 8116 - RNA, 20 nt, Artificial Sequence
  MKO10008116_A_Casp4
  gRNA
cugaacgcagugacaagcgu

SEQ ID NO: 8117 - RNA, 20 nt, Artificial Sequence
  MKO10008117_A_Casp4
  gRNA
uuggguuugucucguagacc

SEQ ID NO: 8118 - RNA, 20 nt, Artificial Sequence
  MKO10008118_A_Casp6
  gRNA
uagccagcaugacguacccg

SEQ ID NO: 8119 - RNA, 20 nt, Artificial Sequence
  MKO10008119_A_Casp6
  gRNA
gccagaguuaccugcgaguc

SEQ ID NO: 8120 - RNA, 20 nt, Artificial Sequence
  MKO10008120_A_Casp6
  gRNA
gucaugcuggcuaccccgac

SEQ ID NO: 8121 - RNA, 20 nt, Artificial Sequence
  MKO10008121_A_Casp7
  gRNA
cgccaucuuucccguaaauc

SEQ ID NO: 8122 - RNA, 20 nt, Artificial Sequence
  MKO10008122_A_Casp7
  gRNA
auuagcgucaaugucguuga

SEQ ID NO: 8123 - RNA, 20 nt, Artificial Sequence
  MKO10008123_A_Casp7
  gRNA
auaugcuuuaggcaugccga

SEQ ID NO: 8124 - RNA, 20 nt, Artificial Sequence
  MKO10008124_A_Casp8ap2
  gRNA
auuggacauauaugcugggu

SEQ ID NO: 8125 - RNA, 20 nt, Artificial Sequence
  MKO10008125_A_Casp8ap2
  gRNA
acuuaucaaaacugccagag

SEQ ID NO: 8126 - RNA, 20 nt, Artificial Sequence
  MKO10008126_A_Casp8ap2
  gRNA
uuucaguugcagauagaaua

SEQ ID NO: 8127 - RNA, 20 nt, Artificial Sequence
  MKO10008127_A_Casp8
  gRNA
ugagauccccaaauguaagc

SEQ ID NO: 8128 - RNA, 20 nt, Artificial Sequence
  MKO10008128_A_Casp8
  gRNA
aauccucgaucuuccccagc

SEQ ID NO: 8129 - RNA, 20 nt, Artificial Sequence
  MKO10008129_A_Casp8
  gRNA
cucagaagaagugagcgagu

SEQ ID NO: 8130 - RNA, 20 nt, Artificial Sequence
  MKO10008130_A_Casp9
  gRNA
aacuugagcaccgauuccgc

SEQ ID NO: 8131 - RNA, 20 nt, Artificial Sequence
  MKO10008131_A_Casp9
  gRNA
uguuaaaccccuagaccacc

SEQ ID NO: 8132 - RNA, 20 nt, Artificial Sequence
  MKO10008132_A_Casp9
  gRNA
cacacgcacgggcuccaacu

SEQ ID NO: 8133 - RNA, 20 nt, Artificial Sequence
  MKO10008133_A_Casq1
  gRNA
cucagauuacaaagccuacg

SEQ ID NO: 8134 - RNA, 20 nt, Artificial Sequence
  MKO10008134_A_Casq1
  gRNA
cucuucagcugcguccucgu

SEQ ID NO: 8135 - RNA, 20 nt, Artificial Sequence
  MKO10008135_A_Casq1
  gRNA
gacagcguuuauguguucaa

SEQ ID NO: 8136 - RNA, 20 nt, Artificial Sequence
  MKO10008136_A_Casq2
  gRNA
gaccgcacgauugaguuuga

SEQ ID NO: 8137 - RNA, 20 nt, Artificial Sequence
  MKO10008137_A_Casq2
  gRNA
ccccgucaaacucaaucgug

SEQ ID NO: 8138 - RNA, 20 nt, Artificial Sequence
  MKO10008138_A_Casq2
  gRNA
gguacuuaccgccuugucaa

SEQ ID NO: 8139 - RNA, 20 nt, Artificial Sequence
  MKO10008139_A_Casr
  gRNA
gacggcuaaguacacguugu

SEQ ID NO: 8140 - RNA, 20 nt, Artificial Sequence
  MKO10008140_A_Casr
  gRNA
caggucaccgcacucaucga

SEQ ID NO: 8141 - RNA, 20 nt, Artificial Sequence
  MKO10008141_A_Casr
  gRNA
uguccugacggcgaguacag

SEQ ID NO: 8142 - RNA, 20 nt, Artificial Sequence
  MKO10008142_A_Cass4
  gRNA
acagauaaucgguccgaguc

SEQ ID NO: 8143 - RNA, 20 nt, Artificial Sequence
  MKO10008143_A_Cass4
  gRNA
gucggcaacgaggcccucgu

SEQ ID NO: 8144 - RNA, 20 nt, Artificial Sequence
  MKO10008144_A_Cass4
  gRNA
guaaaccucuugacgucuuc

SEQ ID NO: 8145 - RNA, 20 nt, Artificial Sequence
  MKO10008145_A_Cast
  gRNA
cuacuuaccucacuugauug

SEQ ID NO: 8146 - RNA, 20 nt, Artificial Sequence
  MKO10008146_A_Cast
  gRNA
acucaugcugggggacuugc

SEQ ID NO: 8147 - RNA, 20 nt, Artificial Sequence
  MKO10008147_A_Cast
  gRNA
cagccuuccagaccacaugu

SEQ ID NO: 8148 - RNA, 20 nt, Artificial Sequence
  MKO10008148_A_Casz1
  gRNA
cgggcaauacgccccaacac

SEQ ID NO: 8149 - RNA, 20 nt, Artificial Sequence
  MKO10008149_A_Casz1
  gRNA
gccccgaacgucguacuuag

SEQ ID NO: 8150 - RNA, 20 nt, Artificial Sequence
  MKO10008150_A_Casz1
  gRNA
gccccucuaaguacgacguu

SEQ ID NO: 8151 - RNA, 20 nt, Artificial Sequence
  MKO10008151_A_Causper1
  gRNA
augagagcgaguuuaucuga

SEQ ID NO: 8152 - RNA, 20 nt, Artificial Sequence
  MKO10008152_A_Causper1
  gRNA
aguccucaagcuaauugccc

SEQ ID NO: 8153 - RNA, 20 nt, Artificial Sequence
  MKO10008153_A_Causper1
  gRNA
uucacugagcuagagauccg

SEQ ID NO: 8154 - RNA, 20 nt, Artificial Sequence
  MKO10008154_A_Causper2
  gRNA
gugaugugccccauucgccg

SEQ ID NO: 8155 - RNA, 20 nt, Artificial Sequence
  MKO10008155_A_Causper2
  gRNA
ugcugagcaggcuucgcgug

SEQ ID NO: 8156 - RNA, 20 nt, Artificial Sequence
  MKO10008156_A_Causper2
  gRNA
uuguagagauacuucuaaug

SEQ ID NO: 8157 - RNA, 20 nt, Artificial Sequence
  MKO10008157_A_Causper3
  gRNA
gagcccgacuugacucguac

SEQ ID NO: 8158 - RNA, 20 nt, Artificial Sequence
  MKO10008158_A_Causper3
  gRNA
cucuguccgucacgccaaau

SEQ ID NO: 8159 - RNA, 20 nt, Artificial Sequence
  MKO10008159_A_Causper3
  gRNA
cauguuuguguucgcgaucc

SEQ ID NO: 8160 - RNA, 20 nt, Artificial Sequence
  MKO10008160_A_Causper4
  gRNA
guugacgauccuuaucugcg

SEQ ID NO: 8161 - RNA, 20 nt, Artificial Sequence
  MKO10008161_A_Causper4
  gRNA
cuucgcaccaacucuuaucu

SEQ ID NO: 8162 - RNA, 20 nt, Artificial Sequence
  MKO10008162_A_Causper4
  gRNA
uugguuggcuuaacggcuuc

SEQ ID NO: 8163 - RNA, 20 nt, Artificial Sequence
  MKO10008163_A_Causperb
  gRNA
accucgaacaagauccaaua

SEQ ID NO: 8164 - RNA, 20 nt, Artificial Sequence
  MKO10008164_A_Causperb
  gRNA
accuuauuggaucuuguucg

SEQ ID NO: 8165 - RNA, 20 nt, Artificial Sequence
  MKO10008165_A_Causperb
  gRNA
aguucaguaaucgucuugag

SEQ ID NO: 8166 - RNA, 20 nt, Artificial Sequence
  MKO10008166_A_Causperd
  gRNA
cacaccuuccaauuuacgcc

SEQ ID NO: 8167 - RNA, 20 nt, Artificial Sequence
  MKO10008167_A_Causperd
  gRNA
aagugggcgcuugugauuga

SEQ ID NO: 8168 - RNA, 20 nt, Artificial Sequence
  MKO10008168_A_Causperd
  gRNA
uaccccuugaaguuguauau

SEQ ID NO: 8169 - RNA, 20 nt, Artificial Sequence
  MKO10008169_A_Causperg1
  gRNA
ggcccuucauacccaagaaa

SEQ ID NO: 8170 - RNA, 20 nt, Artificial Sequence
  MKO10008170_A_Causperg1
  gRNA
aaguugauuugcaaguagua

SEQ ID NO: 8171 - RNA, 20 nt, Artificial Sequence
  MKO10008171_A_Causperg1
  gRNA
ccuucagaauagugaggagc

SEQ ID NO: 8172 - RNA, 20 nt, Artificial Sequence
  MKO10008172_A_Causperg2
  gRNA
ccuucagaauaucgaggagc

SEQ ID NO: 8173 - RNA, 20 nt, Artificial Sequence
  MKO10008173_A_Causperg2
  gRNA
ggcccuucguauccaagaaa

SEQ ID NO: 8174 - RNA, 20 nt, Artificial Sequence
  MKO10008174_A_Causperg2
  gRNA
aggccaugugcguccugaac

SEQ ID NO: 8175 - RNA, 20 nt, Artificial Sequence
  MKO10008175_A_Cau
  gRNA
aauuucacugcaaacccccg

SEQ ID NO: 8176 - RNA, 20 nt, Artificial Sequence
  MKO10008176_A_Cau
  gRNA
acugacuguggagaaucgaa

SEQ ID NO: 8177 - RNA, 20 nt, Artificial Sequence
  MKO10008177_A_Cau
  gRNA
uaaacuuaauaucaugaccg

SEQ ID NO: 8178 - RNA, 20 nt, Artificial Sequence
  MKO10008178_A_Cav1
  gRNA
cacgucgucguugagaugcu

SEQ ID NO: 8179 - RNA, 20 nt, Artificial Sequence
  MKO10008179_A_Cav1
  gRNA
caagcaucucaacgacgacg

SEQ ID NO: 8180 - RNA, 20 nt, Artificial Sequence
  MKO10008180_A_Cav1
  gRNA
cacacaguuucgacggcauc

SEQ ID NO: 8181 - RNA, 20 nt, Artificial Sequence
  MKO10008181_A_Cav2
  gRNA
auguugacucgagucacgac

SEQ ID NO: 8182 - RNA, 20 nt, Artificial Sequence
  MKO10008182_A_Cav2
  gRNA
agugugacagacguugucau

SEQ ID NO: 8183 - RNA, 20 nt, Artificial Sequence
  MKO10008183_A_Cav2
  gRNA
cucgagucaacauacuucuc

SEQ ID NO: 8184 - RNA, 20 nt, Artificial Sequence
  MKO10008184_A_Cav3
  gRNA
caacccgcucuucgcugcgu

SEQ ID NO: 8185 - RNA, 20 nt, Artificial Sequence
  MKO10008185_A_Cav3
  gRNA
ccauacaccgucgaagcugu

SEQ ID NO: 8186 - RNA, 20 nt, Artificial Sequence
  MKO10008186_A_Cav3
  gRNA
ucuggaagcucggaucauca

SEQ ID NO: 8187 - RNA, 20 nt, Artificial Sequence
  MKO10008187_A_Cbfa2t2
  gRNA
gccccacuuacguuggaagg

SEQ ID NO: 8188 - RNA, 20 nt, Artificial Sequence
  MKO10008188_A_Cbfa2t2
  gRNA
cucacaugcuguaggaguaa

SEQ ID NO: 8189 - RNA, 20 nt, Artificial Sequence
  MKO10008189_A_Cbfa2t2
  gRNA
acuaacgaaucaacagcugc

SEQ ID NO: 8190 - RNA, 20 nt, Artificial Sequence
  MKO10008190_A_Cbfa2t3
  gRNA
gcgcgugcgcacacuggugc

SEQ ID NO: 8191 - RNA, 20 nt, Artificial Sequence
  MKO10008191_A_Cbfa2t3
  gRNA
agcugccgugccccgcacgc

SEQ ID NO: 8192 - RNA, 20 nt, Artificial Sequence
  MKO10008192_A_Cbfa2t3
  gRNA
aagucaacgagaacggcaaa

SEQ ID NO: 8193 - RNA, 20 nt, Artificial Sequence
  MKO10008193_A_Cbfb
  gRNA
cgaucuccgagcgaccgucg

SEQ ID NO: 8194 - RNA, 20 nt, Artificial Sequence
  MKO10008194_A_Cbfb
  gRNA
accgccucaccucgcacucg

SEQ ID NO: 8195 - RNA, 20 nt, Artificial Sequence
  MKO10008195_A_Cbfb
  gRNA
gaagaugccgcgcgucgucc

SEQ ID NO: 8196 - RNA, 20 nt, Artificial Sequence
  MKO10008196_A_Cblb
  gRNA
agaagucgaagcgagcgauc

SEQ ID NO: 8197 - RNA, 20 nt, Artificial Sequence
  MKO10008197_A_Cblb
  gRNA
cucaagugcugauacguauc

SEQ ID NO: 8198 - RNA, 20 nt, Artificial Sequence
  MKO10008198_A_Cblb
  gRNA
auuccguaaaauagagcccc

SEQ ID NO: 8199 - RNA, 20 nt, Artificial Sequence
  MKO10008199_A_Cblc
  gRNA
gcgagccacgcgcgcuuagc

SEQ ID NO: 8200 - RNA, 20 nt, Artificial Sequence
  MKO10008200_A_Cblc
  gRNA
ggccuuccucaccuacgaug

SEQ ID NO: 8201 - RNA, 20 nt, Artificial Sequence
  MKO10008201_A_Cblc
  gRNA
gcguguuuggaccucaucgu

SEQ ID NO: 8202 - RNA, 20 nt, Artificial Sequence
  MKO10008202_A_Cbll1
  gRNA
agccgaaucauggaucacac

SEQ ID NO: 8203 - RNA, 20 nt, Artificial Sequence
  MKO10008203_A_Cbll1
  gRNA
augcccgcaaaggccccgca

SEQ ID NO: 8204 - RNA, 20 nt, Artificial Sequence
  MKO10008204_A_Cbll1
  gRNA
aucaccuugcggggccuuug

SEQ ID NO: 8205 - RNA, 20 nt, Artificial Sequence
  MKO10008205_A_Cbln1
  gRNA
cggccucgcgugucacgucu

SEQ ID NO: 8206 - RNA, 20 nt, Artificial Sequence
  MKO10008206_A_Cbln1
  gRNA
acuuucaucgccccgcgcaa

SEQ ID NO: 8207 - RNA, 20 nt, Artificial Sequence
  MKO10008207_A_Cbln1
  gRNA
ugaccaagacgugacacgcg

SEQ ID NO: 8208 - RNA, 20 nt, Artificial Sequence
  MKO10008208_A_Cbln2
  gRNA
gugacggcgccaucccccga

SEQ ID NO: 8209 - RNA, 20 nt, Artificial Sequence
  MKO10008209_A_Cbln2
  gRNA
cgugucguucugagcccuua

SEQ ID NO: 8210 - RNA, 20 nt, Artificial Sequence
  MKO10008210_A_Cbln2
  gRNA
guucaucucaaacuagagag

SEQ ID NO: 8211 - RNA, 20 nt, Artificial Sequence
  MKO10008211_A_Cbln3
  gRNA
ccagaagauucccccgacgc

SEQ ID NO: 8212 - RNA, 20 nt, Artificial Sequence
  MKO10008212_A_Cbln3
  gRNA
cgcagggacacacggucccc

SEQ ID NO: 8213 - RNA, 20 nt, Artificial Sequence
  MKO10008213_A_Cbln3
  gRNA
cgagggcuuugaucggaccu

SEQ ID NO: 8214 - RNA, 20 nt, Artificial Sequence
  MKO10008214_A_Cbln4
  gRNA
ucaccaugggcuccgcgcgc

SEQ ID NO: 8215 - RNA, 20 nt, Artificial Sequence
  MKO10008215_A_Cbln4
  gRNA
ugacacggaaccgaucguuc

SEQ ID NO: 8216 - RNA, 20 nt, Artificial Sequence
  MKO10008216_A_Cbln4
  gRNA
aaaaauuacccacguuaacc

SEQ ID NO: 8217 - RNA, 20 nt, Artificial Sequence
  MKO10008217_A_Cbl
  gRNA
cucccaggacgauagucccg

SEQ ID NO: 8218 - RNA, 20 nt, Artificial Sequence
  MKO10008218_A_Cbl
  gRNA
aagcugaugcugccgaauuu

SEQ ID NO: 8219 - RNA, 20 nt, Artificial Sequence
  MKO10008219_A_Cbl
  gRNA
ucuccuuggaagaguccgcu

SEQ ID NO: 8220 - RNA, 20 nt, Artificial Sequence
  MKO10008220_A_Cbr1
  gRNA
uaggccaaccuucuuccgca

SEQ ID NO: 8221 - RNA, 20 nt, Artificial Sequence
  MKO10008221_A_Cbr1
  gRNA
gguuggccuaauagugcaua

SEQ ID NO: 8222 - RNA, 20 nt, Artificial Sequence
  MKO10008222_A_Cbr1
  gRNA
auacggaggccuggacgugc

SEQ ID NO: 8223 - RNA, 20 nt, Artificial Sequence
  MKO10008223_A_Cbr2
  gRNA
augauuaaccguggcgugcc

SEQ ID NO: 8224 - RNA, 20 nt, Artificial Sequence
  MKO10008224_A_Cbr2
  gRNA
cggaauagagcccgugugug

SEQ ID NO: 8225 - RNA, 20 nt, Artificial Sequence
  MKO10008225_A_Cbr2
  gRNA
caauggacccuggcacgcca

SEQ ID NO: 8226 - RNA, 20 nt, Artificial Sequence
  MKO10008226_A_Cbr3
  gRNA
guacgggggacuuaacgugc

SEQ ID NO: 8227 - RNA, 20 nt, Artificial Sequence
  MKO10008227_A_Cbr3
  gRNA
ccgaugugacacacuuaccg

SEQ ID NO: 8228 - RNA, 20 nt, Artificial Sequence
  MKO10008228_A_Cbr3
  gRNA
gacaccccguaagccgaguc

SEQ ID NO: 8229 - RNA, 20 nt, Artificial Sequence
  MKO10008229_A_Cbr4
  gRNA
uucacgcucgcuugcuaaag

SEQ ID NO: 8230 - RNA, 20 nt, Artificial Sequence
  MKO10008230_A_Cbr4
  gRNA
aaacccaacgaguccuccuu

SEQ ID NO: 8231 - RNA, 20 nt, Artificial Sequence
  MKO10008231_A_Cbr4
  gRNA
uaaaugcagccgguaucaac

SEQ ID NO: 8232 - RNA, 20 nt, Artificial Sequence
  MKO10008232_A_Cbs
  gRNA
cagcaucuucgaucauccga

SEQ ID NO: 8233 - RNA, 20 nt, Artificial Sequence
  MKO10008233_A_Cbs
  gRNA
ucgcugcauuaucgugaugc

SEQ ID NO: 8234 - RNA, 20 nt, Artificial Sequence
  MKO10008234_A_Cbs
  gRNA
ugacccuucagggaucgggc

SEQ ID NO: 8235 - RNA, 20 nt, Artificial Sequence
  MKO10008235_A_Cbwd1
  gRNA
ucagauucucuauagcucua

SEQ ID NO: 8236 - RNA, 20 nt, Artificial Sequence
  MKO10008236_A_Cbwd1
  gRNA
accaggaucugcuagcccag

SEQ ID NO: 8237 - RNA, 20 nt, Artificial Sequence
  MKO10008237_A_Cbwd1
  gRNA
gugcaguggcuucuauguuu

SEQ ID NO: 8238 - RNA, 20 nt, Artificial Sequence
  MKO10008238_A_Cbx1
  gRNA
guagcuccaauaauccgcuc

SEQ ID NO: 8239 - RNA, 20 nt, Artificial Sequence
  MKO10008239_A_Cbx1
  gRNA
uuacagucagaaaagccacg

SEQ ID NO: 8240 - RNA, 20 nt, Artificial Sequence
  MKO10008240_A_Cbx1
  gRNA
aaccugugggcacuugacau

SEQ ID NO: 8241 - RNA, 20 nt, Artificial Sequence
  MKO10008241_A_Cbx2
  gRNA
gcgguucauguaguguacga

SEQ ID NO: 8242 - RNA, 20 nt, Artificial Sequence
  MKO10008242_A_Cbx2
  gRNA
uuuaacggugucccgcuuga

SEQ ID NO: 8243 - RNA, 20 nt, Artificial Sequence
  MKO10008243_A_Cbx2
  gRNA
accagccgcgccacuugacc

SEQ ID NO: 8244 - RNA, 20 nt, Artificial Sequence
  MKO10008244_A_Cbx3
  gRNA
aacacagugcugauaauacu

SEQ ID NO: 8245 - RNA, 20 nt, Artificial Sequence
  MKO10008245_A_Cbx3
  gRNA
guauacaggcugacaaacca

SEQ ID NO: 8246 - RNA, 20 nt, Artificial Sequence
  MKO10008246_A_Cbx3
  gRNA
caacaggaaggacucggacg

SEQ ID NO: 8247 - RNA, 20 nt, Artificial Sequence
  MKO10008247_A_Cbx4
  gRNA
cgacgcuccaauguucugac

SEQ ID NO: 8248 - RNA, 20 nt, Artificial Sequence
  MKO10008248_A_Cbx4
  gRNA
cacggccccgagguagccuu

SEQ ID NO: 8249 - RNA, 20 nt, Artificial Sequence
  MKO10008249_A_Cbx4
  gRNA
agggcccaagcccaaaccgc

SEQ ID NO: 8250 - RNA, 20 nt, Artificial Sequence
  MKO10008250_A_Cbx5
  gRNA
uaagaacauuaagucaccgc

SEQ ID NO: 8251 - RNA, 20 nt, Artificial Sequence
  MKO10008251_A_Cbx5
  gRNA
guuggacaggcgcaugguua

SEQ ID NO: 8252 - RNA, 20 nt, Artificial Sequence
  MKO10008252_A_Cbx5
  gRNA
uuuaauaucaucagcgcugu

SEQ ID NO: 8253 - RNA, 20 nt, Artificial Sequence
  MKO10008253_A_Cbx6
  gRNA
cgugcgcaucaucaaccgua

SEQ ID NO: 8254 - RNA, 20 nt, Artificial Sequence
  MKO10008254_A_Cbx6
  gRNA
cccgcccgaaaguccccucg

SEQ ID NO: 8255 - RNA, 20 nt, Artificial Sequence
  MKO10008255_A_Cbx6
  gRNA
ucagggacgcaucgaguacc

SEQ ID NO: 8256 - RNA, 20 nt, Artificial Sequence
  MKO10008256_A_Cbx7
  gRNA
accucucuuccuauaccccg

SEQ ID NO: 8257 - RNA, 20 nt, Artificial Sequence
  MKO10008257_A_Cbx7
  gRNA
gccuauggagcaagcccccg

SEQ ID NO: 8258 - RNA, 20 nt, Artificial Sequence
  MKO10008258_A_Cbx7
  gRNA
cuuggacccucgccuuguca

SEQ ID NO: 8259 - RNA, 20 nt, Artificial Sequence
  MKO10008259_A_Cbx8
  gRNA
gcgcccccaugucccgauac

SEQ ID NO: 8260 - RNA, 20 nt, Artificial Sequence
  MKO10008260_A_Cbx8
  gRNA
cucuauggccccaaaaagcg

SEQ ID NO: 8261 - RNA, 20 nt, Artificial Sequence
  MKO10008261_A_Cbx8
  gRNA
gccugaacuaugucgaaccc

SEQ ID NO: 8262 - RNA, 20 nt, Artificial Sequence
  MKO10008262_A_Cby1
  gRNA
cacaguuagaucggucaacg

SEQ ID NO: 8263 - RNA, 20 nt, Artificial Sequence
  MKO10008263_A_Cby1
  gRNA
ccucuagacuccgugauuag

SEQ ID NO: 8264 - RNA, 20 nt, Artificial Sequence
  MKO10008264_A_Cby1
  gRNA
gaauguccacuuucagccgc

SEQ ID NO: 8265 - RNA, 20 nt, Artificial Sequence
  MKO10008265_A_Cc2d1a
  gRNA
ccaagaugcgacgcuaugac

SEQ ID NO: 8266 - RNA, 20 nt, Artificial Sequence
  MKO10008266_A_Cc2d1a
  gRNA
agacggccugaugauccccg

SEQ ID NO: 8267 - RNA, 20 nt, Artificial Sequence
  MKO10008267_A_Cc2d1a
  gRNA
gcucccguagcuuggucugc

SEQ ID NO: 8268 - RNA, 20 nt, Artificial Sequence
  MKO10008268_A_Cc2d1b
  gRNA
uuaggccucgcucacagcgc

SEQ ID NO: 8269 - RNA, 20 nt, Artificial Sequence
  MKO10008269_A_Cc2d1b
  gRNA
cugcggccucccgguaguua

SEQ ID NO: 8270 - RNA, 20 nt, Artificial Sequence
  MKO10008270_A_Cc2d1b
  gRNA
agcagacuguaugcgagaug

SEQ ID NO: 8271 - RNA, 20 nt, Artificial Sequence
  MKO10008271_A_Cc2d2a
  gRNA
acucacuccggggcccccgc

SEQ ID NO: 8272 - RNA, 20 nt, Artificial Sequence
  MKO10008272_A_Cc2d2a
  gRNA
aggcagaaagcgcauuguug

SEQ ID NO: 8273 - RNA, 20 nt, Artificial Sequence
  MKO10008273_A_Cc2d2a
  gRNA
caacaaugcgcuuucugccu

SEQ ID NO: 8274 - RNA, 20 nt, Artificial Sequence
  MKO10008274_A_Ccar1
  gRNA
ccgccgccaaugcagucugc

SEQ ID NO: 8275 - RNA, 20 nt, Artificial Sequence
  MKO10008275_A_Ccar1
  gRNA
agucgacaggcuaaggcuug

SEQ ID NO: 8276 - RNA, 20 nt, Artificial Sequence
  MKO10008276_A_Ccar1
  gRNA
cuuguauagugugcagcagc

SEQ ID NO: 8277 - RNA, 20 nt, Artificial Sequence
  MKO10008277_A_Ccar2
  gRNA
agcgccuccccuucugcacg

SEQ ID NO: 8278 - RNA, 20 nt, Artificial Sequence
  MKO10008278_A_Ccar2
  gRNA
gugaaggccgcauacaaccc

SEQ ID NO: 8279 - RNA, 20 nt, Artificial Sequence
  MKO10008279_A_Ccar2
  gRNA
aggcgcuggagacuucagua

SEQ ID NO: 8280 - RNA, 20 nt, Artificial Sequence
  MKO10008280_A_Ccbe1
  gRNA
ucgcccgaagacuucagaca

SEQ ID NO: 8281 - RNA, 20 nt, Artificial Sequence
  MKO10008281_A_Ccbe1
  gRNA
uccuacgcacccagacagua

SEQ ID NO: 8282 - RNA, 20 nt, Artificial Sequence
  MKO10008282_A_Ccbe1
  gRNA
gcgagcucaccacgugcuuc

SEQ ID NO: 8283 - RNA, 20 nt, Artificial Sequence
  MKO10008283_A_Ccbl1
  gRNA
guucacgacaucauacuccu

SEQ ID NO: 8284 - RNA, 20 nt, Artificial Sequence
  MKO10008284_A_Ccbl1
  gRNA
cacaccucgcaccaagaucc

SEQ ID NO: 8285 - RNA, 20 nt, Artificial Sequence
  MKO10008285_A_Ccbl1
  gRNA
cccgcagaguccugcuccua

SEQ ID NO: 8286 - RNA, 20 nt, Artificial Sequence
  MKO10008286_A_Ccbl2
  gRNA
ggcucgcucaccuugccgag

SEQ ID NO: 8287 - RNA, 20 nt, Artificial Sequence
  MKO10008287_A_Ccbl2
  gRNA
uuacgacuguuaugagccca

SEQ ID NO: 8288 - RNA, 20 nt, Artificial Sequence
  MKO10008288_A_Ccbl2
  gRNA
ggcucauaacagucguaaaa

SEQ ID NO: 8289 - RNA, 20 nt, Artificial Sequence
  MKO10008289_A_Ccdc101
  gRNA
cccacagcggccaagaucgc

SEQ ID NO: 8290 - RNA, 20 nt, Artificial Sequence
  MKO10008290_A_Ccdc101
  gRNA
caccagguuucccgauccag

SEQ ID NO: 8291 - RNA, 20 nt, Artificial Sequence
  MKO10008291_A_Ccdc101
  gRNA
cuaucuuauccagcgcuuug

SEQ ID NO: 8292 - RNA, 20 nt, Artificial Sequence
  MKO10008292_A_Ccdc102a
  gRNA
uggcauucugccgccgucug

SEQ ID NO: 8293 - RNA, 20 nt, Artificial Sequence
  MKO10008293_A_Ccdc102a
  gRNA
ucugggacucaucuagccgu

SEQ ID NO: 8294 - RNA, 20 nt, Artificial Sequence
  MKO10008294_A_Ccdc102a
  gRNA
gcugggcgcacgcucuagca

SEQ ID NO: 8295 - RNA, 20 nt, Artificial Sequence
  MKO10008295_A_Ccdc103
  gRNA
uggcauuggcugagcacgcg

SEQ ID NO: 8296 - RNA, 20 nt, Artificial Sequence
  MKO10008296_A_Ccdc103
  gRNA
uugcucaacugcccguaacu

SEQ ID NO: 8297 - RNA, 20 nt, Artificial Sequence
  MKO10008297_A_Ccdc103
  gRNA
aagugggccagagcgcuacc

SEQ ID NO: 8298 - RNA, 20 nt, Artificial Sequence
  MKO10008298_A_Ccdc104
  gRNA
gaugugcgcgucuucgccag

SEQ ID NO: 8299 - RNA, 20 nt, Artificial Sequence
  MKO10008299_A_Ccdc104
  gRNA
ucaagccauccgaauaaucc

SEQ ID NO: 8300 - RNA, 20 nt, Artificial Sequence
  MKO10008300_A_Ccdc104
  gRNA
agaagcgugcacguccccuc

SEQ ID NO: 8301 - RNA, 20 nt, Artificial Sequence
  MKO10008301_A_Ccdc105
  gRNA
gggugaugucuacccacgag

SEQ ID NO: 8302 - RNA, 20 nt, Artificial Sequence
  MKO10008302_A_Ccdc105
  gRNA
aucaagagauguacgucacg

SEQ ID NO: 8303 - RNA, 20 nt, Artificial Sequence
  MKO10008303_A_Ccdc105
  gRNA
acccccaacuccucgaacuc

SEQ ID NO: 8304 - RNA, 20 nt, Artificial Sequence
  MKO10008304_A_Ccdc106
  gRNA
agcggcgggaauacucuagc

SEQ ID NO: 8305 - RNA, 20 nt, Artificial Sequence
  MKO10008305_A_Ccdc106
  gRNA
aguacuagccggaagcgauu

SEQ ID NO: 8306 - RNA, 20 nt, Artificial Sequence
  MKO10008306_A_Ccdc106
  gRNA
uauaccgucugaguccgucu

SEQ ID NO: 8307 - RNA, 20 nt, Artificial Sequence
  MKO10008307_A_Ccdc107
  gRNA
uuugggcgcucuguacaccg

SEQ ID NO: 8308 - RNA, 20 nt, Artificial Sequence
  MKO10008308_A_Ccdc107
  gRNA
ggcucgcucgcgcugauccu

SEQ ID NO: 8309 - RNA, 20 nt, Artificial Sequence
  MKO10008309_A_Ccdc107
  gRNA
aagaagaaauccucgcaguc

SEQ ID NO: 8310 - RNA, 20 nt, Artificial Sequence
  MKO10008310_A_Ccdc108
  gRNA
uggcuccaguaaccccguag

SEQ ID NO: 8311 - RNA, 20 nt, Artificial Sequence
  MKO10008311_A_Ccdc108
  gRNA
gcugaccuuaccgcuucuag

SEQ ID NO: 8312 - RNA, 20 nt, Artificial Sequence
  MKO10008312_A_Ccdc108
  gRNA
ggaagugugagcguuaugcc

SEQ ID NO: 8313 - RNA, 20 nt, Artificial Sequence
  MKO10008313_A_Ccdc109b
  gRNA
aagccgauguugucgacagu

SEQ ID NO: 8314 - RNA, 20 nt, Artificial Sequence
  MKO10008314_A_Ccdc109b
  gRNA
auacacaccugccgugauga

SEQ ID NO: 8315 - RNA, 20 nt, Artificial Sequence
  MKO10008315_A_Ccdc109b
  gRNA
gagacgagagcgccaucuga

SEQ ID NO: 8316 - RNA, 20 nt, Artificial Sequence
  MKO10008316_A_Ccdc110
  gRNA
gacucuacagaacgucagca

SEQ ID NO: 8317 - RNA, 20 nt, Artificial Sequence
  MKO10008317_A_Ccdc110
  gRNA
caacuucaucuucuuccgcg

SEQ ID NO: 8318 - RNA, 20 nt, Artificial Sequence
  MKO10008318_A_Ccdc110
  gRNA
gaaagcgggggcaaugaacc

SEQ ID NO: 8319 - RNA, 20 nt, Artificial Sequence
  MKO10008319_A_Ccdc112
  gRNA
gauggcggcuguagugcuuc

SEQ ID NO: 8320 - RNA, 20 nt, Artificial Sequence
  MKO10008320_A_Ccdc112
  gRNA
caguucugaagucgccucuu

SEQ ID NO: 8321 - RNA, 20 nt, Artificial Sequence
  MKO10008321_A_Ccdc112
  gRNA
gcucugcuuacaaucaggug

SEQ ID NO: 8322 - RNA, 20 nt, Artificial Sequence
  MKO10008322_A_Ccdc113
  gRNA
gccgacgcaggcuaucaucg

SEQ ID NO: 8323 - RNA, 20 nt, Artificial Sequence
  MKO10008323_A_Ccdc113
  gRNA
uuggguuacaguuacgaucc

SEQ ID NO: 8324 - RNA, 20 nt, Artificial Sequence
  MKO10008324_A_Ccdc113
  gRNA
acaugcgggcuaaugcggaa

SEQ ID NO: 8325 - RNA, 20 nt, Artificial Sequence
  MKO10008325_A_Ccdc114
  gRNA
gcgcuacguuaaucugcguc

SEQ ID NO: 8326 - RNA, 20 nt, Artificial Sequence
  MKO10008326_A_Ccdc114
  gRNA
uggagcugcugcgcaucgag

SEQ ID NO: 8327 - RNA, 20 nt, Artificial Sequence
  MKO10008327_A_Ccdc114
  gRNA
gauuaacguagcgcagagcc

SEQ ID NO: 8328 - RNA, 20 nt, Artificial Sequence
  MKO10008328_A_Ccdc115
  gRNA
ggagacuuacaugcuucgcu

SEQ ID NO: 8329 - RNA, 20 nt, Artificial Sequence
  MKO10008329_A_Ccdc115
  gRNA
agcugacgcccagacccccg

SEQ ID NO: 8330 - RNA, 20 nt, Artificial Sequence
  MKO10008330_A_Ccdc115
  gRNA
uucagcucugcgcaggcgca

SEQ ID NO: 8331 - RNA, 20 nt, Artificial Sequence
  MKO10008331_A_Ccdc116
  gRNA
cgagaucgaugccuacuacu

SEQ ID NO: 8332 - RNA, 20 nt, Artificial Sequence
  MKO10008332_A_Ccdc116
  gRNA
gcgaggugccgccaccacuc

SEQ ID NO: 8333 - RNA, 20 nt, Artificial Sequence
  MKO10008333_A_Ccdc116
  gRNA
gguggauauucaagaccccg

SEQ ID NO: 8334 - RNA, 20 nt, Artificial Sequence
  MKO10008334_A_Ccdc117
  gRNA
cgcgccgcuuuaccguaguc

SEQ ID NO: 8335 - RNA, 20 nt, Artificial Sequence
  MKO10008335_A_Ccdc117
  gRNA
cacagugugaagucgcccga

SEQ ID NO: 8336 - RNA, 20 nt, Artificial Sequence
  MKO10008336_A_Ccdc117
  gRNA
agcggcgcgucugcgcacug

SEQ ID NO: 8337 - RNA, 20 nt, Artificial Sequence
  MKO10008337_A_Ccdc11
  gRNA
agcaccuguuugcgaggcuu

SEQ ID NO: 8338 - RNA, 20 nt, Artificial Sequence
  MKO10008338_A_Ccdc11
  gRNA
cccuuucagggaacgcugug

SEQ ID NO: 8339 - RNA, 20 nt, Artificial Sequence
  MKO10008339_A_Ccdc11
  gRNA
ccuucaagacuuacaagaug

SEQ ID NO: 8340 - RNA, 20 nt, Artificial Sequence
  MKO10008340_A_Ccdc120
  gRNA
ggccuccggcggaccaacug

SEQ ID NO: 8341 - RNA, 20 nt, Artificial Sequence
  MKO10008341_A_Ccdc120
  gRNA
ccgccagcgagccuugcaag

SEQ ID NO: 8342 - RNA, 20 nt, Artificial Sequence
  MKO10008342_A_Ccdc120
  gRNA
uacagguugaugcacuucga

SEQ ID NO: 8343 - RNA, 20 nt, Artificial Sequence
  MKO10008343_A_Ccdc121
  gRNA
gaacgcgagcgccaucaucg

SEQ ID NO: 8344 - RNA, 20 nt, Artificial Sequence
  MKO10008344_A_Ccdc121
  gRNA
guacuuccucguaagccccg

SEQ ID NO: 8345 - RNA, 20 nt, Artificial Sequence
  MKO10008345_A_Ccdc121
  gRNA
cauccaaccugccguacucc

SEQ ID NO: 8346 - RNA, 20 nt, Artificial Sequence
  MKO10008346_A_Ccdc122
  gRNA
aggccugcucuguauuucac

SEQ ID NO: 8347 - RNA, 20 nt, Artificial Sequence
  MKO10008347_A_Ccdc122
  gRNA
cugcagcugaguuaaaaaag

SEQ ID NO: 8348 - RNA, 20 nt, Artificial Sequence
  MKO10008348_A_Ccdc122
  gRNA
aaaaccuccaagauucacaa

SEQ ID NO: 8349 - RNA, 20 nt, Artificial Sequence
  MKO10008349_A_Ccdc124
  gRNA
gccgcucgcauccggcgcuc

SEQ ID NO: 8350 - RNA, 20 nt, Artificial Sequence
  MKO10008350_A_Ccdc124
  gRNA
gaaccuuaaccggcgccugc

SEQ ID NO: 8351 - RNA, 20 nt, Artificial Sequence
  MKO10008351_A_Ccdc124
  gRNA
cccacguguggcgcccgcca

SEQ ID NO: 8352 - RNA, 20 nt, Artificial Sequence
  MKO10008352_A_Ccdc125
  gRNA
acgucuucaugaagccuuag

SEQ ID NO: 8353 - RNA, 20 nt, Artificial Sequence
  MKO10008353_A_Ccdc125
  gRNA
ggcuaaugagcaaagugccg

SEQ ID NO: 8354 - RNA, 20 nt, Artificial Sequence
  MKO10008354_A_Ccdc125
  gRNA
guucgauuacaucuaagaaa

SEQ ID NO: 8355 - RNA, 20 nt, Artificial Sequence
  MKO10008355_A_Ccdc126
  gRNA
acauguuccguacaaucuca

SEQ ID NO: 8356 - RNA, 20 nt, Artificial Sequence
  MKO10008356_A_Ccdc126
  gRNA
uugacgcugcucugccgccg

SEQ ID NO: 8357 - RNA, 20 nt, Artificial Sequence
  MKO10008357_A_Ccdc126
  gRNA
uaccggcaccaaauucccau

SEQ ID NO: 8358 - RNA, 20 nt, Artificial Sequence
  MKO10008358_A_Ccdc127
  gRNA
acuuacgccccugcgagaug

SEQ ID NO: 8359 - RNA, 20 nt, Artificial Sequence
  MKO10008359_A_Ccdc127
  gRNA
ucgagaagcccucaucucgc

SEQ ID NO: 8360 - RNA, 20 nt, Artificial Sequence
  MKO10008360_A_Ccdc127
  gRNA
acuuaaacgaccccccaaau

SEQ ID NO: 8361 - RNA, 20 nt, Artificial Sequence
  MKO10008361_A_Ccdc129
  gRNA
gcagcuucuuugcacgaaca

SEQ ID NO: 8362 - RNA, 20 nt, Artificial Sequence
  MKO10008362_A_Ccdc129
  gRNA
cagcaaaccaucaaccauac

SEQ ID NO: 8363 - RNA, 20 nt, Artificial Sequence
  MKO10008363_A_Ccdc129
  gRNA
cgaguugaaacuagucccuc

SEQ ID NO: 8364 - RNA, 20 nt, Artificial Sequence
  MKO10008364_A_Ccdc12
  gRNA
ucauguaccugccacugguu

SEQ ID NO: 8365 - RNA, 20 nt, Artificial Sequence
  MKO10008365_A_Ccdc12
  gRNA
ucccuaggaccuggccaacc

SEQ ID NO: 8366 - RNA, 20 nt, Artificial Sequence
  MKO10008366_A_Ccdc12
  gRNA
cucaccacuuccucaaugac

SEQ ID NO: 8367 - RNA, 20 nt, Artificial Sequence
  MKO10008367_A_Ccdc130
  gRNA
uuccgagcccguucucgaag

SEQ ID NO: 8368 - RNA, 20 nt, Artificial Sequence
  MKO10008368_A_Ccdc130
  gRNA
uaguuucuuaccggauaaca

SEQ ID NO: 8369 - RNA, 20 nt, Artificial Sequence
  MKO10008369_A_Ccdc130
  gRNA
cacgcucacccaugccgaug

SEQ ID NO: 8370 - RNA, 20 nt, Artificial Sequence
  MKO10008370_A_Ccdc132
  gRNA
auaccuuuccagggacccga

SEQ ID NO: 8371 - RNA, 20 nt, Artificial Sequence
  MKO10008371_A_Ccdc132
  gRNA
aacucuugcagauugagaac

SEQ ID NO: 8372 - RNA, 20 nt, Artificial Sequence
  MKO10008372_A_Ccdc132
  gRNA
aucaacucuugcucagcuug

SEQ ID NO: 8373 - RNA, 20 nt, Artificial Sequence
  MKO10008373_A_Ccdc134
  gRNA
cucgccagcuuucucgcacg

SEQ ID NO: 8374 - RNA, 20 nt, Artificial Sequence
  MKO10008374_A_Ccdc134
  gRNA
cagcacgacgucaccaaaaa

SEQ ID NO: 8375 - RNA, 20 nt, Artificial Sequence
  MKO10008375_A_Ccdc134
  gRNA
cggcccgucuggaagcacau

SEQ ID NO: 8376 - RNA, 20 nt, Artificial Sequence
  MKO10008376_A_Ccdc135
  gRNA
uaugaugccuacugcgucaa

SEQ ID NO: 8377 - RNA, 20 nt, Artificial Sequence
  MKO10008377_A_Ccdc135
  gRNA
ggucgaggaauauaagugcg

SEQ ID NO: 8378 - RNA, 20 nt, Artificial Sequence
  MKO10008378_A_Ccdc135
  gRNA
caggucccggggcggcuuga

SEQ ID NO: 8379 - RNA, 20 nt, Artificial Sequence
  MKO10008379_A_Ccdc136
  gRNA
aguuguagcgcucccgaaga

SEQ ID NO: 8380 - RNA, 20 nt, Artificial Sequence
  MKO10008380_A_Ccdc136
  gRNA
ugccucgcuccgggcagaaa

SEQ ID NO: 8381 - RNA, 20 nt, Artificial Sequence
  MKO10008381_A_Ccdc136
  gRNA
gagugacauagcguccuugc

SEQ ID NO: 8382 - RNA, 20 nt, Artificial Sequence
  MKO10008382_A_Ccdc137
  gRNA
uguggccuacguccagcgca

SEQ ID NO: 8383 - RNA, 20 nt, Artificial Sequence
  MKO10008383_A_Ccdc137
  gRNA
cagguuccagaagcgacgac

SEQ ID NO: 8384 - RNA, 20 nt, Artificial Sequence
  MKO10008384_A_Ccdc137
  gRNA
auaauuucucggagccgaaa

SEQ ID NO: 8385 - RNA, 20 nt, Artificial Sequence
  MKO10008385_A_Ccdc138
  gRNA
ucaccaagauauuacucuga

SEQ ID NO: 8386 - RNA, 20 nt, Artificial Sequence
  MKO10008386_A_Ccdc138
  gRNA
gguuuagauacuuacagcuc

SEQ ID NO: 8387 - RNA, 20 nt, Artificial Sequence
  MKO10008387_A_Ccdc138
  gRNA
uuaaagccuagaugaugaac

SEQ ID NO: 8388 - RNA, 20 nt, Artificial Sequence
  MKO10008388_A_Ccdc13
  gRNA
gcgacuauauaagcugcuga

SEQ ID NO: 8389 - RNA, 20 nt, Artificial Sequence
  MKO10008389_A_Ccdc13
  gRNA
ggccgagucagagagcgcaa

SEQ ID NO: 8390 - RNA, 20 nt, Artificial Sequence
  MKO10008390_A_Ccdc13
  gRNA
gcagcugaccaaucgcaucc

SEQ ID NO: 8391 - RNA, 20 nt, Artificial Sequence
  MKO10008391_A_Ccdc141
  gRNA
cagcccaaucuccucgaaau

SEQ ID NO: 8392 - RNA, 20 nt, Artificial Sequence
  MKO10008392_A_Ccdc141
  gRNA
cuugacugcucccaauuucg

SEQ ID NO: 8393 - RNA, 20 nt, Artificial Sequence
  MKO10008393_A_Ccdc141
  gRNA
ugacgccauggcccagacgc

SEQ ID NO: 8394 - RNA, 20 nt, Artificial Sequence
  MKO10008394_A_Ccdc142
  gRNA
agguccuacgccugucgcuc

SEQ ID NO: 8395 - RNA, 20 nt, Artificial Sequence
  MKO10008395_A_Ccdc142
  gRNA
cuuaggcuguguccgccugc

SEQ ID NO: 8396 - RNA, 20 nt, Artificial Sequence
  MKO10008396_A_Ccdc142
  gRNA
uggauagccuucgacagccc

SEQ ID NO: 8397 - RNA, 20 nt, Artificial Sequence
  MKO10008397_A_Ccdc144b
  gRNA
cccgcaucuucuccgugcac

SEQ ID NO: 8398 - RNA, 20 nt, Artificial Sequence
  MKO10008398_A_Ccdc144b
  gRNA
gcacgugaacaacuccaaca

SEQ ID NO: 8399 - RNA, 20 nt, Artificial Sequence
  MKO10008399_A_Ccdc144b
  gRNA
aaaaacuugaaauucguguu

SEQ ID NO: 8400 - RNA, 20 nt, Artificial Sequence
  MKO10008400_A_Ccdc146
  gRNA
gcgcugccguguauucauuu

SEQ ID NO: 8401 - RNA, 20 nt, Artificial Sequence
  MKO10008401_A_Ccdc146
  gRNA
ggagaacgccaagcgcuuca

SEQ ID NO: 8402 - RNA, 20 nt, Artificial Sequence
  MKO10008402_A_Ccdc146
  gRNA
caccuugcuacacgauacag

SEQ ID NO: 8403 - RNA, 20 nt, Artificial Sequence
  MKO10008403_A_Ccdc147
  gRNA
gccugccguccauguccguc

SEQ ID NO: 8404 - RNA, 20 nt, Artificial Sequence
  MKO10008404_A_Ccdc147
  gRNA
gaccuucuuaagggaugcga

SEQ ID NO: 8405 - RNA, 20 nt, Artificial Sequence
  MKO10008405_A_Ccdc147
  gRNA
cgagaaugagaagcgucuca

SEQ ID NO: 8406 - RNA, 20 nt, Artificial Sequence
  MKO10008406_A_Ccdc148
  gRNA
ugcaauuagaagacauacgc

SEQ ID NO: 8407 - RNA, 20 nt, Artificial Sequence
  MKO10008407_A_Ccdc148
  gRNA
gacgauuucagaucugggua

SEQ ID NO: 8408 - RNA, 20 nt, Artificial Sequence
  MKO10008408_A_Ccdc148
  gRNA
caguugcgucugagcccuca

SEQ ID NO: 8409 - RNA, 20 nt, Artificial Sequence
  MKO10008409_A_Ccdc149
  gRNA
caaccaagucuucccgcucg

SEQ ID NO: 8410 - RNA, 20 nt, Artificial Sequence
  MKO10008410_A_Ccdc149
  gRNA
ggaugacgauugccaaacaa

SEQ ID NO: 8411 - RNA, 20 nt, Artificial Sequence
  MKO10008411_A_Ccdc149
  gRNA
acaguaccuuauugucaccc

SEQ ID NO: 8412 - RNA, 20 nt, Artificial Sequence
  MKO10008412_A_Ccdc14
  gRNA
cuuucugaaucagauugaac

SEQ ID NO: 8413 - RNA, 20 nt, Artificial Sequence
  MKO10008413_A_Ccdc14
  gRNA
aagcacaaccgucaaguccc

SEQ ID NO: 8414 - RNA, 20 nt, Artificial Sequence
  MKO10008414_A_Ccdc14
  gRNA
ccuggagcuaaguuaccaaa

SEQ ID NO: 8415 - RNA, 20 nt, Artificial Sequence
  MKO10008415_A_Ccdc150
  gRNA
caccguauccuagcauuauu

SEQ ID NO: 8416 - RNA, 20 nt, Artificial Sequence
  MKO10008416_A_Ccdc150
  gRNA
accacgaaccuuugucuccg

SEQ ID NO: 8417 - RNA, 20 nt, Artificial Sequence
  MKO10008417_A_Ccdc150
  gRNA
ccuugacaacuuucaauugc

SEQ ID NO: 8418 - RNA, 20 nt, Artificial Sequence
  MKO10008418_A_Ccdc151
  gRNA
gcugaaugccuugcgacacc

SEQ ID NO: 8419 - RNA, 20 nt, Artificial Sequence
  MKO10008419_A_Ccdc151
  gRNA
guuucugccgcaguauuacc

SEQ ID NO: 8420 - RNA, 20 nt, Artificial Sequence
  MKO10008420_A_Ccdc151
  gRNA
ugccgcagagggugaccgga

SEQ ID NO: 8421 - RNA, 20 nt, Artificial Sequence
  MKO10008421_A_Ccdc152
  gRNA
gaacugaccuucuuucaucg

SEQ ID NO: 8422 - RNA, 20 nt, Artificial Sequence
  MKO10008422_A_Ccdc152
  gRNA
caaccuucuggauauucagc

SEQ ID NO: 8423 - RNA, 20 nt, Artificial Sequence
  MKO10008423_A_Ccdc152
  gRNA
caauaucaacacaauuugaa

SEQ ID NO: 8424 - RNA, 20 nt, Artificial Sequence
  MKO10008424_A_Ccdc153
  gRNA
ccuccuuuagggccugccgc

SEQ ID NO: 8425 - RNA, 20 nt, Artificial Sequence
  MKO10008425_A_Ccdc153
  gRNA
ccucagagaugagccgccag

SEQ ID NO: 8426 - RNA, 20 nt, Artificial Sequence
  MKO10008426_A_Ccdc153
  gRNA
caggcuggugcugcucgaga

SEQ ID NO: 8427 - RNA, 20 nt, Artificial Sequence
  MKO10008427_A_Ccdc154
  gRNA
aggcucuacaggacucggag

SEQ ID NO: 8428 - RNA, 20 nt, Artificial Sequence
  MKO10008428_A_Ccdc154
  gRNA
ccugagcacugucacacucg

SEQ ID NO: 8429 - RNA, 20 nt, Artificial Sequence
  MKO10008429_A_Ccdc154
  gRNA
aaguaguacaacaggcagcc

SEQ ID NO: 8430 - RNA, 20 nt, Artificial Sequence
  MKO10008430_A_Ccdc155
  gRNA
gcagaggagaccgccuacga

SEQ ID NO: 8431 - RNA, 20 nt, Artificial Sequence
  MKO10008431_A_Ccdc155
  gRNA
gucccgcaugaccaccagaa

SEQ ID NO: 8432 - RNA, 20 nt, Artificial Sequence
  MKO10008432_A_Ccdc155
  gRNA
agcccgaggaagcgaguuca

SEQ ID NO: 8433 - RNA, 20 nt, Artificial Sequence
  MKO10008433_A_Ccdc157
  gRNA
ccaaggcugucucgacgguc

SEQ ID NO: 8434 - RNA, 20 nt, Artificial Sequence
  MKO10008434_A_Ccdc157
  gRNA
gacuuacaguacggcgcuuc

SEQ ID NO: 8435 - RNA, 20 nt, Artificial Sequence
  MKO10008435_A_Ccdc157
  gRNA
gcgccguacuguaaguccca

SEQ ID NO: 8436 - RNA, 20 nt, Artificial Sequence
  MKO10008436_A_Ccdc158
  gRNA
uaccaugcacuuccgcagcc

SEQ ID NO: 8437 - RNA, 20 nt, Artificial Sequence
  MKO10008437_A_Ccdc158
  gRNA
gcugauuucgugacuccucc

SEQ ID NO: 8438 - RNA, 20 nt, Artificial Sequence
  MKO10008438_A_Ccdc158
  gRNA
uacuucaacaacaucaagau

SEQ ID NO: 8439 - RNA, 20 nt, Artificial Sequence
  MKO10008439_A_Ccdc159
  gRNA
gaagcaguguucacgaucuc

SEQ ID NO: 8440 - RNA, 20 nt, Artificial Sequence
  MKO10008440_A_Ccdc159
  gRNA
cguuacucgccaucacaucu

SEQ ID NO: 8441 - RNA, 20 nt, Artificial Sequence
  MKO10008441_A_Ccdc159
  gRNA
ccuagggcccuccucagaca

SEQ ID NO: 8442 - RNA, 20 nt, Artificial Sequence
  MKO10008442_A_Ccdc15
  gRNA
gcuggaauucccgaccaauu

SEQ ID NO: 8443 - RNA, 20 nt, Artificial Sequence
  MKO10008443_A_Ccdc15
  gRNA
ucaaucagcggguuaagcug

SEQ ID NO: 8444 - RNA, 20 nt, Artificial Sequence
  MKO10008444_A_Ccdc15
  gRNA
gcuuagucaaacuaugaaac

SEQ ID NO: 8445 - RNA, 20 nt, Artificial Sequence
  MKO10008445_A_Ccdc160
  gRNA
gagugucuaacuucuccguu

SEQ ID NO: 8446 - RNA, 20 nt, Artificial Sequence
  MKO10008446_A_Ccdc160
  gRNA
ucauuuggaugaugcaacga

SEQ ID NO: 8447 - RNA, 20 nt, Artificial Sequence
  MKO10008447_A_Ccdc160
  gRNA
gaagggagagcgccuccgcg

SEQ ID NO: 8448 - RNA, 20 nt, Artificial Sequence
  MKO10008448_A_Ccdc162
  gRNA
uccgggacgcugcuuauaac

SEQ ID NO: 8449 - RNA, 20 nt, Artificial Sequence
  MKO10008449_A_Ccdc162
  gRNA
uaccgaauggcaagcugcac

SEQ ID NO: 8450 - RNA, 20 nt, Artificial Sequence
  MKO10008450_A_Ccdc162
  gRNA
ccugcccucgaagcuugaau

SEQ ID NO: 8451 - RNA, 20 nt, Artificial Sequence
  MKO10008451_A_Ccdc163
  gRNA
gcucuugaaccugacuccga

SEQ ID NO: 8452 - RNA, 20 nt, Artificial Sequence
  MKO10008452_A_Ccdc163
  gRNA
acugcagggccuucggaguc

SEQ ID NO: 8453 - RNA, 20 nt, Artificial Sequence
  MKO10008453_A_Ccdc163
  gRNA
uucuguacagagccuguuga

SEQ ID NO: 8454 - RNA, 20 nt, Artificial Sequence
  MKO10008454_A_Ccdc166
  gRNA
uucgacgcgcacgacggcgu

SEQ ID NO: 8455 - RNA, 20 nt, Artificial Sequence
  MKO10008455_A_Ccdc166
  gRNA
gcaacgcguacucgcgcugu

SEQ ID NO: 8456 - RNA, 20 nt, Artificial Sequence
  MKO10008456_A_Ccdc166
  gRNA
gcuggcgcgaauccggaccc

SEQ ID NO: 8457 - RNA, 20 nt, Artificial Sequence
  MKO10008457_A_Ccdc167
  gRNA
gaaucuuggugucgcucagg

SEQ ID NO: 8458 - RNA, 20 nt, Artificial Sequence
  MKO10008458_A_Ccdc167
  gRNA
auuucagauugacgggcuag

SEQ ID NO: 8459 - RNA, 20 nt, Artificial Sequence
  MKO10008459_A_Ccdc167
  gRNA
aaagcugucccggugucgga

SEQ ID NO: 8460 - RNA, 20 nt, Artificial Sequence
  MKO10008460_A_Ccdc169
  gRNA
cuugugccguaucucaagug

SEQ ID NO: 8461 - RNA, 20 nt, Artificial Sequence
  MKO10008461_A_Ccdc169
  gRNA
uaccugcaaggucaccguug

SEQ ID NO: 8462 - RNA, 20 nt, Artificial Sequence
  MKO10008462_A_Ccdc169
  gRNA
gaaagaauaugcguuuagac

SEQ ID NO: 8463 - RNA, 20 nt, Artificial Sequence
  MKO10008463_A_Ccdc170
  gRNA
cccgaaauuccucgugccuc

SEQ ID NO: 8464 - RNA, 20 nt, Artificial Sequence
  MKO10008464_A_Ccdc170
  gRNA
cuucaucauggcgugaacag

SEQ ID NO: 8465 - RNA, 20 nt, Artificial Sequence
  MKO10008465_A_Ccdc170
  gRNA
gaguagcgagcuguccuuuc

SEQ ID NO: 8466 - RNA, 20 nt, Artificial Sequence
  MKO10008466_A_Ccdc171
  gRNA
uaaucuaaauucgcccaaug

SEQ ID NO: 8467 - RNA, 20 nt, Artificial Sequence
  MKO10008467_A_Ccdc171
  gRNA
agaagcgcugcgacagcguc

SEQ ID NO: 8468 - RNA, 20 nt, Artificial Sequence
  MKO10008468_A_Ccdc171
  gRNA
cucuugaauccgcugcgccu

SEQ ID NO: 8469 - RNA, 20 nt, Artificial Sequence
  MKO10008469_A_Ccdc172
  gRNA
aacguaaccguggacaguua

SEQ ID NO: 8470 - RNA, 20 nt, Artificial Sequence
  MKO10008470_A_Ccdc172
  gRNA
aauggcugacuuagacagcc

SEQ ID NO: 8471 - RNA, 20 nt, Artificial Sequence
  MKO10008471_A_Ccdc172
  gRNA
ucagugagauuaucagcgag

SEQ ID NO: 8472 - RNA, 20 nt, Artificial Sequence
  MKO10008472_A_Ccdc173
  gRNA
ggauccgggauagccucaac

SEQ ID NO: 8473 - RNA, 20 nt, Artificial Sequence
  MKO10008473_A_Ccdc173
  gRNA
ccauaaucccacacgcugag

SEQ ID NO: 8474 - RNA, 20 nt, Artificial Sequence
  MKO10008474_A_Ccdc173
  gRNA
agcgcuucacucgcuccguc

SEQ ID NO: 8475 - RNA, 20 nt, Artificial Sequence
  MKO10008475_A_Ccdc174
  gRNA
cacgagagagucccaaaucg

SEQ ID NO: 8476 - RNA, 20 nt, Artificial Sequence
  MKO10008476_A_Ccdc174
  gRNA
auucuaguugguagaucuua

SEQ ID NO: 8477 - RNA, 20 nt, Artificial Sequence
  MKO10008477_A_Ccdc174
  gRNA
cauuacccaccauuccucac

SEQ ID NO: 8478 - RNA, 20 nt, Artificial Sequence
  MKO10008478_A_Ccdc175
  gRNA
gagccgacuuuacuuucugc

SEQ ID NO: 8479 - RNA, 20 nt, Artificial Sequence
  MKO10008479_A_Ccdc175
  gRNA
uacuguagcuguuaaaaaac

SEQ ID NO: 8480 - RNA, 20 nt, Artificial Sequence
  MKO10008480_A_Ccdc175
  gRNA
ccugcugcugaaccaaaccu

SEQ ID NO: 8481 - RNA, 20 nt, Artificial Sequence
  MKO10008481_A_Ccdc176
  gRNA
cugaaucaugccgauuuccu

SEQ ID NO: 8482 - RNA, 20 nt, Artificial Sequence
  MKO10008482_A_Ccdc176
  gRNA
ucgugauacuucccgaagac

SEQ ID NO: 8483 - RNA, 20 nt, Artificial Sequence
  MKO10008483_A_Ccdc176
  gRNA
auuaagcuacuugaagaagc

SEQ ID NO: 8484 - RNA, 20 nt, Artificial Sequence
  MKO10008484_A_Ccdc177
  gRNA
ggcgaucuugcggucgcgcu

SEQ ID NO: 8485 - RNA, 20 nt, Artificial Sequence
  MKO10008485_A_Ccdc177
  gRNA
gcgcaugaugcgcucgcgcu

SEQ ID NO: 8486 - RNA, 20 nt, Artificial Sequence
  MKO10008486_A_Ccdc177
  gRNA
ccgccucguaggccucguac

SEQ ID NO: 8487 - RNA, 20 nt, Artificial Sequence
  MKO10008487_A_Ccdc178
  gRNA
guacaacuaugucgccgacu

SEQ ID NO: 8488 - RNA, 20 nt, Artificial Sequence
  MKO10008488_A_Ccdc178
  gRNA
gaaagggcauuaaugcuugc

SEQ ID NO: 8489 - RNA, 20 nt, Artificial Sequence
  MKO10008489_A_Ccdc178
  gRNA
ucuacuucagcuacccaagu

SEQ ID NO: 8490 - RNA, 20 nt, Artificial Sequence
  MKO10008490_A_Ccdc17
  gRNA
agcucgcgcuccaagucgaa

SEQ ID NO: 8491 - RNA, 20 nt, Artificial Sequence
  MKO10008491_A_Ccdc17
  gRNA
aaaacggcgccuccacagcg

SEQ ID NO: 8492 - RNA, 20 nt, Artificial Sequence
  MKO10008492_A_Ccdc17
  gRNA
cgccgcgacgcuccagcgcc

SEQ ID NO: 8493 - RNA, 20 nt, Artificial Sequence
  MKO10008493_A_Ccdc181
  gRNA
guucucgugucaguuaccga

SEQ ID NO: 8494 - RNA, 20 nt, Artificial Sequence
  MKO10008494_A_Ccdc181
  gRNA
gauccaacggcugaauacuu

SEQ ID NO: 8495 - RNA, 20 nt, Artificial Sequence
  MKO10008495_A_Ccdc181
  gRNA
acugucgaaaggcucucucg

SEQ ID NO: 8496 - RNA, 20 nt, Artificial Sequence
  MKO10008496_A_Ccdc18
  gRNA
gguaaaucaaacgucccagg

SEQ ID NO: 8497 - RNA, 20 nt, Artificial Sequence
  MKO10008497_A_Ccdc18
  gRNA
auaagccuuucagaucuuga

SEQ ID NO: 8498 - RNA, 20 nt, Artificial Sequence
  MKO10008498_A_Ccdc18
  gRNA
guuuaugaaguuucucucga

SEQ ID NO: 8499 - RNA, 20 nt, Artificial Sequence
  MKO10008499_A_Ccdc19
  gRNA
agcgaguccuaguccgugac

SEQ ID NO: 8500 - RNA, 20 nt, Artificial Sequence
  MKO10008500_A_Ccdc19
  gRNA
gagagccgacaagcuccgua

SEQ ID NO: 8501 - RNA, 20 nt, Artificial Sequence
  MKO10008501_A_Ccdc19
  gRNA
uccaugauaaacacgcuauc

SEQ ID NO: 8502 - RNA, 20 nt, Artificial Sequence
  MKO10008502_A_Ccdc22
  gRNA
gagccaaauccgggaccagc

SEQ ID NO: 8503 - RNA, 20 nt, Artificial Sequence
  MKO10008503_A_Ccdc22
  gRNA
gggccagcuggucccggauu

SEQ ID NO: 8504 - RNA, 20 nt, Artificial Sequence
  MKO10008504_A_Ccdc22
  gRNA
ccuccgcuggaauucaacuc

SEQ ID NO: 8505 - RNA, 20 nt, Artificial Sequence
  MKO10008505_A_Ccdc23
  gRNA
agaagugaggagacucgacu

SEQ ID NO: 8506 - RNA, 20 nt, Artificial Sequence
  MKO10008506_A_Ccdc23
  gRNA
agucucaguuuccugcacaa

SEQ ID NO: 8507 - RNA, 20 nt, Artificial Sequence
  MKO10008507_A_Ccdc23
  gRNA
aaaccauggauccaccugcc

SEQ ID NO: 8508 - RNA, 20 nt, Artificial Sequence
  MKO10008508_A_Ccdc24
  gRNA
caauauuagacacauucagu

SEQ ID NO: 8509 - RNA, 20 nt, Artificial Sequence
  MKO10008509_A_Ccdc24
  gRNA
uauccucuaaggcaaagcga

SEQ ID NO: 8510 - RNA, 20 nt, Artificial Sequence
  MKO10008510_A_Ccdc24
  gRNA
gacuauacugggcccacauc

SEQ ID NO: 8511 - RNA, 20 nt, Artificial Sequence
  MKO10008511_A_Ccdc25
  gRNA
caacugaccuugaaugcuau

SEQ ID NO: 8512 - RNA, 20 nt, Artificial Sequence
  MKO10008512_A_Ccdc25
  gRNA
uguguaccuacgauuacaaa

SEQ ID NO: 8513 - RNA, 20 nt, Artificial Sequence
  MKO10008513_A_Ccdc25
  gRNA
ggacugugcccaccuuguga

SEQ ID NO: 8514 - RNA, 20 nt, Artificial Sequence
  MKO10008514_A_Ccdc27
  gRNA
ccggugggacucgggucuga

SEQ ID NO: 8515 - RNA, 20 nt, Artificial Sequence
  MKO10008515_A_Ccdc27
  gRNA
ucuccaucucggagaaacgc

SEQ ID NO: 8516 - RNA, 20 nt, Artificial Sequence
  MKO10008516_A_Ccdc27
  gRNA
gcuccagcguuucuccgaga

SEQ ID NO: 8517 - RNA, 20 nt, Artificial Sequence
  MKO10008517_A_Ccdc28a
  gRNA
cuccuggacauccgagacgu

SEQ ID NO: 8518 - RNA, 20 nt, Artificial Sequence
  MKO10008518_A_Ccdc28a
  gRNA
cuccuuccucaccgacgucu

SEQ ID NO: 8519 - RNA, 20 nt, Artificial Sequence
  MKO10008519_A_Ccdc28a
  gRNA
cguccgacagaagccugucc

SEQ ID NO: 8520 - RNA, 20 nt, Artificial Sequence
  MKO10008520_A_Ccdc28b
  gRNA
uuaggcgacaccuacgcagc

SEQ ID NO: 8521 - RNA, 20 nt, Artificial Sequence
  MKO10008521_A_Ccdc28b
  gRNA
gacaauggcugaccgcaacc

SEQ ID NO: 8522 - RNA, 20 nt, Artificial Sequence
  MKO10008522_A_Ccdc28b
  gRNA
cggacuuaccaaaggccugc

SEQ ID NO: 8523 - RNA, 20 nt, Artificial Sequence
  MKO10008523_A_Ccdc30
  gRNA
ccgagucaagugaucgaacc

SEQ ID NO: 8524 - RNA, 20 nt, Artificial Sequence
  MKO10008524_A_Ccdc30
  gRNA
ugcacuugagaaugcccgac

SEQ ID NO: 8525 - RNA, 20 nt, Artificial Sequence
  MKO10008525_A_Ccdc30
  gRNA
gaauuuccucguccagccuc

SEQ ID NO: 8526 - RNA, 20 nt, Artificial Sequence
  MKO10008526_A_Ccdc32
  gRNA
auggacucgauuccgaugag

SEQ ID NO: 8527 - RNA, 20 nt, Artificial Sequence
  MKO10008527_A_Ccdc32
  gRNA
caaagucuggccgggaucuc

SEQ ID NO: 8528 - RNA, 20 nt, Artificial Sequence
  MKO10008528_A_Ccdc32
  gRNA
gugcugggaucgauuccucc

SEQ ID NO: 8529 - RNA, 20 nt, Artificial Sequence
  MKO10008529_A_Ccdc33
  gRNA
cucugaaccguggcccuacg

SEQ ID NO: 8530 - RNA, 20 nt, Artificial Sequence
  MKO10008530_A_Ccdc33
  gRNA
auauccugccgccaacuacc

SEQ ID NO: 8531 - RNA, 20 nt, Artificial Sequence
  MKO10008531_A_Ccdc33
  gRNA
aacccaccagagcccccguc

SEQ ID NO: 8532 - RNA, 20 nt, Artificial Sequence
  MKO10008532_A_Ccdc34
  gRNA
ccggcuacaacagaaauuuc

SEQ ID NO: 8533 - RNA, 20 nt, Artificial Sequence
  MKO10008533_A_Ccdc34
  gRNA
ugcaaaaaauaaaccucguc

SEQ ID NO: 8534 - RNA, 20 nt, Artificial Sequence
  MKO10008534_A_Ccdc34
  gRNA
agcacggcagucugacgcca

SEQ ID NO: 8535 - RNA, 20 nt, Artificial Sequence
  MKO10008535_A_Ccdc36
  gRNA
uuguaucgccuccaagcaac

SEQ ID NO: 8536 - RNA, 20 nt, Artificial Sequence
  MKO10008536_A_Ccdc36
  gRNA
gggcaacggaccaaucugac

SEQ ID NO: 8537 - RNA, 20 nt, Artificial Sequence
  MKO10008537_A_Ccdc36
  gRNA
ggaucacuaaaccaucuaac

SEQ ID NO: 8538 - RNA, 20 nt, Artificial Sequence
  MKO10008538_A_Ccdc37
  gRNA
gggugcuguaccgcggguca

SEQ ID NO: 8539 - RNA, 20 nt, Artificial Sequence
  MKO10008539_A_Ccdc37
  gRNA
agugugcuuggccgauaccu

SEQ ID NO: 8540 - RNA, 20 nt, Artificial Sequence
  MKO10008540_A_Ccdc37
  gRNA
guaacccuuuccacauauca

SEQ ID NO: 8541 - RNA, 20 nt, Artificial Sequence
  MKO10008541_A_Ccdc38
  gRNA
aucuagccccagacguucau

SEQ ID NO: 8542 - RNA, 20 nt, Artificial Sequence
  MKO10008542_A_Ccdc38
  gRNA
cgucagcgaaaaaagcuagc

SEQ ID NO: 8543 - RNA, 20 nt, Artificial Sequence
  MKO10008543_A_Ccdc38
  gRNA
uucucguaggaauucuucaa

SEQ ID NO: 8544 - RNA, 20 nt, Artificial Sequence
  MKO10008544_A_Ccdc39
  gRNA
gacagagacgcuaagugcgc

SEQ ID NO: 8545 - RNA, 20 nt, Artificial Sequence
  MKO10008545_A_Ccdc39
  gRNA
agaaggagauggcgaucauc

SEQ ID NO: 8546 - RNA, 20 nt, Artificial Sequence
  MKO10008546_A_Ccdc39
  gRNA
gugagccgauucuuccagcc

SEQ ID NO: 8547 - RNA, 20 nt, Artificial Sequence
  MKO10008547_A_Ccdc3
  gRNA
ugacgacuuucucgagugac

SEQ ID NO: 8548 - RNA, 20 nt, Artificial Sequence
  MKO10008548_A_Ccdc3
  gRNA
cacgauggucucggcuagcu

SEQ ID NO: 8549 - RNA, 20 nt, Artificial Sequence
  MKO10008549_A_Ccdc3
  gRNA
cucaagggucuccacuccga

SEQ ID NO: 8550 - RNA, 20 nt, Artificial Sequence
  MKO10008550_A_Ccdc40
  gRNA
cuucaguugcucuaucgagc

SEQ ID NO: 8551 - RNA, 20 nt, Artificial Sequence
  MKO10008551_A_Ccdc40
  gRNA
gagccaugaccggcacucuc

SEQ ID NO: 8552 - RNA, 20 nt, Artificial Sequence
  MKO10008552_A_Ccdc40
  gRNA
acuguauccggguuucuuca

SEQ ID NO: 8553 - RNA, 20 nt, Artificial Sequence
  MKO10008553_A_Ccdc41
  gRNA
guccgaaaacguucucgcau

SEQ ID NO: 8554 - RNA, 20 nt, Artificial Sequence
  MKO10008554_A_Ccdc41
  gRNA
caauuauuagguugcacgac

SEQ ID NO: 8555 - RNA, 20 nt, Artificial Sequence
  MKO10008555_A_Ccdc41
  gRNA
cauucguuugcugucucucg

SEQ ID NO: 8556 - RNA, 20 nt, Artificial Sequence
  MKO10008556_A_Ccdc42b
  gRNA
ucgcuucaguauucgcgcgc

SEQ ID NO: 8557 - RNA, 20 nt, Artificial Sequence
  MKO10008557_A_Ccdc42b
  gRNA
gcggaagauaacgggcaacc

SEQ ID NO: 8558 - RNA, 20 nt, Artificial Sequence
  MKO10008558_A_Ccdc42b
  gRNA
ccaccaguugcguccguugc

SEQ ID NO: 8559 - RNA, 20 nt, Artificial Sequence
  MKO10008559_A_Ccdc42
  gRNA
uuagggcucggauccguuuc

SEQ ID NO: 8560 - RNA, 20 nt, Artificial Sequence
  MKO10008560_A_Ccdc42
  gRNA
uggaaacgcugaacuugcgc

SEQ ID NO: 8561 - RNA, 20 nt, Artificial Sequence
  MKO10008561_A_Ccdc42
  gRNA
ucagcguuuccauucuccgu

SEQ ID NO: 8562 - RNA, 20 nt, Artificial Sequence
  MKO10008562_A_Ccdc43
  gRNA
cuuguuccgaaacaccaaug

SEQ ID NO: 8563 - RNA, 20 nt, Artificial Sequence
  MKO10008563_A_Ccdc43
  gRNA
uguucucaaugcucggaaau

SEQ ID NO: 8564 - RNA, 20 nt, Artificial Sequence
  MKO10008564_A_Ccdc43
  gRNA
ugccgacgugacagacgaag

SEQ ID NO: 8565 - RNA, 20 nt, Artificial Sequence
  MKO10008565_A_Ccdc47
  gRNA
acaagacuuacuuaaugucc

SEQ ID NO: 8566 - RNA, 20 nt, Artificial Sequence
  MKO10008566_A_Ccdc47
  gRNA
cuuacaucaacaauuguuau

SEQ ID NO: 8567 - RNA, 20 nt, Artificial Sequence
  MKO10008567_A_Ccdc47
  gRNA
uaaaaacagccgacuugcuc

SEQ ID NO: 8568 - RNA, 20 nt, Artificial Sequence
  MKO10008568_A_Ccdc50
  gRNA
gaccuaccuuccuucacgcc

SEQ ID NO: 8569 - RNA, 20 nt, Artificial Sequence
  MKO10008569_A_Ccdc50
  gRNA
acagggcuuuguagcgcuuc

SEQ ID NO: 8570 - RNA, 20 nt, Artificial Sequence
  MKO10008570_A_Ccdc50
  gRNA
uguagaucaguccaaguugc

SEQ ID NO: 8571 - RNA, 20 nt, Artificial Sequence
  MKO10008571_A_Ccdc51
  gRNA
cacgugcugcauugcgaaca

SEQ ID NO: 8572 - RNA, 20 nt, Artificial Sequence
  MKO10008572_A_Ccdc51
  gRNA
ccaccuauguuaaccgcguc

SEQ ID NO: 8573 - RNA, 20 nt, Artificial Sequence
  MKO10008573_A_Ccdc51
  gRNA
auggccuccuggagacucgc

SEQ ID NO: 8574 - RNA, 20 nt, Artificial Sequence
  MKO10008574_A_Ccdc53
  gRNA
uaccugcguuugcuccgaag

SEQ ID NO: 8575 - RNA, 20 nt, Artificial Sequence
  MKO10008575_A_Ccdc53
  gRNA
cuucaacugugacguccucu

SEQ ID NO: 8576 - RNA, 20 nt, Artificial Sequence
  MKO10008576_A_Ccdc53
  gRNA
ucuaugccugaccccaugag

SEQ ID NO: 8577 - RNA, 20 nt, Artificial Sequence
  MKO10008577_A_Ccdc54
  gRNA
caaccguaagaagcccuugu

SEQ ID NO: 8578 - RNA, 20 nt, Artificial Sequence
  MKO10008578_A_Ccdc54
  gRNA
cagagagacuacgccuucac

SEQ ID NO: 8579 - RNA, 20 nt, Artificial Sequence
  MKO10008579_A_Ccdc54
  gRNA
aacugacaauguucgucauu

SEQ ID NO: 8580 - RNA, 20 nt, Artificial Sequence
  MKO10008580_A_Ccdc55
  gRNA
uacuaaaagcagucgagauc

SEQ ID NO: 8581 - RNA, 20 nt, Artificial Sequence
  MKO10008581_A_Ccdc55
  gRNA
uucuguaaaacucggugcaa

SEQ ID NO: 8582 - RNA, 20 nt, Artificial Sequence
  MKO10008582_A_Ccdc55
  gRNA
gagugauucugaugacgaug

SEQ ID NO: 8583 - RNA, 20 nt, Artificial Sequence
  MKO10008583_A_Ccdc57
  gRNA
uacgcaccgagcguccuuca

SEQ ID NO: 8584 - RNA, 20 nt, Artificial Sequence
  MKO10008584_A_Ccdc57
  gRNA
gaagcuuuacucggcacagc

SEQ ID NO: 8585 - RNA, 20 nt, Artificial Sequence
  MKO10008585_A_Ccdc57
  gRNA
uggaggccgugaaggacgcu

SEQ ID NO: 8586 - RNA, 20 nt, Artificial Sequence
  MKO10008586_A_Ccdc58
  gRNA
agaacuaaaugucgaagaag

SEQ ID NO: 8587 - RNA, 20 nt, Artificial Sequence
  MKO10008587_A_Ccdc58
  gRNA
ugauggcagcucaugucagu

SEQ ID NO: 8588 - RNA, 20 nt, Artificial Sequence
  MKO10008588_A_Ccdc58
  gRNA
cucucucucuacucauucuu

SEQ ID NO: 8589 - RNA, 20 nt, Artificial Sequence
  MKO10008589_A_Ccdc59
  gRNA
cacuuggaagacggccgcga

SEQ ID NO: 8590 - RNA, 20 nt, Artificial Sequence
  MKO10008590_A_Ccdc59
  gRNA
ugaccggccuuugccugaag

SEQ ID NO: 8591 - RNA, 20 nt, Artificial Sequence
  MKO10008591_A_Ccdc59
  gRNA
uacccuugcgcacgcucccc

SEQ ID NO: 8592 - RNA, 20 nt, Artificial Sequence
  MKO10008592_A_Ccdc60
  gRNA
gaacgggcggaugaugaucc

SEQ ID NO: 8593 - RNA, 20 nt, Artificial Sequence
  MKO10008593_A_Ccdc60
  gRNA
uucgcauaagauccuucuua

SEQ ID NO: 8594 - RNA, 20 nt, Artificial Sequence
  MKO10008594_A_Ccdc60
  gRNA
agaaggaucuuaugcgaagc

SEQ ID NO: 8595 - RNA, 20 nt, Artificial Sequence
  MKO10008595_A_Ccdc61
  gRNA
ggccgagucguugcgugggc

SEQ ID NO: 8596 - RNA, 20 nt, Artificial Sequence
  MKO10008596_A_Ccdc61
  gRNA
cagccaggauagucgccgac

SEQ ID NO: 8597 - RNA, 20 nt, Artificial Sequence
  MKO10008597_A_Ccdc61
  gRNA
ggaguugagcugggccgacc

SEQ ID NO: 8598 - RNA, 20 nt, Artificial Sequence
  MKO10008598_A_Ccdc62
  gRNA
ggagcugaaagaccgcgaua

SEQ ID NO: 8599 - RNA, 20 nt, Artificial Sequence
  MKO10008599_A_Ccdc62
  gRNA
gagcgcugcagcaagcucga

SEQ ID NO: 8600 - RNA, 20 nt, Artificial Sequence
  MKO10008600_A_Ccdc62
  gRNA
cacacacgucuccgccaucu

SEQ ID NO: 8601 - RNA, 20 nt, Artificial Sequence
  MKO10008601_A_Ccdc63
  gRNA
auuggccggcgaucauacgc

SEQ ID NO: 8602 - RNA, 20 nt, Artificial Sequence
  MKO10008602_A_Ccdc63
  gRNA
cgccaccagcguaugaucgc

SEQ ID NO: 8603 - RNA, 20 nt, Artificial Sequence
  MKO10008603_A_Ccdc63
  gRNA
gguucuucggagacuucacg

SEQ ID NO: 8604 - RNA, 20 nt, Artificial Sequence
  MKO10008604_A_Ccdc64b
  gRNA
cgcccgauaucucggugucu

SEQ ID NO: 8605 - RNA, 20 nt, Artificial Sequence
  MKO10008605_A_Ccdc64b
  gRNA
gcuggaacgcgcccgcuucg

SEQ ID NO: 8606 - RNA, 20 nt, Artificial Sequence
  MKO10008606_A_Ccdc64b
  gRNA
gagucugacaccgcucccga

SEQ ID NO: 8607 - RNA, 20 nt, Artificial Sequence
  MKO10008607_A_Ccdc64
  gRNA
agaugcugucagaucgaaaa

SEQ ID NO: 8608 - RNA, 20 nt, Artificial Sequence
  MKO10008608_A_Ccdc64
  gRNA
uuucucggucugcuucccga

SEQ ID NO: 8609 - RNA, 20 nt, Artificial Sequence
  MKO10008609_A_Ccdc64
  gRNA
aggaggugcggcuguccuac

SEQ ID NO: 8610 - RNA, 20 nt, Artificial Sequence
  MKO10008610_A_Ccdc65
  gRNA
ggccgagccggcgucguugc

SEQ ID NO: 8611 - RNA, 20 nt, Artificial Sequence
  MKO10008611_A_Ccdc65
  gRNA
cagccagaccuuugaacgcg

SEQ ID NO: 8612 - RNA, 20 nt, Artificial Sequence
  MKO10008612_A_Ccdc65
  gRNA
gcacuuucuucgccuacaac

SEQ ID NO: 8613 - RNA, 20 nt, Artificial Sequence
  MKO10008613_A_Ccdc66
  gRNA
ugaauacugcuuauccguac

SEQ ID NO: 8614 - RNA, 20 nt, Artificial Sequence
  MKO10008614_A_Ccdc66
  gRNA
cacuaccgguacuuguccag

SEQ ID NO: 8615 - RNA, 20 nt, Artificial Sequence
  MKO10008615_A_Ccdc66
  gRNA
ugcucauguucacucgugac

SEQ ID NO: 8616 - RNA, 20 nt, Artificial Sequence
  MKO10008616_A_Ccdc67
  gRNA
uggccaacucuugaucccga

SEQ ID NO: 8617 - RNA, 20 nt, Artificial Sequence
  MKO10008617_A_Ccdc67
  gRNA
gugcacucaccucuaguuuc

SEQ ID NO: 8618 - RNA, 20 nt, Artificial Sequence
  MKO10008618_A_Ccdc67
  gRNA
cccacucccucgacuuugcu

SEQ ID NO: 8619 - RNA, 20 nt, Artificial Sequence
  MKO10008619_A_Ccdc68
  gRNA
gauccgaaaucacauguuua

SEQ ID NO: 8620 - RNA, 20 nt, Artificial Sequence
  MKO10008620_A_Ccdc68
  gRNA
gaaaaacaugggcaaaucgu

SEQ ID NO: 8621 - RNA, 20 nt, Artificial Sequence
  MKO10008621_A_Ccdc68
  gRNA
cuuccagaugcgaacuacac

SEQ ID NO: 8622 - RNA, 20 nt, Artificial Sequence
  MKO10008622_A_Ccdc69
  gRNA
cccgcagacaucgaaugcac

SEQ ID NO: 8623 - RNA, 20 nt, Artificial Sequence
  MKO10008623_A_Ccdc69
  gRNA
ucucaccugcaacgaggcuu

SEQ ID NO: 8624 - RNA, 20 nt, Artificial Sequence
  MKO10008624_A_Ccdc69
  gRNA
uggugagacaugacuugcac

SEQ ID NO: 8625 - RNA, 20 nt, Artificial Sequence
  MKO10008625_A_Ccdc6
  gRNA
ccucgccgugaauuacgaga

SEQ ID NO: 8626 - RNA, 20 nt, Artificial Sequence
  MKO10008626_A_Ccdc6
  gRNA
agaccacguacguuguaacu

SEQ ID NO: 8627 - RNA, 20 nt, Artificial Sequence
  MKO10008627_A_Ccdc6
  gRNA
aggcgcuggugaaucggcug

SEQ ID NO: 8628 - RNA, 20 nt, Artificial Sequence
  MKO10008628_A_Ccdc70
  gRNA
uuguccacuaagcacggccc

SEQ ID NO: 8629 - RNA, 20 nt, Artificial Sequence
  MKO10008629_A_Ccdc70
  gRNA
ggcuuuccggggccagaucc

SEQ ID NO: 8630 - RNA, 20 nt, Artificial Sequence
  MKO10008630_A_Ccdc70
  gRNA
gcgagggcagcaccagugac

SEQ ID NO: 8631 - RNA, 20 nt, Artificial Sequence
  MKO10008631_A_Ccdc71l
  gRNA
ugaugcgacgcggcgugaag

SEQ ID NO: 8632 - RNA, 20 nt, Artificial Sequence
  MKO10008632_A_Ccdc71l
  gRNA
ucuacggcuacuccucgugc

SEQ ID NO: 8633 - RNA, 20 nt, Artificial Sequence
  MKO10008633_A_Ccdc71l
  gRNA
agcuucccgaccauccgcgu

SEQ ID NO: 8634 - RNA, 20 nt, Artificial Sequence
  MKO10008634_A_Ccdc71
  gRNA
uuuggguuccagcgccucgu

SEQ ID NO: 8635 - RNA, 20 nt, Artificial Sequence
  MKO10008635_A_Ccdc71
  gRNA
cccgugcuuaacguccaagc

SEQ ID NO: 8636 - RNA, 20 nt, Artificial Sequence
  MKO10008636_A_Ccdc71
  gRNA
caaccgaccauucuucgaag

SEQ ID NO: 8637 - RNA, 20 nt, Artificial Sequence
  MKO10008637_A_Ccdc73
  gRNA
gcagauugcuaaaauuauuc

SEQ ID NO: 8638 - RNA, 20 nt, Artificial Sequence
  MKO10008638_A_Ccdc73
  gRNA
gcagaugaagauguaugccu

SEQ ID NO: 8639 - RNA, 20 nt, Artificial Sequence
  MKO10008639_A_Ccdc73
  gRNA
ggaaacauuaaaaacauugc

SEQ ID NO: 8640 - RNA, 20 nt, Artificial Sequence
  MKO10008640_A_Ccdc74a
  gRNA
cccuggcucaccggacaucg

SEQ ID NO: 8641 - RNA, 20 nt, Artificial Sequence
  MKO10008641_A_Ccdc74a
  gRNA
auggcugccccccaccaacg

SEQ ID NO: 8642 - RNA, 20 nt, Artificial Sequence
  MKO10008642_A_Ccdc74a
  gRNA
gccuccaauuccacgauguc

SEQ ID NO: 8643 - RNA, 20 nt, Artificial Sequence
  MKO10008643_A_Ccdc77
  gRNA
auaucguuugccucuaaacg

SEQ ID NO: 8644 - RNA, 20 nt, Artificial Sequence
  MKO10008644_A_Ccdc77
  gRNA
gccaguaccugauucuuagu

SEQ ID NO: 8645 - RNA, 20 nt, Artificial Sequence
  MKO10008645_A_Ccdc77
  gRNA
aaaaugaccgacuaagaauc

SEQ ID NO: 8646 - RNA, 20 nt, Artificial Sequence
  MKO10008646_A_Ccdc78
  gRNA
cagcuucaugcuguucgcgc

SEQ ID NO: 8647 - RNA, 20 nt, Artificial Sequence
  MKO10008647_A_Ccdc78
  gRNA
ucuccacucaccucuaaugg

SEQ ID NO: 8648 - RNA, 20 nt, Artificial Sequence
  MKO10008648_A_Ccdc78
  gRNA
aucuccacagauucuucgac

SEQ ID NO: 8649 - RNA, 20 nt, Artificial Sequence
  MKO10008649_A_Ccdc79
  gRNA
aucaucauuaguuaagagcc

SEQ ID NO: 8650 - RNA, 20 nt, Artificial Sequence
  MKO10008650_A_Ccdc79
  gRNA
gaagcagccuuauacacauu

SEQ ID NO: 8651 - RNA, 20 nt, Artificial Sequence
  MKO10008651_A_Ccdc79
  gRNA
gggcaacccuuugucacaaa

SEQ ID NO: 8652 - RNA, 20 nt, Artificial Sequence
  MKO10008652_A_Ccdc7
  gRNA
gcguacaauugacucuccug

SEQ ID NO: 8653 - RNA, 20 nt, Artificial Sequence
  MKO10008653_A_Ccdc7
  gRNA
aauaccauugaguaaaacga

SEQ ID NO: 8654 - RNA, 20 nt, Artificial Sequence
  MKO10008654_A_Ccdc7
  gRNA
auuaucauagcaagcuccau

SEQ ID NO: 8655 - RNA, 20 nt, Artificial Sequence
  MKO10008655_A_Ccdc80
  gRNA
aauugcaugccugaccguug

SEQ ID NO: 8656 - RNA, 20 nt, Artificial Sequence
  MKO10008656_A_Ccdc80
  gRNA
aucaucauccaccacacgca

SEQ ID NO: 8657 - RNA, 20 nt, Artificial Sequence
  MKO10008657_A_Ccdc80
  gRNA
accuggauaggaaguucucc

SEQ ID NO: 8658 - RNA, 20 nt, Artificial Sequence
  MKO10008658_A_Ccdc81
  gRNA
acgacagcuaacuaugcaca

SEQ ID NO: 8659 - RNA, 20 nt, Artificial Sequence
  MKO10008659_A_Ccdc81
  gRNA
gcuagacagcaccgagucca

SEQ ID NO: 8660 - RNA, 20 nt, Artificial Sequence
  MKO10008660_A_Ccdc81
  gRNA
cacuuccauccaucgaacag

SEQ ID NO: 8661 - RNA, 20 nt, Artificial Sequence
  MKO10008661_A_Ccdc82
  gRNA
ugucaacauaucuuucgcgu

SEQ ID NO: 8662 - RNA, 20 nt, Artificial Sequence
  MKO10008662_A_Ccdc82
  gRNA
guuuagucucuagaagucga

SEQ ID NO: 8663 - RNA, 20 nt, Artificial Sequence
  MKO10008663_A_Ccdc82
  gRNA
guuauacaacaucaggacga

SEQ ID NO: 8664 - RNA, 20 nt, Artificial Sequence
  MKO10008664_A_Ccdc83
  gRNA
acaggcagcuucgagucuuu

SEQ ID NO: 8665 - RNA, 20 nt, Artificial Sequence
  MKO10008665_A_Ccdc83
  gRNA
ggcaccaauaguaacaagag

SEQ ID NO: 8666 - RNA, 20 nt, Artificial Sequence
  MKO10008666_A_Ccdc83
  gRNA
auggcagaauagacgcuuga

SEQ ID NO: 8667 - RNA, 20 nt, Artificial Sequence
  MKO10008667_A_Ccdc84
  gRNA
ccaacagcaccgaucgugcu

SEQ ID NO: 8668 - RNA, 20 nt, Artificial Sequence
  MKO10008668_A_Ccdc84
  gRNA
gcuauguccccgagcacgau

SEQ ID NO: 8669 - RNA, 20 nt, Artificial Sequence
  MKO10008669_A_Ccdc84
  gRNA
uaacucaccgugcauaaucc

SEQ ID NO: 8670 - RNA, 20 nt, Artificial Sequence
  MKO10008670_A_Ccdc85a
  gRNA
ugcgucgacacccacgggcg

SEQ ID NO: 8671 - RNA, 20 nt, Artificial Sequence
  MKO10008671_A_Ccdc85a
  gRNA
agauagaucauccacgcccg

SEQ ID NO: 8672 - RNA, 20 nt, Artificial Sequence
  MKO10008672_A_Ccdc85a
  gRNA
ccuccggcggccugcucaag

SEQ ID NO: 8673 - RNA, 20 nt, Artificial Sequence
  MKO10008673_A_Ccdc85b
  gRNA
acucggagcgccaacgagga

SEQ ID NO: 8674 - RNA, 20 nt, Artificial Sequence
  MKO10008674_A_Ccdc85b
  gRNA
cgcgcugcacuagcgcugcc

SEQ ID NO: 8675 - RNA, 20 nt, Artificial Sequence
  MKO10008675_A_Ccdc85b
  gRNA
gaagaguggggcccccgcgg

SEQ ID NO: 8676 - RNA, 20 nt, Artificial Sequence
  MKO10008676_A_Ccdc85c
  gRNA
cccguccaccgucuacaguu

SEQ ID NO: 8677 - RNA, 20 nt, Artificial Sequence
  MKO10008677_A_Ccdc85c
  gRNA
cauggcgugcacgacagccu

SEQ ID NO: 8678 - RNA, 20 nt, Artificial Sequence
  MKO10008678_A_Ccdc85c
  gRNA
cggugacaagcuccccccac

SEQ ID NO: 8679 - RNA, 20 nt, Artificial Sequence
  MKO10008679_A_Ccdc86
  gRNA
uaaggacuucgcccgacacc

SEQ ID NO: 8680 - RNA, 20 nt, Artificial Sequence
  MKO10008680_A_Ccdc86
  gRNA
ccguuucgcccgagagacuu

SEQ ID NO: 8681 - RNA, 20 nt, Artificial Sequence
  MKO10008681_A_Ccdc86
  gRNA
ugaggcggcccacgcuaaag

SEQ ID NO: 8682 - RNA, 20 nt, Artificial Sequence
  MKO10008682_A_Ccdc87
  gRNA
ggcggcacgaguaacugcca

SEQ ID NO: 8683 - RNA, 20 nt, Artificial Sequence
  MKO10008683_A_Ccdc87
  gRNA
uaaccucagugagacgaagu

SEQ ID NO: 8684 - RNA, 20 nt, Artificial Sequence
  MKO10008684_A_Ccdc87
  gRNA
cccgcugcuugcuagccgcu

SEQ ID NO: 8685 - RNA, 20 nt, Artificial Sequence
  MKO10008685_A_Ccdc88a
  gRNA
acucguugacucuccgacuu

SEQ ID NO: 8686 - RNA, 20 nt, Artificial Sequence
  MKO10008686_A_Ccdc88a
  gRNA
cuguucuagguuaaaacguu

SEQ ID NO: 8687 - RNA, 20 nt, Artificial Sequence
  MKO10008687_A_Ccdc88a
  gRNA
cuuacauuuggagcaugacc

SEQ ID NO: 8688 - RNA, 20 nt, Artificial Sequence
  MKO10008688_A_Ccdc88b
  gRNA
gucgcccccauagaugacag

SEQ ID NO: 8689 - RNA, 20 nt, Artificial Sequence
  MKO10008689_A_Ccdc88b
  gRNA
aggcuccaucgaucagccgc

SEQ ID NO: 8690 - RNA, 20 nt, Artificial Sequence
  MKO10008690_A_Ccdc88b
  gRNA
ucgauggagccuuacuccuu

SEQ ID NO: 8691 - RNA, 20 nt, Artificial Sequence
  MKO10008691_A_Ccdc88c
  gRNA
aucguuuggaagcggccacc

SEQ ID NO: 8692 - RNA, 20 nt, Artificial Sequence
  MKO10008692_A_Ccdc88c
  gRNA
cuuguugaugcgcugauugc

SEQ ID NO: 8693 - RNA, 20 nt, Artificial Sequence
  MKO10008693_A_Ccdc88c
  gRNA
uccccgcaggugaaaacuuu

SEQ ID NO: 8694 - RNA, 20 nt, Artificial Sequence
  MKO10008694_A_Ccdc89
  gRNA
gaguucgcgagcuucagcgc

SEQ ID NO: 8695 - RNA, 20 nt, Artificial Sequence
  MKO10008695_A_Ccdc89
  gRNA
gagcgcgucuaugccgcagg

SEQ ID NO: 8696 - RNA, 20 nt, Artificial Sequence
  MKO10008696_A_Ccdc89
  gRNA
ccucgucggaucugcguuuc

SEQ ID NO: 8697 - RNA, 20 nt, Artificial Sequence
  MKO10008697_A_Ccdc8
  gRNA
uggaggccuuccuccgccgu

SEQ ID NO: 8698 - RNA, 20 nt, Artificial Sequence
  MKO10008698_A_Ccdc8
  gRNA
uaucaucguccgagcuggcu

SEQ ID NO: 8699 - RNA, 20 nt, Artificial Sequence
  MKO10008699_A_Ccdc8
  gRNA
ccuacaaccagccgaagugg

SEQ ID NO: 8700 - RNA, 20 nt, Artificial Sequence
  MKO10008700_A_Ccdc90b
  gRNA
cugucacccgcccugcggag

SEQ ID NO: 8701 - RNA, 20 nt, Artificial Sequence
  MKO10008701_A_Ccdc90b
  gRNA
uacgcuaucaaacgucagcc

SEQ ID NO: 8702 - RNA, 20 nt, Artificial Sequence
  MKO10008702_A_Ccdc90b
  gRNA
ccgagacuaugaggagccgc

SEQ ID NO: 8703 - RNA, 20 nt, Artificial Sequence
  MKO10008703_A_Ccdc91
  gRNA
uuaacggaugagccgagcca

SEQ ID NO: 8704 - RNA, 20 nt, Artificial Sequence
  MKO10008704_A_Ccdc91
  gRNA
ggcucauccguuaaaccaag

SEQ ID NO: 8705 - RNA, 20 nt, Artificial Sequence
  MKO10008705_A_Ccdc91
  gRNA
ugcaugcguaucaucugcug

SEQ ID NO: 8706 - RNA, 20 nt, Artificial Sequence
  MKO10008706_A_Ccdc92
  gRNA
gccucagaucguagcgccac

SEQ ID NO: 8707 - RNA, 20 nt, Artificial Sequence
  MKO10008707_A_Ccdc92
  gRNA
accccaacaugcgucuugug

SEQ ID NO: 8708 - RNA, 20 nt, Artificial Sequence
  MKO10008708_A_Ccdc92
  gRNA
cucaaaaguuucgaacugac

SEQ ID NO: 8709 - RNA, 20 nt, Artificial Sequence
  MKO10008709_A_Ccdc93
  gRNA
cuggaucaugggguuaccca

SEQ ID NO: 8710 - RNA, 20 nt, Artificial Sequence
  MKO10008710_A_Ccdc93
  gRNA
ccacauauucccugucgugc

SEQ ID NO: 8711 - RNA, 20 nt, Artificial Sequence
  MKO10008711_A_Ccdc93
  gRNA
cuuucucuuaccuugucgaa

SEQ ID NO: 8712 - RNA, 20 nt, Artificial Sequence
  MKO10008712_A_Ccdc94
  gRNA
aguccagaacgaggcuuacc

SEQ ID NO: 8713 - RNA, 20 nt, Artificial Sequence
  MKO10008713_A_Ccdc94
  gRNA
aguccacaugcgccugccgc

SEQ ID NO: 8714 - RNA, 20 nt, Artificial Sequence
  MKO10008714_A_Ccdc94
  gRNA
ggcccagguaagccucguuc

SEQ ID NO: 8715 - RNA, 20 nt, Artificial Sequence
  MKO10008715_A_Ccdc96
  gRNA
ccuggcgcccaccacgcgug

SEQ ID NO: 8716 - RNA, 20 nt, Artificial Sequence
  MKO10008716_A_Ccdc96
  gRNA
cuugaucucgagcgacugcc

SEQ ID NO: 8717 - RNA, 20 nt, Artificial Sequence
  MKO10008717_A_Ccdc96
  gRNA
gcaagcauacuugcgcuauc

SEQ ID NO: 8718 - RNA, 20 nt, Artificial Sequence
  MKO10008718_A_Ccdc97
  gRNA
cagcauaacgccgguuacgc

SEQ ID NO: 8719 - RNA, 20 nt, Artificial Sequence
  MKO10008719_A_Ccdc97
  gRNA
ugcgcacccgccugcguaac

SEQ ID NO: 8720 - RNA, 20 nt, Artificial Sequence
  MKO10008720_A_Ccdc97
  gRNA
agagaggcugauccuucgcg

SEQ ID NO: 8721 - RNA, 20 nt, Artificial Sequence
  MKO10008721_A_Ccdc9
  gRNA
gcuagggcaccugguagcgc

SEQ ID NO: 8722 - RNA, 20 nt, Artificial Sequence
  MKO10008722_A_Ccdc9
  gRNA
uaccuuagacuuucgaucag

SEQ ID NO: 8723 - RNA, 20 nt, Artificial Sequence
  MKO10008723_A_Ccdc9
  gRNA
augcccggccuacgccugcc

SEQ ID NO: 8724 - RNA, 20 nt, Artificial Sequence
  MKO10008724_A_Ccer1
  gRNA
aaucuucuucgacgccgcug

SEQ ID NO: 8725 - RNA, 20 nt, Artificial Sequence
  MKO10008725_A_Ccer1
  gRNA
uccaagcggcgauaccguga

SEQ ID NO: 8726 - RNA, 20 nt, Artificial Sequence
  MKO10008726_A_Ccer1
  gRNA
ccucccuuucguugaccguc

SEQ ID NO: 8727 - RNA, 20 nt, Artificial Sequence
  MKO10008727_A_Cchcr1
  gRNA
cgagggccugcgcaccgccu

SEQ ID NO: 8728 - RNA, 20 nt, Artificial Sequence
  MKO10008728_A_Cchcr1
  gRNA
cuggccggagauuggaccaa

SEQ ID NO: 8729 - RNA, 20 nt, Artificial Sequence
  MKO10008729_A_Cchcr1
  gRNA
cacggcagcuccaagaguug

SEQ ID NO: 8730 - RNA, 20 nt, Artificial Sequence
  MKO10008730_A_Ccin
  gRNA
gggccggugguugaauucga

SEQ ID NO: 8731 - RNA, 20 nt, Artificial Sequence
  MKO10008731_A_Ccin
  gRNA
cgcggcgaauagacuuaaua

SEQ ID NO: 8732 - RNA, 20 nt, Artificial Sequence
  MKO10008732_A_Ccin
  gRNA
cguuacaucuacauauccgg

SEQ ID NO: 8733 - RNA, 20 nt, Artificial Sequence
  MKO10008733_A_Cckar
  gRNA
agcggcacauguucgccguc

SEQ ID NO: 8734 - RNA, 20 nt, Artificial Sequence
  MKO10008734_A_Cckar
  gRNA
uuugccagacgcgggauugu

SEQ ID NO: 8735 - RNA, 20 nt, Artificial Sequence
  MKO10008735_A_Cckar
  gRNA
ucacgcgcuucuuggcgauc

SEQ ID NO: 8736 - RNA, 20 nt, Artificial Sequence
  MKO10008736_A_Cckbr
  gRNA
caugcaccgccgauuccgcc

SEQ ID NO: 8737 - RNA, 20 nt, Artificial Sequence
  MKO10008737_A_Cckbr
  gRNA
aucgaaggcacgccacgugu

SEQ ID NO: 8738 - RNA, 20 nt, Artificial Sequence
  MKO10008738_A_Cckbr
  gRNA
gauggccgcgagauuuagag

SEQ ID NO: 8739 - RNA, 20 nt, Artificial Sequence
  MKO10008739_A_Cck
  gRNA
aucgcgcuagcagugcgccc

SEQ ID NO: 8740 - RNA, 20 nt, Artificial Sequence
  MKO10008740_A_Cck
  gRNA
ccuuaccuuugcggaccugc

SEQ ID NO: 8741 - RNA, 20 nt, Artificial Sequence
  MKO10008741_A_Cck
  gRNA
cgauggguauucguaguccu

SEQ ID NO: 8742 - RNA, 20 nt, Artificial Sequence
  MKO10008742_A_Ccl11
  gRNA
acagaucucuuugcccaacc

SEQ ID NO: 8743 - RNA, 20 nt, Artificial Sequence
  MKO10008743_A_Ccl11
  gRNA
guagcucuucaguagugugu

SEQ ID NO: 8744 - RNA, 20 nt, Artificial Sequence
  MKO10008744_A_Ccl11
  gRNA
cuacucacacuauggcuuuc

SEQ ID NO: 8745 - RNA, 20 nt, Artificial Sequence
  MKO10008745_A_Ccl12
  gRNA
uuaagcagaagauucacguc

SEQ ID NO: 8746 - RNA, 20 nt, Artificial Sequence
  MKO10008746_A_Ccl12
  gRNA
uuugagacgucuuauccaag

SEQ ID NO: 8747 - RNA, 20 nt, Artificial Sequence
  MKO10008747_A_Ccl12
  gRNA
acagaucuccuuauccagua

SEQ ID NO: 8748 - RNA, 20 nt, Artificial Sequence
  MKO10008748_A_Ccl17
  gRNA
gcacucucggccuacauugg

SEQ ID NO: 8749 - RNA, 20 nt, Artificial Sequence
  MKO10008749_A_Ccl17
  gRNA
uggccccuuugaaguaaucc

SEQ ID NO: 8750 - RNA, 20 nt, Artificial Sequence
  MKO10008750_A_Ccl17
  gRNA
gucacuucagaugcugcucc

SEQ ID NO: 8751 - RNA, 20 nt, Artificial Sequence
  MKO10008751_A_Ccl19
  gRNA
cccccgugugaccccacucc

SEQ ID NO: 8752 - RNA, 20 nt, Artificial Sequence
  MKO10008752_A_Ccl19
  gRNA
ggaagguccagagaaccagc

SEQ ID NO: 8753 - RNA, 20 nt, Artificial Sequence
  MKO10008753_A_Ccl19
  gRNA
uccuaucucagccccaacuc

SEQ ID NO: 8754 - RNA, 20 nt, Artificial Sequence
  MKO10008754_A_Ccl1
  gRNA
gcgccucaacuaacaaaacg

SEQ ID NO: 8755 - RNA, 20 nt, Artificial Sequence
  MKO10008755_A_Ccl1
  gRNA
agcagggguucaccuucuuc

SEQ ID NO: 8756 - RNA, 20 nt, Artificial Sequence
  MKO10008756_A_Ccl1
  gRNA
caccaugaaacccacugcca

SEQ ID NO: 8757 - RNA, 20 nt, Artificial Sequence
  MKO10008757_A_Ccl20
  gRNA
gaggcgucuguauguacgag

SEQ ID NO: 8758 - RNA, 20 nt, Artificial Sequence
  MKO10008758_A_Ccl20
  gRNA
gagcagacgcuugccaccgc

SEQ ID NO: 8759 - RNA, 20 nt, Artificial Sequence
  MKO10008759_A_Ccl20
  gRNA
gcgcugauccaaagcagaac

SEQ ID NO: 8760 - RNA, 20 nt, Artificial Sequence
  MKO10008760_A_Ccl21a
  gRNA
gacucugagccuccuuagcc

SEQ ID NO: 8761 - RNA, 20 nt, Artificial Sequence
  MKO10008761_A_Ccl21a
  gRNA
cuccuugguaccuugggucc

SEQ ID NO: 8762 - RNA, 20 nt, Artificial Sequence
  MKO10008762_A_Ccl21a
  gRNA
uaccuugcaggcagugaugg

SEQ ID NO: 8763 - RNA, 20 nt, Artificial Sequence
  MKO10008763_A_Ccl21b
  gRNA
cuccuugguaccuugggucc

SEQ ID NO: 8764 - RNA, 20 nt, Artificial Sequence
  MKO10008764_A_Ccl21b
  gRNA
gacucugagccuccuuagcc

SEQ ID NO: 8765 - RNA, 20 nt, Artificial Sequence
  MKO10008765_A_Ccl21b
  gRNA
agcgcacucacaggauugcc

SEQ ID NO: 8766 - RNA, 20 nt, Artificial Sequence
  MKO10008766_A_Ccl22
  gRNA
gagauaucugugccgauccc

SEQ ID NO: 8767 - RNA, 20 nt, Artificial Sequence
  MKO10008767_A_Ccl22
  gRNA
uacccugcgugucccacucc

SEQ ID NO: 8768 - RNA, 20 nt, Artificial Sequence
  MKO10008768_A_Ccl22
  gRNA
gagggugacggauguagucc

SEQ ID NO: 8769 - RNA, 20 nt, Artificial Sequence
  MKO10008769_A_Ccl24
  gRNA
ggcucugcuacgaucguugc

SEQ ID NO: 8770 - RNA, 20 nt, Artificial Sequence
  MKO10008770_A_Ccl24
  gRNA
ggggaagaugcaacacgcgc

SEQ ID NO: 8771 - RNA, 20 nt, Artificial Sequence
  MKO10008771_A_Ccl24
  gRNA
agaugcugccguuggccaac

SEQ ID NO: 8772 - RNA, 20 nt, Artificial Sequence
  MKO10008772_A_Ccl25
  gRNA
accccaacaguacaagcgug

SEQ ID NO: 8773 - RNA, 20 nt, Artificial Sequence
  MKO10008773_A_Ccl25
  gRNA
guccacuggaagagcgccuc

SEQ ID NO: 8774 - RNA, 20 nt, Artificial Sequence
  MKO10008774_A_Ccl25
  gRNA
gcugcaaccuacgugcugug

SEQ ID NO: 8775 - RNA, 20 nt, Artificial Sequence
  MKO10008775_A_Ccl26
  gRNA
uacauguggcaacaccaagc

SEQ ID NO: 8776 - RNA, 20 nt, Artificial Sequence
  MKO10008776_A_Ccl26
  gRNA
gcagggucacaaaugguucc

SEQ ID NO: 8777 - RNA, 20 nt, Artificial Sequence
  MKO10008777_A_Ccl26
  gRNA
cacucacaucacaccgucac

SEQ ID NO: 8778 - RNA, 20 nt, Artificial Sequence
  MKO10008778_A_Ccl27a
  gRNA
ugucuuugcaggaucuacug

SEQ ID NO: 8779 - RNA, 20 nt, Artificial Sequence
  MKO10008779_A_Ccl27a
  gRNA
cugcgccacauucgcagcca

SEQ ID NO: 8780 - RNA, 20 nt, Artificial Sequence
  MKO10008780_A_Ccl27a
  gRNA
ccuacagcucggcgcacccc

SEQ ID NO: 8781 - RNA, 20 nt, Artificial Sequence
  MKO10008781_A_Ccl27b
  gRNA
aacuuaccugcuucaggagc

SEQ ID NO: 8782 - RNA, 20 nt, Artificial Sequence
  MKO10008782_A_Ccl27b
  gRNA
gcugagugagcaugauggag

SEQ ID NO: 8783 - RNA, 20 nt, Artificial Sequence
  MKO10008783_A_Ccl27b
  gRNA
gcagagcucacacgacagcc

SEQ ID NO: 8784 - RNA, 20 nt, Artificial Sequence
  MKO10008784_A_Ccl28
  gRNA
ugcuucaaaguacgauugug

SEQ ID NO: 8785 - RNA, 20 nt, Artificial Sequence
  MKO10008785_A_Ccl28
  gRNA
acaaucguacuuugaagcag

SEQ ID NO: 8786 - RNA, 20 nt, Artificial Sequence
  MKO10008786_A_Ccl28
  gRNA
ucuuguagccauacuuccca

SEQ ID NO: 8787 - RNA, 20 nt, Artificial Sequence
  MKO10008787_A_Ccl2
  gRNA
aucucauuugguuccgaucc

SEQ ID NO: 8788 - RNA, 20 nt, Artificial Sequence
  MKO10008788_A_Ccl2
  gRNA
ugcuguucacaguugccggc

SEQ ID NO: 8789 - RNA, 20 nt, Artificial Sequence
  MKO10008789_A_Ccl2
  gRNA
agccggcaacugugaacagc

SEQ ID NO: 8790 - RNA, 20 nt, Artificial Sequence
  MKO10008790_A_Ccl3
  gRNA
caaaauagucaacgaugaau

SEQ ID NO: 8791 - RNA, 20 nt, Artificial Sequence
  MKO10008791_A_Ccl3
  gRNA
gaacuuacaugacaccuggc

SEQ ID NO: 8792 - RNA, 20 nt, Artificial Sequence
  MKO10008792_A_Ccl3
  gRNA
gcgcugacuccaaagagacc

SEQ ID NO: 8793 - RNA, 20 nt, Artificial Sequence
  MKO10008793_A_Ccl4
  gRNA
gugcuaaccccagugagccc

SEQ ID NO: 8794 - RNA, 20 nt, Artificial Sequence
  MKO10008794_A_Ccl4
  gRNA
gcuguuucucuuacaccucc

SEQ ID NO: 8795 - RNA, 20 nt, Artificial Sequence
  MKO10008795_A_Ccl4
  gRNA
uacagauuccugaccaaaag

SEQ ID NO: 8796 - RNA, 20 nt, Artificial Sequence
  MKO10008796_A_Ccl5
  gRNA
gacucacacgacugcaagau

SEQ ID NO: 8797 - RNA, 20 nt, Artificial Sequence
  MKO10008797_A_Ccl5
  gRNA
uguagaaauacuccuugacg

SEQ ID NO: 8798 - RNA, 20 nt, Artificial Sequence
  MKO10008798_A_Ccl5
  gRNA
ccugcagguuugucacucga

SEQ ID NO: 8799 - RNA, 20 nt, Artificial Sequence
  MKO10008799_A_Ccl6
  gRNA
ucugugccgaccccagcgau

SEQ ID NO: 8800 - RNA, 20 nt, Artificial Sequence
  MKO10008800_A_Ccl6
  gRNA
ccucugaacucuccgaucgc

SEQ ID NO: 8801 - RNA, 20 nt, Artificial Sequence
  MKO10008801_A_Ccl6
  gRNA
cggcuugaugcacccaccac

SEQ ID NO: 8802 - RNA, 20 nt, Artificial Sequence
  MKO10008802_A_Ccl7
  gRNA
gcgcugaagcccaucagaag

SEQ ID NO: 8803 - RNA, 20 nt, Artificial Sequence
  MKO10008803_A_Ccl7
  gRNA
caccugguugggcccacacu

SEQ ID NO: 8804 - RNA, 20 nt, Artificial Sequence
  MKO10008804_A_Ccl7
  gRNA
guagcucuugagauuccucu

SEQ ID NO: 8805 - RNA, 20 nt, Artificial Sequence
  MKO10008805_A_Ccl8
  gRNA
uaaagcugaagaucccccuu

SEQ ID NO: 8806 - RNA, 20 nt, Artificial Sequence
  MKO10008806_A_Ccl8
  gRNA
caacaauauccagugcccca

SEQ ID NO: 8807 - RNA, 20 nt, Artificial Sequence
  MKO10008807_A_Ccl8
  gRNA
gucagcccagagaagcugac

SEQ ID NO: 8808 - RNA, 20 nt, Artificial Sequence
  MKO10008808_A_Ccl9
  gRNA
cacuuacaugaugcccggcc

SEQ ID NO: 8809 - RNA, 20 nt, Artificial Sequence
  MKO10008809_A_Ccl9
  gRNA
ccaccagugguggguguacc

SEQ ID NO: 8810 - RNA, 20 nt, Artificial Sequence
  MKO10008810_A_Ccl9
  gRNA
aggacucaccaugugugauc

SEQ ID NO: 8811 - RNA, 20 nt, Artificial Sequence
  MKO10008811_A_Ccm2l
  gRNA
ggaucgcgacccgaaccucc

SEQ ID NO: 8812 - RNA, 20 nt, Artificial Sequence
  MKO10008812_A_Ccm2l
  gRNA
ggagguucgggucgcgaucc

SEQ ID NO: 8813 - RNA, 20 nt, Artificial Sequence
  MKO10008813_A_Ccm2l
  gRNA
gcagcagcaaucucgugcgu

SEQ ID NO: 8814 - RNA, 20 nt, Artificial Sequence
  MKO10008814_A_Ccm2
  gRNA
ccguccuacuggaaggguuc

SEQ ID NO: 8815 - RNA, 20 nt, Artificial Sequence
  MKO10008815_A_Ccm2
  gRNA
ggaguccaccaucgacuuuc

SEQ ID NO: 8816 - RNA, 20 nt, Artificial Sequence
  MKO10008816_A_Ccm2
  gRNA
ggucaguuaacauccauucc

SEQ ID NO: 8817 - RNA, 20 nt, Artificial Sequence
  MKO10008817_A_Ccna1
  gRNA
agagauauauccgcccgacg

SEQ ID NO: 8818 - RNA, 20 nt, Artificial Sequence
  MKO10008818_A_Ccna1
  gRNA
ucgcuuuguguacguaucgu

SEQ ID NO: 8819 - RNA, 20 nt, Artificial Sequence
  MKO10008819_A_Ccna1
  gRNA
cgcaugcccuccgugauguc

SEQ ID NO: 8820 - RNA, 20 nt, Artificial Sequence
  MKO10008820_A_Ccna2
  gRNA
aagacauucacacguaccuu

SEQ ID NO: 8821 - RNA, 20 nt, Artificial Sequence
  MKO10008821_A_Ccna2
  gRNA
gugacaugcucaucguuuau

SEQ ID NO: 8822 - RNA, 20 nt, Artificial Sequence
  MKO10008822_A_Ccna2
  gRNA
gacaccucuugacuauccaa

SEQ ID NO: 8823 - RNA, 20 nt, Artificial Sequence
  MKO10008823_A_Ccnb1ip1
  gRNA
gcucccgggcauuggccuuc

SEQ ID NO: 8824 - RNA, 20 nt, Artificial Sequence
  MKO10008824_A_Ccnb1ip1
  gRNA
acucuugauagagacgcucc

SEQ ID NO: 8825 - RNA, 20 nt, Artificial Sequence
  MKO10008825_A_Ccnb1ip1
  gRNA
ccagguaugaucccgcaguc

SEQ ID NO: 8826 - RNA, 20 nt, Artificial Sequence
  MKO10008826_A_Ccnb1
  gRNA
aaguuuaccaaaauagguuc

SEQ ID NO: 8827 - RNA, 20 nt, Artificial Sequence
  MKO10008827_A_Ccnb1
  gRNA
caauacugaccuccaguugu

SEQ ID NO: 8828 - RNA, 20 nt, Artificial Sequence
  MKO10008828_A_Ccnb1
  gRNA
ccacaggaagcaaaaacgcu

SEQ ID NO: 8829 - RNA, 20 nt, Artificial Sequence
  MKO10008829_A_Ccnb2
  gRNA
uggacguaugcgugccaucc

SEQ ID NO: 8830 - RNA, 20 nt, Artificial Sequence
  MKO10008830_A_Ccnb2
  gRNA
ggaucguccucccgccccug

SEQ ID NO: 8831 - RNA, 20 nt, Artificial Sequence
  MKO10008831_A_Ccnb2
  gRNA
gcuagcgccuccaucugcac

SEQ ID NO: 8832 - RNA, 20 nt, Artificial Sequence
  MKO10008832_A_Ccnb3
  gRNA
ugacaagaacuucuucucgc

SEQ ID NO: 8833 - RNA, 20 nt, Artificial Sequence
  MKO10008833_A_Ccnb3
  gRNA
ccaaagaagcauaucagucc

SEQ ID NO: 8834 - RNA, 20 nt, Artificial Sequence
  MKO10008834_A_Ccnb3
  gRNA
ggagaagccacuaaccuugc

SEQ ID NO: 8835 - RNA, 20 nt, Artificial Sequence
  MKO10008835_A_Ccnc
  gRNA
ucuguugaaagagcgccaaa

SEQ ID NO: 8836 - RNA, 20 nt, Artificial Sequence
  MKO10008836_A_Ccnc
  gRNA
aaguauagauccuguauuaa

SEQ ID NO: 8837 - RNA, 20 nt, Artificial Sequence
  MKO10008837_A_Ccnc
  gRNA
auuucaagagauucuaugcu

SEQ ID NO: 8838 - RNA, 20 nt, Artificial Sequence
  MKO10008838_A_Ccnd1
  gRNA
ccuuggggucgacguucugc

SEQ ID NO: 8839 - RNA, 20 nt, Artificial Sequence
  MKO10008839_A_Ccnd1
  gRNA
gcccaccgacgugcgagaug

SEQ ID NO: 8840 - RNA, 20 nt, Artificial Sequence
  MKO10008840_A_Ccnd1
  gRNA
aaagugcguugugcgguagc

SEQ ID NO: 8841 - RNA, 20 nt, Artificial Sequence
  MKO10008841_A_Ccnd2
  gRNA
ccgccgucgaugauugcaac

SEQ ID NO: 8842 - RNA, 20 nt, Artificial Sequence
  MKO10008842_A_Ccnd2
  gRNA
uucaucgcucugugcgcuac

SEQ ID NO: 8843 - RNA, 20 nt, Artificial Sequence
  MKO10008843_A_Ccnd2
  gRNA
cgucaagagcagcauaacgc

SEQ ID NO: 8844 - RNA, 20 nt, Artificial Sequence
  MKO10008844_A_Ccnd3
  gRNA
agguaccgucugccuguugc

SEQ ID NO: 8845 - RNA, 20 nt, Artificial Sequence
  MKO10008845_A_Ccnd3
  gRNA
gcacgcacccgcaacugcca

SEQ ID NO: 8846 - RNA, 20 nt, Artificial Sequence
  MKO10008846_A_Ccnd3
  gRNA
agcauuggggcagccgugcu

SEQ ID NO: 8847 - RNA, 20 nt, Artificial Sequence
  MKO10008847_A_Ccndbp1
  gRNA
gcaaguccguauugccaucg

SEQ ID NO: 8848 - RNA, 20 nt, Artificial Sequence
  MKO10008848_A_Ccndbp1
  gRNA
uccucaagucggcgaagccc

SEQ ID NO: 8849 - RNA, 20 nt, Artificial Sequence
  MKO10008849_A_Ccndbp1
  gRNA
cauuccguaccagcuuucuc

SEQ ID NO: 8850 - RNA, 20 nt, Artificial Sequence
  MKO10008850_A_Ccne1
  gRNA
ggaugauaauucagcaugcg

SEQ ID NO: 8851 - RNA, 20 nt, Artificial Sequence
  MKO10008851_A_Ccne1
  gRNA
acaaugagcuugaauacccc

SEQ ID NO: 8852 - RNA, 20 nt, Artificial Sequence
  MKO10008852_A_Ccne1
  gRNA
uuucacagucuugucaaucu

SEQ ID NO: 8853 - RNA, 20 nt, Artificial Sequence
  MKO10008853_A_Ccne2
  gRNA
ugaagagaaugucaagacgc

SEQ ID NO: 8854 - RNA, 20 nt, Artificial Sequence
  MKO10008854_A_Ccne2
  gRNA
cugauuccuccagacaguac

SEQ ID NO: 8855 - RNA, 20 nt, Artificial Sequence
  MKO10008855_A_Ccne2
  gRNA
ccucaccucugccagauuua

SEQ ID NO: 8856 - RNA, 20 nt, Artificial Sequence
  MKO10008856_A_Ccnf
  gRNA
ggcucuucauccgcccaccg

SEQ ID NO: 8857 - RNA, 20 nt, Artificial Sequence
  MKO10008857_A_Ccnf
  gRNA
cgcagaagugaacggcuuga

SEQ ID NO: 8858 - RNA, 20 nt, Artificial Sequence
  MKO10008858_A_Ccnf
  gRNA
acuuacggccuucauuguag

SEQ ID NO: 8859 - RNA, 20 nt, Artificial Sequence
  MKO10008859_A_Ccng1
  gRNA
acucuacguauuucagugcu

SEQ ID NO: 8860 - RNA, 20 nt, Artificial Sequence
  MKO10008860_A_Ccng1
  gRNA
ugauccgaauaagucaguau

SEQ ID NO: 8861 - RNA, 20 nt, Artificial Sequence
  MKO10008861_A_Ccng1
  gRNA
guggccgagauuugaccuuc

SEQ ID NO: 8862 - RNA, 20 nt, Artificial Sequence
  MKO10008862_A_Ccng2
  gRNA
ugugacaaaauacaaucgcg

SEQ ID NO: 8863 - RNA, 20 nt, Artificial Sequence
  MKO10008863_A_Ccng2
  gRNA
agcgucugacauuaaacgca

SEQ ID NO: 8864 - RNA, 20 nt, Artificial Sequence
  MKO10008864_A_Ccng2
  gRNA
gcugcgcuucgaguuuaucg

SEQ ID NO: 8865 - RNA, 20 nt, Artificial Sequence
  MKO10008865_A_Ccnh
  gRNA
cauacucacauuauuauccg

SEQ ID NO: 8866 - RNA, 20 nt, Artificial Sequence
  MKO10008866_A_Ccnh
  gRNA
gguuuaccuuuauaucgaug

SEQ ID NO: 8867 - RNA, 20 nt, Artificial Sequence
  MKO10008867_A_Ccnh
  gRNA
ucacuuaccacaacagaccg

SEQ ID NO: 8868 - RNA, 20 nt, Artificial Sequence
  MKO10008868_A_Ccni
  gRNA
uagcugacaccgcaauggca

SEQ ID NO: 8869 - RNA, 20 nt, Artificial Sequence
  MKO10008869_A_Ccni
  gRNA
ucuucacacggcuacaccau

SEQ ID NO: 8870 - RNA, 20 nt, Artificial Sequence
  MKO10008870_A_Ccni
  gRNA
caagcagcugcuucacugua

SEQ ID NO: 8871 - RNA, 20 nt, Artificial Sequence
  MKO10008871_A_Ccnjl
  gRNA
cacguguaucgaaauccugc

SEQ ID NO: 8872 - RNA, 20 nt, Artificial Sequence
  MKO10008872_A_Ccnjl
  gRNA
ggcauaucgggacucguugc

SEQ ID NO: 8873 - RNA, 20 nt, Artificial Sequence
  MKO10008873_A_Ccnjl
  gRNA
cguucagggggccugcucuc

SEQ ID NO: 8874 - RNA, 20 nt, Artificial Sequence
  MKO10008874_A_Ccnj
  gRNA
agucuguagcguguaagacg

SEQ ID NO: 8875 - RNA, 20 nt, Artificial Sequence
  MKO10008875_A_Ccnj
  gRNA
caaggcccugaacgcucguu

SEQ ID NO: 8876 - RNA, 20 nt, Artificial Sequence
  MKO10008876_A_Ccnj
  gRNA
ucuuggugcaguguaucgaa

SEQ ID NO: 8877 - RNA, 20 nt, Artificial Sequence
  MKO10008877_A_Ccnk
  gRNA
cgacagacacuaugacaccc

SEQ ID NO: 8878 - RNA, 20 nt, Artificial Sequence
  MKO10008878_A_Ccnk
  gRNA
aauaaaugauuccaguugcc

SEQ ID NO: 8879 - RNA, 20 nt, Artificial Sequence
  MKO10008879_A_Ccnk
  gRNA
ccuuugggucaucuccaaac

SEQ ID NO: 8880 - RNA, 20 nt, Artificial Sequence
  MKO10008880_A_Ccnl1
  gRNA
acuguguuugacgaacgacu

SEQ ID NO: 8881 - RNA, 20 nt, Artificial Sequence
  MKO10008881_A_Ccnl1
  gRNA
caccaccuccgccaguuaag

SEQ ID NO: 8882 - RNA, 20 nt, Artificial Sequence
  MKO10008882_A_Ccnl1
  gRNA
guucgucaaacacaguuucg

SEQ ID NO: 8883 - RNA, 20 nt, Artificial Sequence
  MKO10008883_A_Ccnl2
  gRNA
cuccauggaauguuucacga

SEQ ID NO: 8884 - RNA, 20 nt, Artificial Sequence
  MKO10008884_A_Ccnl2
  gRNA
augugagcguaaucaacacc

SEQ ID NO: 8885 - RNA, 20 nt, Artificial Sequence
  MKO10008885_A_Ccnl2
  gRNA
ucaauguauuccaucgccuu

SEQ ID NO: 8886 - RNA, 20 nt, Artificial Sequence
  MKO10008886_A_Ccno
  gRNA
gcugaacgcguguucgcucc

SEQ ID NO: 8887 - RNA, 20 nt, Artificial Sequence
  MKO10008887_A_Ccno
  gRNA
uagugaacgcguaauccguu

SEQ ID NO: 8888 - RNA, 20 nt, Artificial Sequence
  MKO10008888_A_Ccno
  gRNA
gggagaacgcaccgccgcac

SEQ ID NO: 8889 - RNA, 20 nt, Artificial Sequence
  MKO10008889_A_Ccnt1
  gRNA
aagugcacccagcuuguucg

SEQ ID NO: 8890 - RNA, 20 nt, Artificial Sequence
  MKO10008890_A_Ccnt1
  gRNA
guuacuuaccucgaacaagc

SEQ ID NO: 8891 - RNA, 20 nt, Artificial Sequence
  MKO10008891_A_Ccnt1
  gRNA
ccagaucuugaacuuguugu

SEQ ID NO: 8892 - RNA, 20 nt, Artificial Sequence
  MKO10008892_A_Ccnt2
  gRNA
accacucaccucuuacuaac

SEQ ID NO: 8893 - RNA, 20 nt, Artificial Sequence
  MKO10008893_A_Ccnt2
  gRNA
cugcgauuguuuauaugcac

SEQ ID NO: 8894 - RNA, 20 nt, Artificial Sequence
  MKO10008894_A_Ccnt2
  gRNA
aaaugcacccaguuaguaag

SEQ ID NO: 8895 - RNA, 20 nt, Artificial Sequence
  MKO10008895_A_Ccnyl1
  gRNA
uauucuuagugcgugaaaag

SEQ ID NO: 8896 - RNA, 20 nt, Artificial Sequence
  MKO10008896_A_Ccnyl1
  gRNA
augcucaccuguucuuuaug

SEQ ID NO: 8897 - RNA, 20 nt, Artificial Sequence
  MKO10008897_A_Ccnyl1
  gRNA
uauauuaccacauaaagaac

SEQ ID NO: 8898 - RNA, 20 nt, Artificial Sequence
  MKO10008898_A_Ccny
  gRNA
auauugugcuggcccgagga

SEQ ID NO: 8899 - RNA, 20 nt, Artificial Sequence
  MKO10008899_A_Ccny
  gRNA
ucaauccuucagaccauccu

SEQ ID NO: 8900 - RNA, 20 nt, Artificial Sequence
  MKO10008900_A_Ccny
  gRNA
accucaaguacaccaucaaa

SEQ ID NO: 8901 - RNA, 20 nt, Artificial Sequence
  MKO10008901_A_Ccp110
  gRNA
gaaugccuccgaugcaucgu

SEQ ID NO: 8902 - RNA, 20 nt, Artificial Sequence
  MKO10008902_A_Ccp110
  gRNA
guaugaguccuacgaugcau

SEQ ID NO: 8903 - RNA, 20 nt, Artificial Sequence
  MKO10008903_A_Ccp110
  gRNA
agccuuacugacucgugucc

SEQ ID NO: 8904 - RNA, 20 nt, Artificial Sequence
  MKO10008904_A_Ccpg1os
  gRNA
ucgccagacuucucgcuauc

SEQ ID NO: 8905 - RNA, 20 nt, Artificial Sequence
  MKO10008905_A_Ccpg1os
  gRNA
gucccguaaacuacaauuuc

SEQ ID NO: 8906 - RNA, 20 nt, Artificial Sequence
  MKO10008906_A_Ccpg1os
  gRNA
acuuagaaacuuauaccccc

SEQ ID NO: 8907 - RNA, 20 nt, Artificial Sequence
  MKO10008907_A_Ccpg1
  gRNA
cgcaaacaacacaucgucag

SEQ ID NO: 8908 - RNA, 20 nt, Artificial Sequence
  MKO10008908_A_Ccpg1
  gRNA
acaagaugagucgcugucgc

SEQ ID NO: 8909 - RNA, 20 nt, Artificial Sequence
  MKO10008909_A_Ccpg1
  gRNA
gcuccauaccggguucuggc

SEQ ID NO: 8910 - RNA, 20 nt, Artificial Sequence
  MKO10008910_A_Ccr10
  gRNA
aaaugagccgacagcgucgu

SEQ ID NO: 8911 - RNA, 20 nt, Artificial Sequence
  MKO10008911_A_Ccr10
  gRNA
aacgccuagccgagcgcacu

SEQ ID NO: 8912 - RNA, 20 nt, Artificial Sequence
  MKO10008912_A_Ccr10
  gRNA
ggggaccaagcccacagagc

SEQ ID NO: 8913 - RNA, 20 nt, Artificial Sequence
  MKO10008913_A_Ccr1l1
  gRNA
gguaucuaucaaucguaagc

SEQ ID NO: 8914 - RNA, 20 nt, Artificial Sequence
  MKO10008914_A_Ccr1l1
  gRNA
ucugaauuauaagucggcag

SEQ ID NO: 8915 - RNA, 20 nt, Artificial Sequence
  MKO10008915_A_Ccr1l1
  gRNA
aacgguuccggaaguaccuc

SEQ ID NO: 8916 - RNA, 20 nt, Artificial Sequence
  MKO10008916_A_Ccr1
  gRNA
acuacaaguugaaagacgac

SEQ ID NO: 8917 - RNA, 20 nt, Artificial Sequence
  MKO10008917_A_Ccr1
  gRNA
gguaucugucaaucgucaac

SEQ ID NO: 8918 - RNA, 20 nt, Artificial Sequence
  MKO10008918_A_Ccr1
  gRNA
uacggugagugaacucccac

SEQ ID NO: 8919 - RNA, 20 nt, Artificial Sequence
  MKO10008919_A_Ccr2
  gRNA
gagauguugauaguaugccg

SEQ ID NO: 8920 - RNA, 20 nt, Artificial Sequence
  MKO10008920_A_Ccr2
  gRNA
acaccguaugacuacgauga

SEQ ID NO: 8921 - RNA, 20 nt, Artificial Sequence
  MKO10008921_A_Ccr2
  gRNA
ucaccaucaucguagucaua

SEQ ID NO: 8922 - RNA, 20 nt, Artificial Sequence
  MKO10008922_A_Ccr3
  gRNA
ccaguaaucuacgccuuugu

SEQ ID NO: 8923 - RNA, 20 nt, Artificial Sequence
  MKO10008923_A_Ccr3
  gRNA
uggugcccacucauauucau

SEQ ID NO: 8924 - RNA, 20 nt, Artificial Sequence
  MKO10008924_A_Ccr3
  gRNA
ccacacccuaugaauaugag

SEQ ID NO: 8925 - RNA, 20 nt, Artificial Sequence
  MKO10008925_A_Ccr4
  gRNA
uguacggcguccagaagccg

SEQ ID NO: 8926 - RNA, 20 nt, Artificial Sequence
  MKO10008926_A_Ccr4
  gRNA
ucgucgaguugaccgaguac

SEQ ID NO: 8927 - RNA, 20 nt, Artificial Sequence
  MKO10008927_A_Ccr4
  gRNA
agugcgcaugaucuucgccg

SEQ ID NO: 8928 - RNA, 20 nt, Artificial Sequence
  MKO10008928_A_Ccr5
  gRNA
ucagucuauacccgauccac

SEQ ID NO: 8929 - RNA, 20 nt, Artificial Sequence
  MKO10008929_A_Ccr5
  gRNA
uauagcuaugacaucgauua

SEQ ID NO: 8930 - RNA, 20 nt, Artificial Sequence
  MKO10008930_A_Ccr5
  gRNA
uagacugagcuugcacgauc

SEQ ID NO: 8931 - RNA, 20 nt, Artificial Sequence
  MKO10008931_A_Ccr6
  gRNA
ucugagacagaccuguaccg

SEQ ID NO: 8932 - RNA, 20 nt, Artificial Sequence
  MKO10008932_A_Ccr6
  gRNA
agaaaguccucgccuacacc

SEQ ID NO: 8933 - RNA, 20 nt, Artificial Sequence
  MKO10008933_A_Ccr6
  gRNA
aauccgagucgugaucgcug

SEQ ID NO: 8934 - RNA, 20 nt, Artificial Sequence
  MKO10008934_A_Ccr7
  gRNA
ccgacgcguuccguacaugc

SEQ ID NO: 8935 - RNA, 20 nt, Artificial Sequence
  MKO10008935_A_Ccr7
  gRNA
gcggaacuugacgccgauga

SEQ ID NO: 8936 - RNA, 20 nt, Artificial Sequence
  MKO10008936_A_Ccr7
  gRNA
gaaacccaggaaaaacgugc

SEQ ID NO: 8937 - RNA, 20 nt, Artificial Sequence
  MKO10008937_A_Ccr8
  gRNA
uccuaugaacgcguagauga

SEQ ID NO: 8938 - RNA, 20 nt, Artificial Sequence
  MKO10008938_A_Ccr8
  gRNA
cccgucaucuacgcguucau

SEQ ID NO: 8939 - RNA, 20 nt, Artificial Sequence
  MKO10008939_A_Ccr8
  gRNA
ugccucgauggauuacacga

SEQ ID NO: 8940 - RNA, 20 nt, Artificial Sequence
  MKO10008940_A_Ccr9
  gRNA
augcaauagucugaguaacc

SEQ ID NO: 8941 - RNA, 20 nt, Artificial Sequence
  MKO10008941_A_Ccr9
  gRNA
cgagagauuccgaagggauc

SEQ ID NO: 8942 - RNA, 20 nt, Artificial Sequence
  MKO10008942_A_Ccr9
  gRNA
uauacucacugugaguucug

SEQ ID NO: 8943 - RNA, 20 nt, Artificial Sequence
  MKO10008943_A_Ccrl2
  gRNA
gcuaucagcaagcgccucca

SEQ ID NO: 8944 - RNA, 20 nt, Artificial Sequence
  MKO10008944_A_Ccrl2
  gRNA
ugccaaucgaagcgccgcuc

SEQ ID NO: 8945 - RNA, 20 nt, Artificial Sequence
  MKO10008945_A_Ccrl2
  gRNA
gaguccgacaagaacuuuac

SEQ ID NO: 8946 - RNA, 20 nt, Artificial Sequence
  MKO10008946_A_Ccrn4l
  gRNA
gcgccgaacgcucgccccgc

SEQ ID NO: 8947 - RNA, 20 nt, Artificial Sequence
  MKO10008947_A_Ccrn4l
  gRNA
guuccacugcaugacgcgaa

SEQ ID NO: 8948 - RNA, 20 nt, Artificial Sequence
  MKO10008948_A_Ccrn4l
  gRNA
ugaaguccccgcagacgauc

SEQ ID NO: 8949 - RNA, 20 nt, Artificial Sequence
  MKO10008949_A_Ccsap
  gRNA
ggcgcguauucgucccagcg

SEQ ID NO: 8950 - RNA, 20 nt, Artificial Sequence
  MKO10008950_A_Ccsap
  gRNA
gggcgcguuaggggagcccu

SEQ ID NO: 8951 - RNA, 20 nt, Artificial Sequence
  MKO10008951_A_Ccsap
  gRNA
gcgggcucacucgguggacg

SEQ ID NO: 8952 - RNA, 20 nt, Artificial Sequence
  MKO10008952_A_Ccser1
  gRNA
gauauauagagcggcggcug

SEQ ID NO: 8953 - RNA, 20 nt, Artificial Sequence
  MKO10008953_A_Ccser1
  gRNA
cagaauggucuuaaagccga

SEQ ID NO: 8954 - RNA, 20 nt, Artificial Sequence
  MKO10008954_A_Ccser1
  gRNA
gccauucagacugaugcucc

SEQ ID NO: 8955 - RNA, 20 nt, Artificial Sequence
  MKO10008955_A_Ccser2
  gRNA
cagaaauguacgacagucgc

SEQ ID NO: 8956 - RNA, 20 nt, Artificial Sequence
  MKO10008956_A_Ccser2
  gRNA
ugagaugacccuccggcaca

SEQ ID NO: 8957 - RNA, 20 nt, Artificial Sequence
  MKO10008957_A_Ccser2
  gRNA
gccggagggucaucucaucc

SEQ ID NO: 8958 - RNA, 20 nt, Artificial Sequence
  MKO10008958_A_Ccs
  gRNA
accuauugcagucccucgua

SEQ ID NO: 8959 - RNA, 20 nt, Artificial Sequence
  MKO10008959_A_Ccs
  gRNA
accaucgacggccuagagcc

SEQ ID NO: 8960 - RNA, 20 nt, Artificial Sequence
  MKO10008960_A_Ccs
  gRNA
cuuacccgaucaguguccug

SEQ ID NO: 8961 - RNA, 20 nt, Artificial Sequence
  MKO10008961_A_Ccu2
  gRNA
uguggacaaccccgcagcaa

SEQ ID NO: 8962 - RNA, 20 nt, Artificial Sequence
  MKO10008962_A_Ccu2
  gRNA
uaauuuaagucgucguuuau

SEQ ID NO: 8963 - RNA, 20 nt, Artificial Sequence
  MKO10008963_A_Ccu2
  gRNA
gcucugauggugaccaacga

SEQ ID NO: 8964 - RNA, 20 nt, Artificial Sequence
  MKO10008964_A_Ccu3
  gRNA
caaacacaccucucgaagaa

SEQ ID NO: 8965 - RNA, 20 nt, Artificial Sequence
  MKO10008965_A_Ccu3
  gRNA
cagaacacaaagcgugaauc

SEQ ID NO: 8966 - RNA, 20 nt, Artificial Sequence
  MKO10008966_A_Ccu3
  gRNA
gggaccuaaaucuaugauga

SEQ ID NO: 8967 - RNA, 20 nt, Artificial Sequence
  MKO10008967_A_Ccu4
  gRNA
agcaaugaugacaaccgacg

SEQ ID NO: 8968 - RNA, 20 nt, Artificial Sequence
  MKO10008968_A_Ccu4
  gRNA
acgucgguugucaucauugc

SEQ ID NO: 8969 - RNA, 20 nt, Artificial Sequence
  MKO10008969_A_Ccu4
  gRNA
gaugcuauuagaacaagccu

SEQ ID NO: 8970 - RNA, 20 nt, Artificial Sequence
  MKO10008970_A_Ccu5
  gRNA
cgccgugaaugccguccuca

SEQ ID NO: 8971 - RNA, 20 nt, Artificial Sequence
  MKO10008971_A_Ccu5
  gRNA
ccgaauugcaauacaacacc

SEQ ID NO: 8972 - RNA, 20 nt, Artificial Sequence
  MKO10008972_A_Ccu5
  gRNA
aggcaaaguaggugggcggc

SEQ ID NO: 8973 - RNA, 20 nt, Artificial Sequence
  MKO10008973_A_Ccu6a
  gRNA
ccauuuggcaggcuuguauc

SEQ ID NO: 8974 - RNA, 20 nt, Artificial Sequence
  MKO10008974_A_Ccu6a
  gRNA
ggcuguaguggacuccaucu

SEQ ID NO: 8975 - RNA, 20 nt, Artificial Sequence
  MKO10008975_A_Ccu6a
  gRNA
ugagcagcuccccgaugaug

SEQ ID NO: 8976 - RNA, 20 nt, Artificial Sequence
  MKO10008976_A_Ccu6b
  gRNA
cagcaugaacuuucgucugc

SEQ ID NO: 8977 - RNA, 20 nt, Artificial Sequence
  MKO10008977_A_Ccu6b
  gRNA
aagcaguacauugccgucuu

SEQ ID NO: 8978 - RNA, 20 nt, Artificial Sequence
  MKO10008978_A_Ccu6b
  gRNA
gacgaaaguucaugcugaac

SEQ ID NO: 8979 - RNA, 20 nt, Artificial Sequence
  MKO10008979_A_Ccu7
  gRNA
uuuccgcacagccacccaau

SEQ ID NO: 8980 - RNA, 20 nt, Artificial Sequence
  MKO10008980_A_Ccu7
  gRNA
agaaccacccuggguccccg

SEQ ID NO: 8981 - RNA, 20 nt, Artificial Sequence
  MKO10008981_A_Ccu7
  gRNA
guguaaaccuucuuccacgu

SEQ ID NO: 8982 - RNA, 20 nt, Artificial Sequence
  MKO10008982_A_Ccu8l1
  gRNA
gauucaagccaagucccgaa

SEQ ID NO: 8983 - RNA, 20 nt, Artificial Sequence
  MKO10008983_A_Ccu8l1
  gRNA
ggaagugccacaagguuuac

SEQ ID NO: 8984 - RNA, 20 nt, Artificial Sequence
  MKO10008984_A_Ccu8l1
  gRNA
gacaaucuccuuucgggacu

SEQ ID NO: 8985 - RNA, 20 nt, Artificial Sequence
  MKO10008985_A_Ccu8
  gRNA
cagacuacucgcacagcgua

SEQ ID NO: 8986 - RNA, 20 nt, Artificial Sequence
  MKO10008986_A_Ccu8
  gRNA
gcauuucucgggauuagaag

SEQ ID NO: 8987 - RNA, 20 nt, Artificial Sequence
  MKO10008987_A_Ccu8
  gRNA
ucaugguuuagguaauaucg

SEQ ID NO: 8988 - RNA, 20 nt, Artificial Sequence
  MKO10008988_A_Ccz1
  gRNA
uuacuuugcuucucgaugau

SEQ ID NO: 8989 - RNA, 20 nt, Artificial Sequence
  MKO10008989_A_Ccz1
  gRNA
ggcgguaguggaguaccaag

SEQ ID NO: 8990 - RNA, 20 nt, Artificial Sequence
  MKO10008990_A_Ccz1
  gRNA
gcagugcuacagcauguaca

SEQ ID NO: 8991 - RNA, 20 nt, Artificial Sequence
  MKO10008991_A_Cd101
  gRNA
uguggccggugauguacggc

SEQ ID NO: 8992 - RNA, 20 nt, Artificial Sequence
  MKO10008992_A_Cd101
  gRNA
cuuguccagccguacaucac

SEQ ID NO: 8993 - RNA, 20 nt, Artificial Sequence
  MKO10008993_A_Cd101
  gRNA
cugccgagcagcguacugug

SEQ ID NO: 8994 - RNA, 20 nt, Artificial Sequence
  MKO10008994_A_Cd109
  gRNA
acucuuuaggucccgcuuuc

SEQ ID NO: 8995 - RNA, 20 nt, Artificial Sequence
  MKO10008995_A_Cd109
  gRNA
augagaucguauucuccaac

SEQ ID NO: 8996 - RNA, 20 nt, Artificial Sequence
  MKO10008996_A_Cd109
  gRNA
uuucaagacucucguucuuc

SEQ ID NO: 8997 - RNA, 20 nt, Artificial Sequence
  MKO10008997_A_Cd14
  gRNA
cguuacgcagcgcuaaaacu

SEQ ID NO: 8998 - RNA, 20 nt, Artificial Sequence
  MKO10008998_A_Cd14
  gRNA
gggccgcgcggauuccuagu

SEQ ID NO: 8999 - RNA, 20 nt, Artificial Sequence
  MKO10008999_A_Cd14
  gRNA
gaagacgcggaccuguucgc

SEQ ID NO: 9000 - RNA, 20 nt, Artificial Sequence
  MKO10009000_A_Cd151
  gRNA
ccccacugaccaagcguaac

SEQ ID NO: 9001 - RNA, 20 nt, Artificial Sequence
  MKO10009001_A_Cd151
  gRNA
gcgacggaaccuguuacgcu

SEQ ID NO: 9002 - RNA, 20 nt, Artificial Sequence
  MKO10009002_A_Cd151
  gRNA
ggccuaugucuauuaucagc

SEQ ID NO: 9003 - RNA, 20 nt, Artificial Sequence
  MKO10009003_A_Cd160
  gRNA
uucaggcuuccugcaaguaa

SEQ ID NO: 9004 - RNA, 20 nt, Artificial Sequence
  MKO10009004_A_Cd160
  gRNA
aacccuaagcuguucuaagu

SEQ ID NO: 9005 - RNA, 20 nt, Artificial Sequence
  MKO10009005_A_Cd160
  gRNA
aacugagagugccguugaua

SEQ ID NO: 9006 - RNA, 20 nt, Artificial Sequence
  MKO10009006_A_Cd163l1
  gRNA
guggugcugguucgacacca

SEQ ID NO: 9007 - RNA, 20 nt, Artificial Sequence
  MKO10009007_A_Cd163l1
  gRNA
ccaggccccccgucaagaug

SEQ ID NO: 9008 - RNA, 20 nt, Artificial Sequence
  MKO10009008_A_Cd163l1
  gRNA
ggcugcacaauguauccugu

SEQ ID NO: 9009 - RNA, 20 nt, Artificial Sequence
  MKO10009009_A_Cd163
  gRNA
accaaucuggcucgaugacc

SEQ ID NO: 9010 - RNA, 20 nt, Artificial Sequence
  MKO10009010_A_Cd163
  gRNA
gcacagugugcaguaacggc

SEQ ID NO: 9011 - RNA, 20 nt, Artificial Sequence
  MKO10009011_A_Cd163
  gRNA
cgcuggaguuagcccaucca

SEQ ID NO: 9012 - RNA, 20 nt, Artificial Sequence
  MKO10009012_A_Cd164l2
  gRNA
cccugcuccgccugaacguu

SEQ ID NO: 9013 - RNA, 20 nt, Artificial Sequence
  MKO10009013_A_Cd164l2
  gRNA
ccaaacguucaggcggagca

SEQ ID NO: 9014 - RNA, 20 nt, Artificial Sequence
  MKO10009014_A_Cd164l2
  gRNA
aagcuagcuccaucaaaacc

SEQ ID NO: 9015 - RNA, 20 nt, Artificial Sequence
  MKO10009015_A_Cd164
  gRNA
ccagugccaaccaauucuac

SEQ ID NO: 9016 - RNA, 20 nt, Artificial Sequence
  MKO10009016_A_Cd164
  gRNA
uuccagcuaagcccacaacu

SEQ ID NO: 9017 - RNA, 20 nt, Artificial Sequence
  MKO10009017_A_Cd164
  gRNA
acucccucaguugucacauc

SEQ ID NO: 9018 - RNA, 20 nt, Artificial Sequence
  MKO10009018_A_Cd177
  gRNA
auggcgacacacacgggugu

SEQ ID NO: 9019 - RNA, 20 nt, Artificial Sequence
  MKO10009019_A_Cd177
  gRNA
ucgccugggugccauuaagc

SEQ ID NO: 9020 - RNA, 20 nt, Artificial Sequence
  MKO10009020_A_Cd177
  gRNA
ggaagcacacacugcuacga

SEQ ID NO: 9021 - RNA, 20 nt, Artificial Sequence
  MKO10009021_A_Cd180
  gRNA
auguagaccugagucacaac

SEQ ID NO: 9022 - RNA, 20 nt, Artificial Sequence
  MKO10009022_A_Cd180
  gRNA
ugucacgcuauccuguagua

SEQ ID NO: 9023 - RNA, 20 nt, Artificial Sequence
  MKO10009023_A_Cd180
  gRNA
gagauugauaagucugcuga

SEQ ID NO: 9024 - RNA, 20 nt, Artificial Sequence
  MKO10009024_A_Cd19
  gRNA
gaccuucacgugccucucga

SEQ ID NO: 9025 - RNA, 20 nt, Artificial Sequence
  MKO10009025_A_Cd19
  gRNA
ugauucaaacugcucccccg

SEQ ID NO: 9026 - RNA, 20 nt, Artificial Sequence
  MKO10009026_A_Cd19
  gRNA
acagguagaagccccccaua

SEQ ID NO: 9027 - RNA, 20 nt, Artificial Sequence
  MKO10009027_A_Cd1d1
  gRNA
accugcccccuauuuguccg

SEQ ID NO: 9028 - RNA, 20 nt, Artificial Sequence
  MKO10009028_A_Cd1d1
  gRNA
cccgcacagacagcgugguc

SEQ ID NO: 9029 - RNA, 20 nt, Artificial Sequence
  MKO10009029_A_Cd1d1
  gRNA
gggaucugcagacucaccgu

SEQ ID NO: 9030 - RNA, 20 nt, Artificial Sequence
  MKO10009030_A_Cd1d2
  gRNA
uuucacagccgguagacaac

SEQ ID NO: 9031 - RNA, 20 nt, Artificial Sequence
  MKO10009031_A_Cd1d2
  gRNA
ggaccagcuuauguuagcaa

SEQ ID NO: 9032 - RNA, 20 nt, Artificial Sequence
  MKO10009032_A_Cd1d2
  gRNA
aaaauaugccgugagauucc

SEQ ID NO: 9033 - RNA, 20 nt, Artificial Sequence
  MKO10009033_A_Cd200r1
  gRNA
gaauauauggucguaaugau

SEQ ID NO: 9034 - RNA, 20 nt, Artificial Sequence
  MKO10009034_A_Cd200r1
  gRNA
uacuuuguaugcuauugugc

SEQ ID NO: 9035 - RNA, 20 nt, Artificial Sequence
  MKO10009035_A_Cd200r1
  gRNA
agaauauuaccuugugucag

SEQ ID NO: 9036 - RNA, 20 nt, Artificial Sequence
  MKO10009036_A_Cd200r2
  gRNA
aggccagccuuccugcauaa

SEQ ID NO: 9037 - RNA, 20 nt, Artificial Sequence
  MKO10009037_A_Cd200r2
  gRNA
gaccauucucuacgugaaaa

SEQ ID NO: 9038 - RNA, 20 nt, Artificial Sequence
  MKO10009038_A_Cd200r2
  gRNA
acuuuauggaaauucccuuc

SEQ ID NO: 9039 - RNA, 20 nt, Artificial Sequence
  MKO10009039_A_Cd200r3
  gRNA
aguaaugcccaucaugcuug

SEQ ID NO: 9040 - RNA, 20 nt, Artificial Sequence
  MKO10009040_A_Cd200r3
  gRNA
agacauagcauccaagugcc

SEQ ID NO: 9041 - RNA, 20 nt, Artificial Sequence
  MKO10009041_A_Cd200r3
  gRNA
agacucacucucaaucucca

SEQ ID NO: 9042 - RNA, 20 nt, Artificial Sequence
  MKO10009042_A_Cd200r4
  gRNA
ugcuuagucucucauucgac

SEQ ID NO: 9043 - RNA, 20 nt, Artificial Sequence
  MKO10009043_A_Cd200r4
  gRNA
gugauuauucuucuuaacgu

SEQ ID NO: 9044 - RNA, 20 nt, Artificial Sequence
  MKO10009044_A_Cd200r4
  gRNA
agucgaaugagagacuaagc

SEQ ID NO: 9045 - RNA, 20 nt, Artificial Sequence
  MKO10009045_A_Cd200
  gRNA
auucaccccgcuccugauuu

SEQ ID NO: 9046 - RNA, 20 nt, Artificial Sequence
  MKO10009046_A_Cd200
  gRNA
uguagucaaucacauucccc

SEQ ID NO: 9047 - RNA, 20 nt, Artificial Sequence
  MKO10009047_A_Cd200
  gRNA
augugucucuucaacacguu

SEQ ID NO: 9048 - RNA, 20 nt, Artificial Sequence
  MKO10009048_A_Cd207
  gRNA
acucacuuguuccgauucug

SEQ ID NO: 9049 - RNA, 20 nt, Artificial Sequence
  MKO10009049_A_Cd207
  gRNA
uuucacgcaccccaaagacc

SEQ ID NO: 9050 - RNA, 20 nt, Artificial Sequence
  MKO10009050_A_Cd207
  gRNA
ucugagaacgcacccucuug

SEQ ID NO: 9051 - RNA, 20 nt, Artificial Sequence
  MKO10009051_A_Cd209a
  gRNA
caccuacgccagccuucaac

SEQ ID NO: 9052 - RNA, 20 nt, Artificial Sequence
  MKO10009052_A_Cd209a
  gRNA
caaguugagcccccacauug

SEQ ID NO: 9053 - RNA, 20 nt, Artificial Sequence
  MKO10009053_A_Cd209a
  gRNA
gguccacagucaaguccccu

SEQ ID NO: 9054 - RNA, 20 nt, Artificial Sequence
  MKO10009054_A_Cd209b
  gRNA
uccagacuacgaccaaauuc

SEQ ID NO: 9055 - RNA, 20 nt, Artificial Sequence
  MKO10009055_A_Cd209b
  gRNA
ccaaaaccccaaauaccgag

SEQ ID NO: 9056 - RNA, 20 nt, Artificial Sequence
  MKO10009056_A_Cd209b
  gRNA
cucagugaucuucgccugca

SEQ ID NO: 9057 - RNA, 20 nt, Artificial Sequence
  MKO10009057_A_Cd209c
  gRNA
ucuaauguugccuacuccca

SEQ ID NO: 9058 - RNA, 20 nt, Artificial Sequence
  MKO10009058_A_Cd209c
  gRNA
cacuuauuugagacuucagc

SEQ ID NO: 9059 - RNA, 20 nt, Artificial Sequence
  MKO10009059_A_Cd209c
  gRNA
agggagagcccaacaaugaa

SEQ ID NO: 9060 - RNA, 20 nt, Artificial Sequence
  MKO10009060_A_Cd209d
  gRNA
gaagcagagccgcaaccccu

SEQ ID NO: 9061 - RNA, 20 nt, Artificial Sequence
  MKO10009061_A_Cd209d
  gRNA
uggaguugugccaauuucuu

SEQ ID NO: 9062 - RNA, 20 nt, Artificial Sequence
  MKO10009062_A_Cd209d
  gRNA
cagucucuaugaugaccagu

SEQ ID NO: 9063 - RNA, 20 nt, Artificial Sequence
  MKO10009063_A_Cd209e
  gRNA
augccaaucccguugugacu

SEQ ID NO: 9064 - RNA, 20 nt, Artificial Sequence
  MKO10009064_A_Cd209e
  gRNA
uugaagaacguccaauccca

SEQ ID NO: 9065 - RNA, 20 nt, Artificial Sequence
  MKO10009065_A_Cd209e
  gRNA
ugggacuaccugucugacag

SEQ ID NO: 9066 - RNA, 20 nt, Artificial Sequence
  MKO10009066_A_Cd209f
  gRNA
agcugcaaaugagacccucg

SEQ ID NO: 9067 - RNA, 20 nt, Artificial Sequence
  MKO10009067_A_Cd209f
  gRNA
ucagaggaggaggucacauc

SEQ ID NO: 9068 - RNA, 20 nt, Artificial Sequence
  MKO10009068_A_Cd209f
  gRNA
ggcaucugacccaagucccc

SEQ ID NO: 9069 - RNA, 20 nt, Artificial Sequence
  MKO10009069_A_Cd209g
  gRNA
uucagcaauuccucaaauac

SEQ ID NO: 9070 - RNA, 20 nt, Artificial Sequence
  MKO10009070_A_Cd209g
  gRNA
ggugucaucuacccacugcc

SEQ ID NO: 9071 - RNA, 20 nt, Artificial Sequence
  MKO10009071_A_Cd209g
  gRNA
ccaguuacccuuguccaagc

SEQ ID NO: 9072 - RNA, 20 nt, Artificial Sequence
  MKO10009072_A_Cd226
  gRNA
ucccauaugacuuguugcac

SEQ ID NO: 9073 - RNA, 20 nt, Artificial Sequence
  MKO10009073_A_Cd226
  gRNA
ggccagugcaacaagucaua

SEQ ID NO: 9074 - RNA, 20 nt, Artificial Sequence
  MKO10009074_A_Cd226
  gRNA
gaauuccacuuaaagagccc

SEQ ID NO: 9075 - RNA, 20 nt, Artificial Sequence
  MKO10009075_A_Cd22
  gRNA
ccgauacgugccaaugacag

SEQ ID NO: 9076 - RNA, 20 nt, Artificial Sequence
  MKO10009076_A_Cd22
  gRNA
gcccauucaccucaaugucu

SEQ ID NO: 9077 - RNA, 20 nt, Artificial Sequence
  MKO10009077_A_Cd22
  gRNA
cguggcggugucuugguuca

SEQ ID NO: 9078 - RNA, 20 nt, Artificial Sequence
  MKO10009078_A_Cd244
  gRNA
aaucacgaugaucaccccaa

SEQ ID NO: 9079 - RNA, 20 nt, Artificial Sequence
  MKO10009079_A_Cd244
  gRNA
gaccaucauuauaccaauuc

SEQ ID NO: 9080 - RNA, 20 nt, Artificial Sequence
  MKO10009080_A_Cd244
  gRNA
uugacaagucccauuagucc

SEQ ID NO: 9081 - RNA, 20 nt, Artificial Sequence
  MKO10009081_A_Cd247
  gRNA
gcgggcucgggauccagaga

SEQ ID NO: 9082 - RNA, 20 nt, Artificial Sequence
  MKO10009082_A_Cd247
  gRNA
aagagaggaauaugacgucu

SEQ ID NO: 9083 - RNA, 20 nt, Artificial Sequence
  MKO10009083_A_Cd247
  gRNA
ucgccugcauccuccacgug

SEQ ID NO: 9084 - RNA, 20 nt, Artificial Sequence
  MKO10009084_A_Cd248
  gRNA
guccauaugaagccccgcag

SEQ ID NO: 9085 - RNA, 20 nt, Artificial Sequence
  MKO10009085_A_Cd248
  gRNA
cgcacccaacaagcggauca

SEQ ID NO: 9086 - RNA, 20 nt, Artificial Sequence
  MKO10009086_A_Cd248
  gRNA
gcaguccgugauccgcuugu

SEQ ID NO: 9087 - RNA, 20 nt, Artificial Sequence
  MKO10009087_A_Cd24a
  gRNA
agggucucaccugcgugggu

SEQ ID NO: 9088 - RNA, 20 nt, Artificial Sequence
  MKO10009088_A_Cd24a
  gRNA
acaucuguugcaccguuucc

SEQ ID NO: 9089 - RNA, 20 nt, Artificial Sequence
  MKO10009089_A_Cd24a
  gRNA
gaaacggugcaacagauguu

SEQ ID NO: 9090 - RNA, 20 nt, Artificial Sequence
  MKO10009090_A_Cd274
  gRNA
guauggcagcaacgucacga

SEQ ID NO: 9091 - RNA, 20 nt, Artificial Sequence
  MKO10009091_A_Cd274
  gRNA
cuggauccacggaaauucuc

SEQ ID NO: 9092 - RNA, 20 nt, Artificial Sequence
  MKO10009092_A_Cd274
  gRNA
uccaaaggacuuguacgugg

SEQ ID NO: 9093 - RNA, 20 nt, Artificial Sequence
  MKO10009093_A_Cd276
  gRNA
gcgcguccgaguaaccgacg

SEQ ID NO: 9094 - RNA, 20 nt, Artificial Sequence
  MKO10009094_A_Cd276
  gRNA
aucgaacaagccccgcucgu

SEQ ID NO: 9095 - RNA, 20 nt, Artificial Sequence
  MKO10009095_A_Cd276
  gRNA
cccaacaaggaccuacgucc

SEQ ID NO: 9096 - RNA, 20 nt, Artificial Sequence
  MKO10009096_A_Cd27
  gRNA
cuggcuauagacagucgagu

SEQ ID NO: 9097 - RNA, 20 nt, Artificial Sequence
  MKO10009097_A_Cd27
  gRNA
cggguuuccgguaguccucc

SEQ ID NO: 9098 - RNA, 20 nt, Artificial Sequence
  MKO10009098_A_Cd27
  gRNA
acucgacugucuauagccag

SEQ ID NO: 9099 - RNA, 20 nt, Artificial Sequence
  MKO10009099_A_Cd28
  gRNA
cgccuuaccuagacaacgag

SEQ ID NO: 9100 - RNA, 20 nt, Artificial Sequence
  MKO10009100_A_Cd28
  gRNA
cccggaauuccuuugcgaga

SEQ ID NO: 9101 - RNA, 20 nt, Artificial Sequence
  MKO10009101_A_Cd28
  gRNA
gcgguacgcugcaaagucuc

SEQ ID NO: 9102 - RNA, 20 nt, Artificial Sequence
  MKO10009102_A_Cd2ap
  gRNA
guacagcgaaucagcacuua

SEQ ID NO: 9103 - RNA, 20 nt, Artificial Sequence
  MKO10009103_A_Cd2ap
  gRNA
cauacucuucuuaauagcuu

SEQ ID NO: 9104 - RNA, 20 nt, Artificial Sequence
  MKO10009104_A_Cd2ap
  gRNA
cuuaccuuaacaaaauuguc

SEQ ID NO: 9105 - RNA, 20 nt, Artificial Sequence
  MKO10009105_A_Cd2bp2
  gRNA
aaugagcgcccaagcacucc

SEQ ID NO: 9106 - RNA, 20 nt, Artificial Sequence
  MKO10009106_A_Cd2bp2
  gRNA
augcgcagauccgagacagc

SEQ ID NO: 9107 - RNA, 20 nt, Artificial Sequence
  MKO10009107_A_Cd2bp2
  gRNA
acggcccccugauaagcacc

SEQ ID NO: 9108 - RNA, 20 nt, Artificial Sequence
  MKO10009108_A_Cd2
  gRNA
ugucccuugcaagaccgcac

SEQ ID NO: 9109 - RNA, 20 nt, Artificial Sequence
  MKO10009109_A_Cd2
  gRNA
ccgaugaugagaaacgacag

SEQ ID NO: 9110 - RNA, 20 nt, Artificial Sequence
  MKO10009110_A_Cd2
  gRNA
cugggguugagugcggcuug

SEQ ID NO: 9111 - RNA, 20 nt, Artificial Sequence
  MKO10009111_A_Cd300a
  gRNA
gcuaacacagacaacagcgc

SEQ ID NO: 9112 - RNA, 20 nt, Artificial Sequence
  MKO10009112_A_Cd300a
  gRNA
ccuagggcgggacccuuggu

SEQ ID NO: 9113 - RNA, 20 nt, Artificial Sequence
  MKO10009113_A_Cd300a
  gRNA
gagugugucaugucgauaug

SEQ ID NO: 9114 - RNA, 20 nt, Artificial Sequence
  MKO10009114_A_Cd300c
  gRNA
ccagucaaagguucacgccc

SEQ ID NO: 9115 - RNA, 20 nt, Artificial Sequence
  MKO10009115_A_Cd300c
  gRNA
agaauguugauaccguuccc

SEQ ID NO: 9116 - RNA, 20 nt, Artificial Sequence
  MKO10009116_A_Cd300c
  gRNA
cacgaacaccucaaccuuga

SEQ ID NO: 9117 - RNA, 20 nt, Artificial Sequence
  MKO10009117_A_Cd300e
  gRNA
uucguggucacgugauccau

SEQ ID NO: 9118 - RNA, 20 nt, Artificial Sequence
  MKO10009118_A_Cd300e
  gRNA
uucacccuuacacugaccga

SEQ ID NO: 9119 - RNA, 20 nt, Artificial Sequence
  MKO10009119_A_Cd300e
  gRNA
ucacauuaguacuaauccuc

SEQ ID NO: 9120 - RNA, 20 nt, Artificial Sequence
  MKO10009120_A_Cd300lb
  gRNA
guagacguucacuuuaacuc

SEQ ID NO: 9121 - RNA, 20 nt, Artificial Sequence
  MKO10009121_A_Cd300lb
  gRNA
aaugucgcuauagcucaaga

SEQ ID NO: 9122 - RNA, 20 nt, Artificial Sequence
  MKO10009122_A_Cd300lb
  gRNA
cgacuucuaaucaacuuccc

SEQ ID NO: 9123 - RNA, 20 nt, Artificial Sequence
  MKO10009123_A_Cd300ld
  gRNA
agugcagauauuccucauac

SEQ ID NO: 9124 - RNA, 20 nt, Artificial Sequence
  MKO10009124_A_Cd300ld
  gRNA
uucucucuauccuaggcaac

SEQ ID NO: 9125 - RNA, 20 nt, Artificial Sequence
  MKO10009125_A_Cd300ld
  gRNA
cuuguaacccuuccaguaug

SEQ ID NO: 9126 - RNA, 20 nt, Artificial Sequence
  MKO10009126_A_Cd300lf
  gRNA
gugcagugccgauauaccuc

SEQ ID NO: 9127 - RNA, 20 nt, Artificial Sequence
  MKO10009127_A_Cd300lf
  gRNA
gaguaguagcuagucagcgu

SEQ ID NO: 9128 - RNA, 20 nt, Artificial Sequence
  MKO10009128_A_Cd300lf
  gRNA
ugcccuuccaggcauggcgg

SEQ ID NO: 9129 - RNA, 20 nt, Artificial Sequence
  MKO10009129_A_Cd300lg
  gRNA
ucacggucaucgagagcucu

SEQ ID NO: 9130 - RNA, 20 nt, Artificial Sequence
  MKO10009130_A_Cd300lg
  gRNA
ggagcucccguccagucguc

SEQ ID NO: 9131 - RNA, 20 nt, Artificial Sequence
  MKO10009131_A_Cd300lg
  gRNA
gucccugcgguguaccuacg

SEQ ID NO: 9132 - RNA, 20 nt, Artificial Sequence
  MKO10009132_A_Cd300lh
  gRNA
gcuacuuaccugggaggaaa

SEQ ID NO: 9133 - RNA, 20 nt, Artificial Sequence
  MKO10009133_A_Cd300lh
  gRNA
cagagcugggaacugccaca

SEQ ID NO: 9134 - RNA, 20 nt, Artificial Sequence
  MKO10009134_A_Cd300lh
  gRNA
guucacguuaacuuuaaaca

SEQ ID NO: 9135 - RNA, 20 nt, Artificial Sequence
  MKO10009135_A_Cd302
  gRNA
agcgcgcguuucuucuauag

SEQ ID NO: 9136 - RNA, 20 nt, Artificial Sequence
  MKO10009136_A_Cd302
  gRNA
uauagaagaaacgcgcgcuc

SEQ ID NO: 9137 - RNA, 20 nt, Artificial Sequence
  MKO10009137_A_Cd302
  gRNA
caaauaugacauucgacaag

SEQ ID NO: 9138 - RNA, 20 nt, Artificial Sequence
  MKO10009138_A_Cd320
  gRNA
cucauauugcuacgccuccg

SEQ ID NO: 9139 - RNA, 20 nt, Artificial Sequence
  MKO10009139_A_Cd320
  gRNA
ccaucacagcgccacgugug

SEQ ID NO: 9140 - RNA, 20 nt, Artificial Sequence
  MKO10009140_A_Cd320
  gRNA
gcguagcaauaugagaaggg

SEQ ID NO: 9141 - RNA, 20 nt, Artificial Sequence
  MKO10009141_A_Cd33
  gRNA
acugaccccuuuccggagcc

SEQ ID NO: 9142 - RNA, 20 nt, Artificial Sequence
  MKO10009142_A_Cd33
  gRNA
gcccgagucagugacagucg

SEQ ID NO: 9143 - RNA, 20 nt, Artificial Sequence
  MKO10009143_A_Cd33
  gRNA
gacuccugacauuauaaucc

SEQ ID NO: 9144 - RNA, 20 nt, Artificial Sequence
  MKO10009144_A_Cd34
  gRNA
cagccacuacuugaucuauc

SEQ ID NO: 9145 - RNA, 20 nt, Artificial Sequence
  MKO10009145_A_Cd34
  gRNA
gccccgcgcgcgugucccug

SEQ ID NO: 9146 - RNA, 20 nt, Artificial Sequence
  MKO10009146_A_Cd34
  gRNA
uccuuguguagaagucuccg

SEQ ID NO: 9147 - RNA, 20 nt, Artificial Sequence
  MKO10009147_A_Cd36
  gRNA
cagaguucguuaucuagcca

SEQ ID NO: 9148 - RNA, 20 nt, Artificial Sequence
  MKO10009148_A_Cd36
  gRNA
uauccuauaaguaccacagu

SEQ ID NO: 9149 - RNA, 20 nt, Artificial Sequence
  MKO10009149_A_Cd36
  gRNA
gccauaauugaguccuauaa

SEQ ID NO: 9150 - RNA, 20 nt, Artificial Sequence
  MKO10009150_A_Cd37
  gRNA
ccagagcuaccgcacgaauc

SEQ ID NO: 9151 - RNA, 20 nt, Artificial Sequence
  MKO10009151_A_Cd37
  gRNA
cugucucauccggauucgug

SEQ ID NO: 9152 - RNA, 20 nt, Artificial Sequence
  MKO10009152_A_Cd37
  gRNA
acucacccggacccgcugag

SEQ ID NO: 9153 - RNA, 20 nt, Artificial Sequence
  MKO10009153_A_Cd38
  gRNA
accuggcccaucaauauacu

SEQ ID NO: 9154 - RNA, 20 nt, Artificial Sequence
  MKO10009154_A_Cd38
  gRNA
gugguccaagugaugcucaa

SEQ ID NO: 9155 - RNA, 20 nt, Artificial Sequence
  MKO10009155_A_Cd38
  gRNA
gggacccauugagcaucacu

SEQ ID NO: 9156 - RNA, 20 nt, Artificial Sequence
  MKO10009156_A_Cd3d
  gRNA
guaucuucacgaucucgaag

SEQ ID NO: 9157 - RNA, 20 nt, Artificial Sequence
  MKO10009157_A_Cd3d
  gRNA
uugggcgucuacugcuuugc

SEQ ID NO: 9158 - RNA, 20 nt, Artificial Sequence
  MKO10009158_A_Cd3d
  gRNA
uccaucuagaugcaugacgc

SEQ ID NO: 9159 - RNA, 20 nt, Artificial Sequence
  MKO10009159_A_Cd3eap
  gRNA
auggcaagaagcaccgauac

SEQ ID NO: 9160 - RNA, 20 nt, Artificial Sequence
  MKO10009160_A_Cd3eap
  gRNA
gacgggagggcugccgccaa

SEQ ID NO: 9161 - RNA, 20 nt, Artificial Sequence
  MKO10009161_A_Cd3eap
  gRNA
cauuguggggcgaagucugc

SEQ ID NO: 9162 - RNA, 20 nt, Artificial Sequence
  MKO10009162_A_Cd3e
  gRNA
ccgaguuaccucgagcuuuc

SEQ ID NO: 9163 - RNA, 20 nt, Artificial Sequence
  MKO10009163_A_Cd3e
  gRNA
ccucgacuuccgagaaaucc

SEQ ID NO: 9164 - RNA, 20 nt, Artificial Sequence
  MKO10009164_A_Cd3e
  gRNA
aaggccaagccugugacccg

SEQ ID NO: 9165 - RNA, 20 nt, Artificial Sequence
  MKO10009165_A_Cd3g
  gRNA
auccggcuuuaucuucgcug

SEQ ID NO: 9166 - RNA, 20 nt, Artificial Sequence
  MKO10009166_A_Cd3g
  gRNA
uguauaucucauugcgggac

SEQ ID NO: 9167 - RNA, 20 nt, Artificial Sequence
  MKO10009167_A_Cd3g
  gRNA
ugacugacaagacuaucaag

SEQ ID NO: 9168 - RNA, 20 nt, Artificial Sequence
  MKO10009168_A_Cd40lg
  gRNA
agucaacgcccauucaucgu

SEQ ID NO: 9169 - RNA, 20 nt, Artificial Sequence
  MKO10009169_A_Cd40lg
  gRNA
agccagaggccgacgaugaa

SEQ ID NO: 9170 - RNA, 20 nt, Artificial Sequence
  MKO10009170_A_Cd40lg
  gRNA
gccaacaguaaugcagcauc

SEQ ID NO: 9171 - RNA, 20 nt, Artificial Sequence
  MKO10009171_A_Cd40
  gRNA
acaugccucgcaauccuugc

SEQ ID NO: 9172 - RNA, 20 nt, Artificial Sequence
  MKO10009172_A_Cd40
  gRNA
ccccauagcgcgcacagccg

SEQ ID NO: 9173 - RNA, 20 nt, Artificial Sequence
  MKO10009173_A_Cd40
  gRNA
acguaacacacugcccuaga

SEQ ID NO: 9174 - RNA, 20 nt, Artificial Sequence
  MKO10009174_A_Cd44
  gRNA
aauguaaccugccgcuacgc

SEQ ID NO: 9175 - RNA, 20 nt, Artificial Sequence
  MKO10009175_A_Cd44
  gRNA
cgaggauauauacuccugug

SEQ ID NO: 9176 - RNA, 20 nt, Artificial Sequence
  MKO10009176_A_Cd44
  gRNA
gaccuacccaauuccuucga

SEQ ID NO: 9177 - RNA, 20 nt, Artificial Sequence
  MKO10009177_A_Cd46
  gRNA
ucgagcuaaauuuacuugua

SEQ ID NO: 9178 - RNA, 20 nt, Artificial Sequence
  MKO10009178_A_Cd46
  gRNA
cuaucuaguuauuacguagu

SEQ ID NO: 9179 - RNA, 20 nt, Artificial Sequence
  MKO10009179_A_Cd46
  gRNA
auaugguuaccuuuacacuc

SEQ ID NO: 9180 - RNA, 20 nt, Artificial Sequence
  MKO10009180_A_Cd47
  gRNA
cccuugcaucguccguaaug

SEQ ID NO: 9181 - RNA, 20 nt, Artificial Sequence
  MKO10009181_A_Cd47
  gRNA
aauggauaagcgcgaugcca

SEQ ID NO: 9182 - RNA, 20 nt, Artificial Sequence
  MKO10009182_A_Cd47
  gRNA
aucauucugcugcucguugc

SEQ ID NO: 9183 - RNA, 20 nt, Artificial Sequence
  MKO10009183_A_Cd48
  gRNA
gaccauauaaacguaucacc

SEQ ID NO: 9184 - RNA, 20 nt, Artificial Sequence
  MKO10009184_A_Cd48
  gRNA
acgcagcacucucauguagu

SEQ ID NO: 9185 - RNA, 20 nt, Artificial Sequence
  MKO10009185_A_Cd48
  gRNA
uuaccucacacgauagccuc

SEQ ID NO: 9186 - RNA, 20 nt, Artificial Sequence
  MKO10009186_A_Cd4
  gRNA
cagcaaacugaagcgagacc

SEQ ID NO: 9187 - RNA, 20 nt, Artificial Sequence
  MKO10009187_A_Cd4
  gRNA
cuggaacugcaccgugaccc

SEQ ID NO: 9188 - RNA, 20 nt, Artificial Sequence
  MKO10009188_A_Cd4
  gRNA
gaccuuagaguugcuaucca

SEQ ID NO: 9189 - RNA, 20 nt, Artificial Sequence
  MKO10009189_A_Cd52
  gRNA
gcaggcacccgcaucgauga

SEQ ID NO: 9190 - RNA, 20 nt, Artificial Sequence
  MKO10009190_A_Cd52
  gRNA
caagccacuacggccgcuuc

SEQ ID NO: 9191 - RNA, 20 nt, Artificial Sequence
  MKO10009191_A_Cd52
  gRNA
caaccagaagaaugauagug

SEQ ID NO: 9192 - RNA, 20 nt, Artificial Sequence
  MKO10009192_A_Cd53
  gRNA
guuacggaagaguacuccau

SEQ ID NO: 9193 - RNA, 20 nt, Artificial Sequence
  MKO10009193_A_Cd53
  gRNA
gccacagcucaacacuuuag

SEQ ID NO: 9194 - RNA, 20 nt, Artificial Sequence
  MKO10009194_A_Cd53
  gRNA
aaugacucaccgacauaagc

SEQ ID NO: 9195 - RNA, 20 nt, Artificial Sequence
  MKO10009195_A_Cd55
  gRNA
cgaaaacaaccuccacuccc

SEQ ID NO: 9196 - RNA, 20 nt, Artificial Sequence
  MKO10009196_A_Cd55
  gRNA
ucuacuuucuguucugucac

SEQ ID NO: 9197 - RNA, 20 nt, Artificial Sequence
  MKO10009197_A_Cd55
  gRNA
ggagacauaccugugcacac

SEQ ID NO: 9198 - RNA, 20 nt, Artificial Sequence
  MKO10009198_A_Cd59a
  gRNA
augcuaccacuguuuccaac

SEQ ID NO: 9199 - RNA, 20 nt, Artificial Sequence
  MKO10009199_A_Cd59a
  gRNA
cuuggggaagacaccauugc

SEQ ID NO: 9200 - RNA, 20 nt, Artificial Sequence
  MKO10009200_A_Cd59a
  gRNA
ggaaacagugguagcaugug

SEQ ID NO: 9201 - RNA, 20 nt, Artificial Sequence
  MKO10009201_A_Cd59b
  gRNA
uauuaugagccgauuagacg

SEQ ID NO: 9202 - RNA, 20 nt, Artificial Sequence
  MKO10009202_A_Cd59b
  gRNA
guaugccugccacgucuaau

SEQ ID NO: 9203 - RNA, 20 nt, Artificial Sequence
  MKO10009203_A_Cd59b
  gRNA
cacuacuugcucuccuaacc

SEQ ID NO: 9204 - RNA, 20 nt, Artificial Sequence
  MKO10009204_A_Cd5l
  gRNA
ucuacuagacgcacauccuc

SEQ ID NO: 9205 - RNA, 20 nt, Artificial Sequence
  MKO10009205_A_Cd5l
  gRNA
gaacaacuguacccauggcg

SEQ ID NO: 9206 - RNA, 20 nt, Artificial Sequence
  MKO10009206_A_Cd5l
  gRNA
gcagucauccaaaccccgcg

SEQ ID NO: 9207 - RNA, 20 nt, Artificial Sequence
  MKO10009207_A_Cd5
  gRNA
ggccucccaucgaauuggca

SEQ ID NO: 9208 - RNA, 20 nt, Artificial Sequence
  MKO10009208_A_Cd5
  gRNA
gauauccaggugaugcuaag

SEQ ID NO: 9209 - RNA, 20 nt, Artificial Sequence
  MKO10009209_A_Cd5
  gRNA
auauagaccacggagauccu

SEQ ID NO: 9210 - RNA, 20 nt, Artificial Sequence
  MKO10009210_A_Cd63
  gRNA
cccuaccuggguauggauag

SEQ ID NO: 9211 - RNA, 20 nt, Artificial Sequence
  MKO10009211_A_Cd63
  gRNA
aaacauccccggcauggcca

SEQ ID NO: 9212 - RNA, 20 nt, Artificial Sequence
  MKO10009212_A_Cd63
  gRNA
auuacccaugagacuacugc

SEQ ID NO: 9213 - RNA, 20 nt, Artificial Sequence
  MKO10009213_A_Cd68
  gRNA
ggcccgaagugucccuuguc

SEQ ID NO: 9214 - RNA, 20 nt, Artificial Sequence
  MKO10009214_A_Cd68
  gRNA
ggguaccgucacaaccuccc

SEQ ID NO: 9215 - RNA, 20 nt, Artificial Sequence
  MKO10009215_A_Cd68
  gRNA
gggcucuugggaacuacacg

SEQ ID NO: 9216 - RNA, 20 nt, Artificial Sequence
  MKO10009216_A_Cd69
  gRNA
acguuucugaagcgauauuc

SEQ ID NO: 9217 - RNA, 20 nt, Artificial Sequence
  MKO10009217_A_Cd69
  gRNA
gugggcaaguacaauugccc

SEQ ID NO: 9218 - RNA, 20 nt, Artificial Sequence
  MKO10009218_A_Cd69
  gRNA
ccacaaaaauguuaccgcug

SEQ ID NO: 9219 - RNA, 20 nt, Artificial Sequence
  MKO10009219_A_Cd6
  gRNA
guaccgugugcgacgacacg

SEQ ID NO: 9220 - RNA, 20 nt, Artificial Sequence
  MKO10009220_A_Cd6
  gRNA
gccgucccgggcagucccac

SEQ ID NO: 9221 - RNA, 20 nt, Artificial Sequence
  MKO10009221_A_Cd6
  gRNA
ccgcgcccacgucguauucc

SEQ ID NO: 9222 - RNA, 20 nt, Artificial Sequence
  MKO10009222_A_Cd70
  gRNA
ggaccgcguuccagcgccaa

SEQ ID NO: 9223 - RNA, 20 nt, Artificial Sequence
  MKO10009223_A_Cd70
  gRNA
gcguugcgggacggcagcag

SEQ ID NO: 9224 - RNA, 20 nt, Artificial Sequence
  MKO10009224_A_Cd70
  gRNA
caagcugaugccgugcgcag

SEQ ID NO: 9225 - RNA, 20 nt, Artificial Sequence
  MKO10009225_A_Cd72
  gRNA
aauccauccgcauggacagc

SEQ ID NO: 9226 - RNA, 20 nt, Artificial Sequence
  MKO10009226_A_Cd72
  gRNA
cccgcgugcuugucaaccuc

SEQ ID NO: 9227 - RNA, 20 nt, Artificial Sequence
  MKO10009227_A_Cd72
  gRNA
uucaucgaaugcugccaguu

SEQ ID NO: 9228 - RNA, 20 nt, Artificial Sequence
  MKO10009228_A_Cd74
  gRNA
gcugaugcguccaaugucca

SEQ ID NO: 9229 - RNA, 20 nt, Artificial Sequence
  MKO10009229_A_Cd74
  gRNA
auuucggaagcuucaugcga

SEQ ID NO: 9230 - RNA, 20 nt, Artificial Sequence
  MKO10009230_A_Cd74
  gRNA
gaggucgcguuggucaucca

SEQ ID NO: 9231 - RNA, 20 nt, Artificial Sequence
  MKO10009231_A_Cd79a
  gRNA
guggacccccuucuacccgc

SEQ ID NO: 9232 - RNA, 20 nt, Artificial Sequence
  MKO10009232_A_Cd79a
  gRNA
aacauauuaaaacgcuccug

SEQ ID NO: 9233 - RNA, 20 nt, Artificial Sequence
  MKO10009233_A_Cd79a
  gRNA
ugaugacuguucuauguaug

SEQ ID NO: 9234 - RNA, 20 nt, Artificial Sequence
  MKO10009234_A_Cd79b
  gRNA
guguguuccgccgcuucagu

SEQ ID NO: 9235 - RNA, 20 nt, Artificial Sequence
  MKO10009235_A_Cd79b
  gRNA
agauaccauuauccucguac

SEQ ID NO: 9236 - RNA, 20 nt, Artificial Sequence
  MKO10009236_A_Cd79b
  gRNA
cugaccugguuccgaaagcg

SEQ ID NO: 9237 - RNA, 20 nt, Artificial Sequence
  MKO10009237_A_Cd7
  gRNA
caaucgugagucggggggac

SEQ ID NO: 9238 - RNA, 20 nt, Artificial Sequence
  MKO10009238_A_Cd7
  gRNA
ccgacucacgauugccucug

SEQ ID NO: 9239 - RNA, 20 nt, Artificial Sequence
  MKO10009239_A_Cd7
  gRNA
uuugggcgucaugacucagc

SEQ ID NO: 9240 - RNA, 20 nt, Artificial Sequence
  MKO10009240_A_Cd80
  gRNA
gagucguauugaaaucuagu

SEQ ID NO: 9241 - RNA, 20 nt, Artificial Sequence
  MKO10009241_A_Cd80
  gRNA
agucugaagaccgaaucuac

SEQ ID NO: 9242 - RNA, 20 nt, Artificial Sequence
  MKO10009242_A_Cd80
  gRNA
caucaauacgacaauuuccc

SEQ ID NO: 9243 - RNA, 20 nt, Artificial Sequence
  MKO10009243_A_Cd81
  gRNA
uugguacucacccacguaga

SEQ ID NO: 9244 - RNA, 20 nt, Artificial Sequence
  MKO10009244_A_Cd81
  gRNA
ggcacccaacaccuucuacg

SEQ ID NO: 9245 - RNA, 20 nt, Artificial Sequence
  MKO10009245_A_Cd81
  gRNA
gggcuucguaaacaaagacc

SEQ ID NO: 9246 - RNA, 20 nt, Artificial Sequence
  MKO10009246_A_Cd82
  gRNA
cuacggucaccugugcgaug

SEQ ID NO: 9247 - RNA, 20 nt, Artificial Sequence
  MKO10009247_A_Cd82
  gRNA
caaugccaccaguagccgcg

SEQ ID NO: 9248 - RNA, 20 nt, Artificial Sequence
  MKO10009248_A_Cd82
  gRNA
ucugcugauccucaucgcac

SEQ ID NO: 9249 - RNA, 20 nt, Artificial Sequence
  MKO10009249_A_Cd83
  gRNA
agaaaagcuuguuccguacc

SEQ ID NO: 9250 - RNA, 20 nt, Artificial Sequence
  MKO10009250_A_Cd83
  gRNA
acccgcgauggcgaugcggg

SEQ ID NO: 9251 - RNA, 20 nt, Artificial Sequence
  MKO10009251_A_Cd83
  gRNA
caccucccgcaucgccaucg

SEQ ID NO: 9252 - RNA, 20 nt, Artificial Sequence
  MKO10009252_A_Cd84
  gRNA
accagauccacagauggcgc

SEQ ID NO: 9253 - RNA, 20 nt, Artificial Sequence
  MKO10009253_A_Cd84
  gRNA
gcuuauucucauuccgaugu

SEQ ID NO: 9254 - RNA, 20 nt, Artificial Sequence
  MKO10009254_A_Cd84
  gRNA
gcaugucagugugauauuac

SEQ ID NO: 9255 - RNA, 20 nt, Artificial Sequence
  MKO10009255_A_Cd86
  gRNA
gugaccuugcuuagacgugc

SEQ ID NO: 9256 - RNA, 20 nt, Artificial Sequence
  MKO10009256_A_Cd86
  gRNA
uugaccugcacgucuaagca

SEQ ID NO: 9257 - RNA, 20 nt, Artificial Sequence
  MKO10009257_A_Cd86
  gRNA
uuccaucuccucaaacguau

SEQ ID NO: 9258 - RNA, 20 nt, Artificial Sequence
  MKO10009258_A_Cd8a
  gRNA
cgucccacguuaucuuguug

SEQ ID NO: 9259 - RNA, 20 nt, Artificial Sequence
  MKO10009259_A_Cd8a
  gRNA
gcccaccuucguugucuaua

SEQ ID NO: 9260 - RNA, 20 nt, Artificial Sequence
  MKO10009260_A_Cd8a
  gRNA
acccuuggccggaaucugcg

SEQ ID NO: 9261 - RNA, 20 nt, Artificial Sequence
  MKO10009261_A_Cd8b1
  gRNA
ugacuucuacuucugcgcga

SEQ ID NO: 9262 - RNA, 20 nt, Artificial Sequence
  MKO10009262_A_Cd8b1
  gRNA
ucagaccccuucgucccugc

SEQ ID NO: 9263 - RNA, 20 nt, Artificial Sequence
  MKO10009263_A_Cd8b1
  gRNA
uucuugguuggggcaguugu

SEQ ID NO: 9264 - RNA, 20 nt, Artificial Sequence
  MKO10009264_A_Cd93
  gRNA
ccggccuggauuucgacugc

SEQ ID NO: 9265 - RNA, 20 nt, Artificial Sequence
  MKO10009265_A_Cd93
  gRNA
uagaugaguguucggacgca

SEQ ID NO: 9266 - RNA, 20 nt, Artificial Sequence
  MKO10009266_A_Cd93
  gRNA
agucuucagcagucuguccc

SEQ ID NO: 9267 - RNA, 20 nt, Artificial Sequence
  MKO10009267_A_Cd96
  gRNA
agaauguccugccaucgucu

SEQ ID NO: 9268 - RNA, 20 nt, Artificial Sequence
  MKO10009268_A_Cd96
  gRNA
gaugacguguaugcucuacc

SEQ ID NO: 9269 - RNA, 20 nt, Artificial Sequence
  MKO10009269_A_Cd96
  gRNA
cugagaaggguguaacaaau

SEQ ID NO: 9270 - RNA, 20 nt, Artificial Sequence
  MKO10009270_A_Cd97
  gRNA
aucaacgaguguuuacuacc

SEQ ID NO: 9271 - RNA, 20 nt, Artificial Sequence
  MKO10009271_A_Cd97
  gRNA
auaucccagguuacagacgc

SEQ ID NO: 9272 - RNA, 20 nt, Artificial Sequence
  MKO10009272_A_Cd97
  gRNA
uuccuucuccgagcugaagc

SEQ ID NO: 9273 - RNA, 20 nt, Artificial Sequence
  MKO10009273_A_Cd99l2
  gRNA
gcuugacucacgcuuuacug

SEQ ID NO: 9274 - RNA, 20 nt, Artificial Sequence
  MKO10009274_A_Cd99l2
  gRNA
gaugaucgaaaugaucuaga

SEQ ID NO: 9275 - RNA, 20 nt, Artificial Sequence
  MKO10009275_A_Cd99l2
  gRNA
uggccuucuaguuguaguag

SEQ ID NO: 9276 - RNA, 20 nt, Artificial Sequence
  MKO10009276_A_Cd9
  gRNA
uugagauagccgccgccguc

SEQ ID NO: 9277 - RNA, 20 nt, Artificial Sequence
  MKO10009277_A_Cd9
  gRNA
gugaccuaccgccauaugga

SEQ ID NO: 9278 - RNA, 20 nt, Artificial Sequence
  MKO10009278_A_Cd9
  gRNA
gacggcggcggcuaucucaa

SEQ ID NO: 9279 - RNA, 20 nt, Artificial Sequence
  MKO10009279_A_Cdadc1
  gRNA
gaggucagucggcacgcaga

SEQ ID NO: 9280 - RNA, 20 nt, Artificial Sequence
  MKO10009280_A_Cdadc1
  gRNA
cugcgugccgacugaccucu

SEQ ID NO: 9281 - RNA, 20 nt, Artificial Sequence
  MKO10009281_A_Cdadc1
  gRNA
uccagugaagacuuacauac

SEQ ID NO: 9282 - RNA, 20 nt, Artificial Sequence
  MKO10009282_A_Cdan1
  gRNA
uggcccgccgugcgggccgc

SEQ ID NO: 9283 - RNA, 20 nt, Artificial Sequence
  MKO10009283_A_Cdan1
  gRNA
agccccgaccgccucguucg

SEQ ID NO: 9284 - RNA, 20 nt, Artificial Sequence
  MKO10009284_A_Cdan1
  gRNA
gaaccggagaccccgauucu

SEQ ID NO: 9285 - RNA, 20 nt, Artificial Sequence
  MKO10009285_A_Cda
  gRNA
auucguagucaggacggucc

SEQ ID NO: 9286 - RNA, 20 nt, Artificial Sequence
  MKO10009286_A_Cda
  gRNA
cgagcggacugccauccaga

SEQ ID NO: 9287 - RNA, 20 nt, Artificial Sequence
  MKO10009287_A_Cda
  gRNA
ucuuccaguuuggcaccgac

SEQ ID NO: 9288 - RNA, 20 nt, Artificial Sequence
  MKO10009288_A_Cdc123
  gRNA
ccaagaagcuaucaauucgc

SEQ ID NO: 9289 - RNA, 20 nt, Artificial Sequence
  MKO10009289_A_Cdc123
  gRNA
ggggcacuccaguuaagcuu

SEQ ID NO: 9290 - RNA, 20 nt, Artificial Sequence
  MKO10009290_A_Cdc123
  gRNA
cuucguuaccacugucugac

SEQ ID NO: 9291 - RNA, 20 nt, Artificial Sequence
  MKO10009291_A_Cdc14a
  gRNA
ccacuauuucuccaucgacg

SEQ ID NO: 9292 - RNA, 20 nt, Artificial Sequence
  MKO10009292_A_Cdc14a
  gRNA
acuacaccucuuucgaccag

SEQ ID NO: 9293 - RNA, 20 nt, Artificial Sequence
  MKO10009293_A_Cdc14a
  gRNA
auagaccagcuccucgucga

SEQ ID NO: 9294 - RNA, 20 nt, Artificial Sequence
  MKO10009294_A_Cdc14b
  gRNA
aauguucuauacgcgucuuc

SEQ ID NO: 9295 - RNA, 20 nt, Artificial Sequence
  MKO10009295_A_Cdc14b
  gRNA
gcgaaugccgccuuccuugu

SEQ ID NO: 9296 - RNA, 20 nt, Artificial Sequence
  MKO10009296_A_Cdc14b
  gRNA
uaaagcuucuaugcggauuu

SEQ ID NO: 9297 - RNA, 20 nt, Artificial Sequence
  MKO10009297_A_Cdc16
  gRNA
cucggugguacugcgcugug

SEQ ID NO: 9298 - RNA, 20 nt, Artificial Sequence
  MKO10009298_A_Cdc16
  gRNA
cuuuguccagcuugcgugac

SEQ ID NO: 9299 - RNA, 20 nt, Artificial Sequence
  MKO10009299_A_Cdc16
  gRNA
uuacguggcaucuagcugca

SEQ ID NO: 9300 - RNA, 20 nt, Artificial Sequence
  MKO10009300_A_Cdc20b
  gRNA
ucgcugcugcuucaugccgu

SEQ ID NO: 9301 - RNA, 20 nt, Artificial Sequence
  MKO10009301_A_Cdc20b
  gRNA
acugagcucacguagaguua

SEQ ID NO: 9302 - RNA, 20 nt, Artificial Sequence
  MKO10009302_A_Cdc20b
  gRNA
ucaagagcaacuucgugaag

SEQ ID NO: 9303 - RNA, 20 nt, Artificial Sequence
  MKO10009303_A_Cdc20
  gRNA
cagaccugaaucuuguagau

SEQ ID NO: 9304 - RNA, 20 nt, Artificial Sequence
  MKO10009304_A_Cdc20
  gRNA
ggggcaucaaggauccuguc

SEQ ID NO: 9305 - RNA, 20 nt, Artificial Sequence
  MKO10009305_A_Cdc20
  gRNA
ugcacucacaguagucauuc

SEQ ID NO: 9306 - RNA, 20 nt, Artificial Sequence
  MKO10009306_A_Cdc23
  gRNA
uuccuuguaggaggacgcgc

SEQ ID NO: 9307 - RNA, 20 nt, Artificial Sequence
  MKO10009307_A_Cdc23
  gRNA
ucuugcuauugcagccguga

SEQ ID NO: 9308 - RNA, 20 nt, Artificial Sequence
  MKO10009308_A_Cdc23
  gRNA
ggcggcugcagcuccgacaa

SEQ ID NO: 9309 - RNA, 20 nt, Artificial Sequence
  MKO10009309_A_Cdc25a
  gRNA
uccucagaaucgaccgauuc

SEQ ID NO: 9310 - RNA, 20 nt, Artificial Sequence
  MKO10009310_A_Cdc25a
  gRNA
accugaaucggucgauucug

SEQ ID NO: 9311 - RNA, 20 nt, Artificial Sequence
  MKO10009311_A_Cdc25a
  gRNA
guagggaauuuauucucguc

SEQ ID NO: 9312 - RNA, 20 nt, Artificial Sequence
  MKO10009312_A_Cdc25b
  gRNA
cagaccaugcacaaccucgc

SEQ ID NO: 9313 - RNA, 20 nt, Artificial Sequence
  MKO10009313_A_Cdc25b
  gRNA
cacgugcgcucugccaucug

SEQ ID NO: 9314 - RNA, 20 nt, Artificial Sequence
  MKO10009314_A_Cdc25b
  gRNA
ucucaguccugcccgcgugc

SEQ ID NO: 9315 - RNA, 20 nt, Artificial Sequence
  MKO10009315_A_Cdc25c
  gRNA
uuacugggauaccuuucaua

SEQ ID NO: 9316 - RNA, 20 nt, Artificial Sequence
  MKO10009316_A_Cdc25c
  gRNA
ccaguuaacugucuauccag

SEQ ID NO: 9317 - RNA, 20 nt, Artificial Sequence
  MKO10009317_A_Cdc25c
  gRNA
ccucuggauagacaguuaac

SEQ ID NO: 9318 - RNA, 20 nt, Artificial Sequence
  MKO10009318_A_Cdc26
  gRNA
cgucgagcuugagcucuaag

SEQ ID NO: 9319 - RNA, 20 nt, Artificial Sequence
  MKO10009319_A_Cdc26
  gRNA
gugacuucacuaugcugcga

SEQ ID NO: 9320 - RNA, 20 nt, Artificial Sequence
  MKO10009320_A_Cdc26
  gRNA
cuaggcccguaagaagcaga

SEQ ID NO: 9321 - RNA, 20 nt, Artificial Sequence
  MKO10009321_A_Cdc27
  gRNA
cugcauauagucguucugcg

SEQ ID NO: 9322 - RNA, 20 nt, Artificial Sequence
  MKO10009322_A_Cdc27
  gRNA
cugcaucucgguaagcauag

SEQ ID NO: 9323 - RNA, 20 nt, Artificial Sequence
  MKO10009323_A_Cdc27
  gRNA
gacgaccuugucacugaguu

SEQ ID NO: 9324 - RNA, 20 nt, Artificial Sequence
  MKO10009324_A_Cdc34
  gRNA
uccgagcccucgucgggcgc

SEQ ID NO: 9325 - RNA, 20 nt, Artificial Sequence
  MKO10009325_A_Cdc34
  gRNA
cauaguagucgucguagaag

SEQ ID NO: 9326 - RNA, 20 nt, Artificial Sequence
  MKO10009326_A_Cdc34
  gRNA
guccacguuggcaggcgaga

SEQ ID NO: 9327 - RNA, 20 nt, Artificial Sequence
  MKO10009327_A_Cdc37l1
  gRNA
uuacagguauguugagucgc

SEQ ID NO: 9328 - RNA, 20 nt, Artificial Sequence
  MKO10009328_A_Cdc37l1
  gRNA
uagcagucucuucacauacg

SEQ ID NO: 9329 - RNA, 20 nt, Artificial Sequence
  MKO10009329_A_Cdc37l1
  gRNA
uuuggcguguuccugaucca

SEQ ID NO: 9330 - RNA, 20 nt, Artificial Sequence
  MKO10009330_A_Cdc37
  gRNA
cguuguccgacagguauuuc

SEQ ID NO: 9331 - RNA, 20 nt, Artificial Sequence
  MKO10009331_A_Cdc37
  gRNA
gcaggcccggguggaacgca

SEQ ID NO: 9332 - RNA, 20 nt, Artificial Sequence
  MKO10009332_A_Cdc37
  gRNA
cggccaacuaccugguuauc

SEQ ID NO: 9333 - RNA, 20 nt, Artificial Sequence
  MKO10009333_A_Cdc40
  gRNA
accugaugauuaucuaacga

SEQ ID NO: 9334 - RNA, 20 nt, Artificial Sequence
  MKO10009334_A_Cdc40
  gRNA
cccuucguuagauaaucauc

SEQ ID NO: 9335 - RNA, 20 nt, Artificial Sequence
  MKO10009335_A_Cdc40
  gRNA
ugagaccauguucgcuccug

SEQ ID NO: 9336 - RNA, 20 nt, Artificial Sequence
  MKO10009336_A_Cdc42bpa
  gRNA
cagcgugcuuucgugaagag

SEQ ID NO: 9337 - RNA, 20 nt, Artificial Sequence
  MKO10009337_A_Cdc42bpa
  gRNA
caacauaauaauccauaacc

SEQ ID NO: 9338 - RNA, 20 nt, Artificial Sequence
  MKO10009338_A_Cdc42bpa
  gRNA
guguucacaguaccugguua

SEQ ID NO: 9339 - RNA, 20 nt, Artificial Sequence
  MKO10009339_A_Cdc42bpb
  gRNA
ucgagaagagcgugacgugc

SEQ ID NO: 9340 - RNA, 20 nt, Artificial Sequence
  MKO10009340_A_Cdc42bpb
  gRNA
cggcgacugccaguggauca

SEQ ID NO: 9341 - RNA, 20 nt, Artificial Sequence
  MKO10009341_A_Cdc42bpb
  gRNA
gacauggcgagguucuacau

SEQ ID NO: 9342 - RNA, 20 nt, Artificial Sequence
  MKO10009342_A_Cdc42bpg
  gRNA
ccccucagguugccguggug

SEQ ID NO: 9343 - RNA, 20 nt, Artificial Sequence
  MKO10009343_A_Cdc42bpg
  gRNA
ugcucugcacuacgccuucc

SEQ ID NO: 9344 - RNA, 20 nt, Artificial Sequence
  MKO10009344_A_Cdc42bpg
  gRNA
cuagaacaucucgcuccucc

SEQ ID NO: 9345 - RNA, 20 nt, Artificial Sequence
  MKO10009345_A_Cdc42ep1
  gRNA
caucucacgccugccacgcg

SEQ ID NO: 9346 - RNA, 20 nt, Artificial Sequence
  MKO10009346_A_Cdc42ep1
  gRNA
cuccaacagguucgcagagu

SEQ ID NO: 9347 - RNA, 20 nt, Artificial Sequence
  MKO10009347_A_Cdc42ep1
  gRNA
gccggggaagccauccuucg

SEQ ID NO: 9348 - RNA, 20 nt, Artificial Sequence
  MKO10009348_A_Cdc42ep2
  gRNA
acucgcacuacaaccgugug

SEQ ID NO: 9349 - RNA, 20 nt, Artificial Sequence
  MKO10009349_A_Cdc42ep2
  gRNA
gccugggggccaccaauuac

SEQ ID NO: 9350 - RNA, 20 nt, Artificial Sequence
  MKO10009350_A_Cdc42ep2
  gRNA
gauucaaggugcaagcgagg

SEQ ID NO: 9351 - RNA, 20 nt, Artificial Sequence
  MKO10009351_A_Cdc42ep3
  gRNA
cggggcauaacgacuucuuc

SEQ ID NO: 9352 - RNA, 20 nt, Artificial Sequence
  MKO10009352_A_Cdc42ep3
  gRNA
uagugugacgaaaguccccc

SEQ ID NO: 9353 - RNA, 20 nt, Artificial Sequence
  MKO10009353_A_Cdc42ep3
  gRNA
cggaagaagucguuaugccc

SEQ ID NO: 9354 - RNA, 20 nt, Artificial Sequence
  MKO10009354_A_Cdc42ep4
  gRNA
agcuggcggguaccgugaca

SEQ ID NO: 9355 - RNA, 20 nt, Artificial Sequence
  MKO10009355_A_Cdc42ep4
  gRNA
ugacccacuccuugacgagc

SEQ ID NO: 9356 - RNA, 20 nt, Artificial Sequence
  MKO10009356_A_Cdc42ep4
  gRNA
cguucacaguccgugaccag

SEQ ID NO: 9357 - RNA, 20 nt, Artificial Sequence
  MKO10009357_A_Cdc42ep5
  gRNA
gaccgaugacgucguccagc

SEQ ID NO: 9358 - RNA, 20 nt, Artificial Sequence
  MKO10009358_A_Cdc42ep5
  gRNA
uaacaccgcguccagcauag

SEQ ID NO: 9359 - RNA, 20 nt, Artificial Sequence
  MKO10009359_A_Cdc42ep5
  gRNA
uccgcgauccagccgcuucu

SEQ ID NO: 9360 - RNA, 20 nt, Artificial Sequence
  MKO10009360_A_Cdc42se1
  gRNA
gaaaccaccgugacagaccg

SEQ ID NO: 9361 - RNA, 20 nt, Artificial Sequence
  MKO10009361_A_Cdc42se1
  gRNA
uuggcuccccaaucauagug

SEQ ID NO: 9362 - RNA, 20 nt, Artificial Sequence
  MKO10009362_A_Cdc42se1
  gRNA
cguggucgagaagccccagc

SEQ ID NO: 9363 - RNA, 20 nt, Artificial Sequence
  MKO10009363_A_Cdc42se2
  gRNA
cacgagcugcaucugcacgu

SEQ ID NO: 9364 - RNA, 20 nt, Artificial Sequence
  MKO10009364_A_Cdc42se2
  gRNA
uuggcucuccgaucauacuu

SEQ ID NO: 9365 - RNA, 20 nt, Artificial Sequence
  MKO10009365_A_Cdc42se2
  gRNA
caacgugcagaugcagcucg

SEQ ID NO: 9366 - RNA, 20 nt, Artificial Sequence
  MKO10009366_A_Cdc42
  gRNA
acaguugguacauauuccga

SEQ ID NO: 9367 - RNA, 20 nt, Artificial Sequence
  MKO10009367_A_Cdc42
  gRNA
caaguuucucaauaguagag

SEQ ID NO: 9368 - RNA, 20 nt, Artificial Sequence
  MKO10009368_A_Cdc42
  gRNA
acaauuaaguguguuguugu

SEQ ID NO: 9369 - RNA, 20 nt, Artificial Sequence
  MKO10009369_A_Cdc45
  gRNA
guucgugaccgauuuccgca

SEQ ID NO: 9370 - RNA, 20 nt, Artificial Sequence
  MKO10009370_A_Cdc45
  gRNA
cuacgagacgguccacaacc

SEQ ID NO: 9371 - RNA, 20 nt, Artificial Sequence
  MKO10009371_A_Cdc45
  gRNA
ugaccacguccaguauacgc

SEQ ID NO: 9372 - RNA, 20 nt, Artificial Sequence
  MKO10009372_A_Cdc5l
  gRNA
cuuuaauagguacgaauggc

SEQ ID NO: 9373 - RNA, 20 nt, Artificial Sequence
  MKO10009373_A_Cdc5l
  gRNA
caagggacaaaacugcccaa

SEQ ID NO: 9374 - RNA, 20 nt, Artificial Sequence
  MKO10009374_A_Cdc5l
  gRNA
acucauaguguuccaagcac

SEQ ID NO: 9375 - RNA, 20 nt, Artificial Sequence
  MKO10009375_A_Cdc6
  gRNA
ucucaguccccgaaaacguc

SEQ ID NO: 9376 - RNA, 20 nt, Artificial Sequence
  MKO10009376_A_Cdc6
  gRNA
uguacccaccacuccgugug

SEQ ID NO: 9377 - RNA, 20 nt, Artificial Sequence
  MKO10009377_A_Cdc6
  gRNA
gagcggaggaggaacguauc

SEQ ID NO: 9378 - RNA, 20 nt, Artificial Sequence
  MKO10009378_A_Cdc73
  gRNA
cccgaccgaaaagaucuacu

SEQ ID NO: 9379 - RNA, 20 nt, Artificial Sequence
  MKO10009379_A_Cdc73
  gRNA
aguucuauuaccucaauccg

SEQ ID NO: 9380 - RNA, 20 nt, Artificial Sequence
  MKO10009380_A_Cdc73
  gRNA
uucuacuuacagcugcacgc

SEQ ID NO: 9381 - RNA, 20 nt, Artificial Sequence
  MKO10009381_A_Cdc7
  gRNA
acauauauucccgaacuucu

SEQ ID NO: 9382 - RNA, 20 nt, Artificial Sequence
  MKO10009382_A_Cdc7
  gRNA
uagggggcaagacaauguca

SEQ ID NO: 9383 - RNA, 20 nt, Artificial Sequence
  MKO10009383_A_Cdc7
  gRNA
uucccacaagucauccuaug

SEQ ID NO: 9384 - RNA, 20 nt, Artificial Sequence
  MKO10009384_A_Cdca2
  gRNA
cuugcugacgaagcgugugc

SEQ ID NO: 9385 - RNA, 20 nt, Artificial Sequence
  MKO10009385_A_Cdca2
  gRNA
ggcacgagagccccacuucg

SEQ ID NO: 9386 - RNA, 20 nt, Artificial Sequence
  MKO10009386_A_Cdca2
  gRNA
cagcacacgcuucgucagca

SEQ ID NO: 9387 - RNA, 20 nt, Artificial Sequence
  MKO10009387_A_Cdca3
  gRNA
ugggaccuugacacuacgac

SEQ ID NO: 9388 - RNA, 20 nt, Artificial Sequence
  MKO10009388_A_Cdca3
  gRNA
ugcccucagugagaacguua

SEQ ID NO: 9389 - RNA, 20 nt, Artificial Sequence
  MKO10009389_A_Cdca3
  gRNA
ucccaaacagguguuuacca

SEQ ID NO: 9390 - RNA, 20 nt, Artificial Sequence
  MKO10009390_A_Cdca4
  gRNA
cuccccucacuguacgacac

SEQ ID NO: 9391 - RNA, 20 nt, Artificial Sequence
  MKO10009391_A_Cdca4
  gRNA
cccuggugcugagccaacga

SEQ ID NO: 9392 - RNA, 20 nt, Artificial Sequence
  MKO10009392_A_Cdca4
  gRNA
guggacaccaggcguucaac

SEQ ID NO: 9393 - RNA, 20 nt, Artificial Sequence
  MKO10009393_A_Cdca5
  gRNA
uaggacuucuucgaaccgug

SEQ ID NO: 9394 - RNA, 20 nt, Artificial Sequence
  MKO10009394_A_Cdca5
  gRNA
uacgaucuucuucaagacga

SEQ ID NO: 9395 - RNA, 20 nt, Artificial Sequence
  MKO10009395_A_Cdca5
  gRNA
cgaacucguucucugaaauc

SEQ ID NO: 9396 - RNA, 20 nt, Artificial Sequence
  MKO10009396_A_Cdca7l
  gRNA
uaguuuggacucacgggagu

SEQ ID NO: 9397 - RNA, 20 nt, Artificial Sequence
  MKO10009397_A_Cdca7l
  gRNA
cacaaacucuucaucgucac

SEQ ID NO: 9398 - RNA, 20 nt, Artificial Sequence
  MKO10009398_A_Cdca7l
  gRNA
aagugugagcuaucuuuauc

SEQ ID NO: 9399 - RNA, 20 nt, Artificial Sequence
  MKO10009399_A_Cdca7
  gRNA
acuagagacugcaguugaac

SEQ ID NO: 9400 - RNA, 20 nt, Artificial Sequence
  MKO10009400_A_Cdca7
  gRNA
ccugggaaugugcgucgucu

SEQ ID NO: 9401 - RNA, 20 nt, Artificial Sequence
  MKO10009401_A_Cdca7
  gRNA
cacguucauguagcugucca

SEQ ID NO: 9402 - RNA, 20 nt, Artificial Sequence
  MKO10009402_A_Cdca8
  gRNA
ucugucggacucaauuugcu

SEQ ID NO: 9403 - RNA, 20 nt, Artificial Sequence
  MKO10009403_A_Cdca8
  gRNA
uauagagcgaaagguaaucg

SEQ ID NO: 9404 - RNA, 20 nt, Artificial Sequence
  MKO10009404_A_Cdca8
  gRNA
uguacaacaucgagauccuu

SEQ ID NO: 9405 - RNA, 20 nt, Artificial Sequence
  MKO10009405_A_Cdcp1
  gRNA
aguucgcaaccccucgacug

SEQ ID NO: 9406 - RNA, 20 nt, Artificial Sequence
  MKO10009406_A_Cdcp1
  gRNA
uccaaucugccucagucgag

SEQ ID NO: 9407 - RNA, 20 nt, Artificial Sequence
  MKO10009407_A_Cdcp1
  gRNA
gcgaugacuugacacgccug

SEQ ID NO: 9408 - RNA, 20 nt, Artificial Sequence
  MKO10009408_A_Cdcp2
  gRNA
ugucaccucgagucgcaacc

SEQ ID NO: 9409 - RNA, 20 nt, Artificial Sequence
  MKO10009409_A_Cdcp2
  gRNA
gacgacagacaugacgugcc

SEQ ID NO: 9410 - RNA, 20 nt, Artificial Sequence
  MKO10009410_A_Cdcp2
  gRNA
caggaccugguugcgacucg

SEQ ID NO: 9411 - RNA, 20 nt, Artificial Sequence
  MKO10009411_A_Cdh10
  gRNA
guggauuaccgcauuauuga

SEQ ID NO: 9412 - RNA, 20 nt, Artificial Sequence
  MKO10009412_A_Cdh10
  gRNA
gaugccgaugacccuuccua

SEQ ID NO: 9413 - RNA, 20 nt, Artificial Sequence
  MKO10009413_A_Cdh10
  gRNA
uuccagacaaaccccccauc

SEQ ID NO: 9414 - RNA, 20 nt, Artificial Sequence
  MKO10009414_A_Cdh11
  gRNA
uugggccuccaccgagaaau

SEQ ID NO: 9415 - RNA, 20 nt, Artificial Sequence
  MKO10009415_A_Cdh11
  gRNA
uacaacagacuaugaaacac

SEQ ID NO: 9416 - RNA, 20 nt, Artificial Sequence
  MKO10009416_A_Cdh11
  gRNA
uguaucagaagcagcugucc

SEQ ID NO: 9417 - RNA, 20 nt, Artificial Sequence
  MKO10009417_A_Cdh12
  gRNA
ccaugucuuucgcuugaaug

SEQ ID NO: 9418 - RNA, 20 nt, Artificial Sequence
  MKO10009418_A_Cdh12
  gRNA
uucucagcugcauucggacu

SEQ ID NO: 9419 - RNA, 20 nt, Artificial Sequence
  MKO10009419_A_Cdh12
  gRNA
acuguuaaauacacgcucuc

SEQ ID NO: 9420 - RNA, 20 nt, Artificial Sequence
  MKO10009420_A_Cdh13
  gRNA
gucgauagcgacagacccga

SEQ ID NO: 9421 - RNA, 20 nt, Artificial Sequence
  MKO10009421_A_Cdh13
  gRNA
caaguuccggcucaccggga

SEQ ID NO: 9422 - RNA, 20 nt, Artificial Sequence
  MKO10009422_A_Cdh13
  gRNA
auggcagaacucgugauugu

SEQ ID NO: 9423 - RNA, 20 nt, Artificial Sequence
  MKO10009423_A_Cdh15
  gRNA
gguguaccucaaugccacgc

SEQ ID NO: 9424 - RNA, 20 nt, Artificial Sequence
  MKO10009424_A_Cdh15
  gRNA
uggggcugaugcccggcgcc

SEQ ID NO: 9425 - RNA, 20 nt, Artificial Sequence
  MKO10009425_A_Cdh15
  gRNA
ugaagcgguccgucuucucg

SEQ ID NO: 9426 - RNA, 20 nt, Artificial Sequence
  MKO10009426_A_Cdh16
  gRNA
gaaggccacauuguccuauc

SEQ ID NO: 9427 - RNA, 20 nt, Artificial Sequence
  MKO10009427_A_Cdh16
  gRNA
gaaagcagaauaccaacuac

SEQ ID NO: 9428 - RNA, 20 nt, Artificial Sequence
  MKO10009428_A_Cdh16
  gRNA
guggggacuggcucagaaug

SEQ ID NO: 9429 - RNA, 20 nt, Artificial Sequence
  MKO10009429_A_Cdh17
  gRNA
guuagcucgaaagucacagc

SEQ ID NO: 9430 - RNA, 20 nt, Artificial Sequence
  MKO10009430_A_Cdh17
  gRNA
gugaggcagaacucucgccc

SEQ ID NO: 9431 - RNA, 20 nt, Artificial Sequence
  MKO10009431_A_Cdh17
  gRNA
aguacauaacaucguugauu

SEQ ID NO: 9432 - RNA, 20 nt, Artificial Sequence
  MKO10009432_A_Cdh18
  gRNA
uuguccgucugucaauagcc

SEQ ID NO: 9433 - RNA, 20 nt, Artificial Sequence
  MKO10009433_A_Cdh18
  gRNA
aaucccgucuccauuaguga

SEQ ID NO: 9434 - RNA, 20 nt, Artificial Sequence
  MKO10009434_A_Cdh18
  gRNA
ucgaacagcuuuacacaaca

SEQ ID NO: 9435 - RNA, 20 nt, Artificial Sequence
  MKO10009435_A_Cdh19
  gRNA
auccuauacaacuuagaacg

SEQ ID NO: 9436 - RNA, 20 nt, Artificial Sequence
  MKO10009436_A_Cdh19
  gRNA
gacgcagaugauccuucaac

SEQ ID NO: 9437 - RNA, 20 nt, Artificial Sequence
  MKO10009437_A_Cdh19
  gRNA
uggccucauaugguucaucu

SEQ ID NO: 9438 - RNA, 20 nt, Artificial Sequence
  MKO10009438_A_Cdh1
  gRNA
cgucugucgccacuuugaau

SEQ ID NO: 9439 - RNA, 20 nt, Artificial Sequence
  MKO10009439_A_Cdh1
  gRNA
uacguacgcggugguggugc

SEQ ID NO: 9440 - RNA, 20 nt, Artificial Sequence
  MKO10009440_A_Cdh1
  gRNA
ggagcugacaaaccccccgu

SEQ ID NO: 9441 - RNA, 20 nt, Artificial Sequence
  MKO10009441_A_Cdh20
  gRNA
gguaguguacagcauucucc

SEQ ID NO: 9442 - RNA, 20 nt, Artificial Sequence
  MKO10009442_A_Cdh20
  gRNA
aaguugcccucccauaucuu

SEQ ID NO: 9443 - RNA, 20 nt, Artificial Sequence
  MKO10009443_A_Cdh20
  gRNA
uggcgauguaagguccaucc

SEQ ID NO: 9444 - RNA, 20 nt, Artificial Sequence
  MKO10009444_A_Cdh22
  gRNA
cccaggcacguccgugaugc

SEQ ID NO: 9445 - RNA, 20 nt, Artificial Sequence
  MKO10009445_A_Cdh22
  gRNA
auccacucggauucugacga

SEQ ID NO: 9446 - RNA, 20 nt, Artificial Sequence
  MKO10009446_A_Cdh22
  gRNA
gcggcccacagccguaccga

SEQ ID NO: 9447 - RNA, 20 nt, Artificial Sequence
  MKO10009447_A_Cdh23
  gRNA
ggccucccgauucuuugccg

SEQ ID NO: 9448 - RNA, 20 nt, Artificial Sequence
  MKO10009448_A_Cdh23
  gRNA
cuccacggcaaagaaucggg

SEQ ID NO: 9449 - RNA, 20 nt, Artificial Sequence
  MKO10009449_A_Cdh23
  gRNA
cucagggaugcgcacgcugu

SEQ ID NO: 9450 - RNA, 20 nt, Artificial Sequence
  MKO10009450_A_Cdh24
  gRNA
ggguuccaggggccgguuag

SEQ ID NO: 9451 - RNA, 20 nt, Artificial Sequence
  MKO10009451_A_Cdh24
  gRNA
cgguggcaugguagggcccg

SEQ ID NO: 9452 - RNA, 20 nt, Artificial Sequence
  MKO10009452_A_Cdh24
  gRNA
agcuaaccuugcggacagua

SEQ ID NO: 9453 - RNA, 20 nt, Artificial Sequence
  MKO10009453_A_Cdh26
  gRNA
ucacuucucgaucgacaggg

SEQ ID NO: 9454 - RNA, 20 nt, Artificial Sequence
  MKO10009454_A_Cdh26
  gRNA
gaugccguagaucgauccac

SEQ ID NO: 9455 - RNA, 20 nt, Artificial Sequence
  MKO10009455_A_Cdh26
  gRNA
cucgggaugcuuacauuaug

SEQ ID NO: 9456 - RNA, 20 nt, Artificial Sequence
  MKO10009456_A_Cdh2
  gRNA
uuacagcgcagucuuaccga

SEQ ID NO: 9457 - RNA, 20 nt, Artificial Sequence
  MKO10009457_A_Cdh2
  gRNA
ucguccaccuugaaaucugc

SEQ ID NO: 9458 - RNA, 20 nt, Artificial Sequence
  MKO10009458_A_Cdh2
  gRNA
uugauaaugaagaugcccgu

SEQ ID NO: 9459 - RNA, 20 nt, Artificial Sequence
  MKO10009459_A_Cdh3
  gRNA
cccuaccgagcgggcuucau

SEQ ID NO: 9460 - RNA, 20 nt, Artificial Sequence
  MKO10009460_A_Cdh3
  gRNA
gguuugcuggcuacgcagcg

SEQ ID NO: 9461 - RNA, 20 nt, Artificial Sequence
  MKO10009461_A_Cdh3
  gRNA
ggagaagauugucaaguacg

SEQ ID NO: 9462 - RNA, 20 nt, Artificial Sequence
  MKO10009462_A_Cdh4
  gRNA
acuucaaagucggggcggau

SEQ ID NO: 9463 - RNA, 20 nt, Artificial Sequence
  MKO10009463_A_Cdh4
  gRNA
aacguucccgagaacucccg

SEQ ID NO: 9464 - RNA, 20 nt, Artificial Sequence
  MKO10009464_A_Cdh4
  gRNA
guugaucuccccgaaugucc

SEQ ID NO: 9465 - RNA, 20 nt, Artificial Sequence
  MKO10009465_A_Cdh5
  gRNA
gucuuguaccaaaucgugaa

SEQ ID NO: 9466 - RNA, 20 nt, Artificial Sequence
  MKO10009466_A_Cdh5
  gRNA
gaugauacccucguuacguu

SEQ ID NO: 9467 - RNA, 20 nt, Artificial Sequence
  MKO10009467_A_Cdh5
  gRNA
gacagaccccaaacguaacg

SEQ ID NO: 9468 - RNA, 20 nt, Artificial Sequence
  MKO10009468_A_Cdh6
  gRNA
agucgucuauagcauccugc

SEQ ID NO: 9469 - RNA, 20 nt, Artificial Sequence
  MKO10009469_A_Cdh6
  gRNA
gaugcugacgacccaacaua

SEQ ID NO: 9470 - RNA, 20 nt, Artificial Sequence
  MKO10009470_A_Cdh6
  gRNA
guuugaugucaucaccgacc

SEQ ID NO: 9471 - RNA, 20 nt, Artificial Sequence
  MKO10009471_A_Cdh7
  gRNA
gaugccgaugauccuacaua

SEQ ID NO: 9472 - RNA, 20 nt, Artificial Sequence
  MKO10009472_A_Cdh7
  gRNA
gccugacaagauguacuuga

SEQ ID NO: 9473 - RNA, 20 nt, Artificial Sequence
  MKO10009473_A_Cdh7
  gRNA
aacuuacuucguggaaaucg

SEQ ID NO: 9474 - RNA, 20 nt, Artificial Sequence
  MKO10009474_A_Cdh8
  gRNA
ggaccugaaccgauucucgu

SEQ ID NO: 9475 - RNA, 20 nt, Artificial Sequence
  MKO10009475_A_Cdh8
  gRNA
cuuacccggccaacgagaau

SEQ ID NO: 9476 - RNA, 20 nt, Artificial Sequence
  MKO10009476_A_Cdh8
  gRNA
ugccagcuccaucacccgau

SEQ ID NO: 9477 - RNA, 20 nt, Artificial Sequence
  MKO10009477_A_Cdh9
  gRNA
gcaccucuuggaacucaucu

SEQ ID NO: 9478 - RNA, 20 nt, Artificial Sequence
  MKO10009478_A_Cdh9
  gRNA
uacaggucuuucgugaauuu

SEQ ID NO: 9479 - RNA, 20 nt, Artificial Sequence
  MKO10009479_A_Cdh9
  gRNA
ucuguacauucuucgugcca

SEQ ID NO: 9480 - RNA, 20 nt, Artificial Sequence
  MKO10009480_A_Cdhr1
  gRNA
gaacagggccauguucccgu

SEQ ID NO: 9481 - RNA, 20 nt, Artificial Sequence
  MKO10009481_A_Cdhr1
  gRNA
ggcagagaaagucgugauac

SEQ ID NO: 9482 - RNA, 20 nt, Artificial Sequence
  MKO10009482_A_Cdhr1
  gRNA
uccaggagccuuacaucauc

SEQ ID NO: 9483 - RNA, 20 nt, Artificial Sequence
  MKO10009483_A_Cdhr2
  gRNA
uucuccgucaacgcgaacac

SEQ ID NO: 9484 - RNA, 20 nt, Artificial Sequence
  MKO10009484_A_Cdhr2
  gRNA
cggagauaccucauugaugc

SEQ ID NO: 9485 - RNA, 20 nt, Artificial Sequence
  MKO10009485_A_Cdhr2
  gRNA
uuccccaguguucgcguuga

SEQ ID NO: 9486 - RNA, 20 nt, Artificial Sequence
  MKO10009486_A_Cdhr3
  gRNA
cgauuugcagauuuacguua

SEQ ID NO: 9487 - RNA, 20 nt, Artificial Sequence
  MKO10009487_A_Cdhr3
  gRNA
uuaccccgagggguaugcuc

SEQ ID NO: 9488 - RNA, 20 nt, Artificial Sequence
  MKO10009488_A_Cdhr3
  gRNA
guucucugccacguugcuag

SEQ ID NO: 9489 - RNA, 20 nt, Artificial Sequence
  MKO10009489_A_Cdhr5
  gRNA
agacggccugcacgugaccu

SEQ ID NO: 9490 - RNA, 20 nt, Artificial Sequence
  MKO10009490_A_Cdhr5
  gRNA
uuugcugcaggugguacgcc

SEQ ID NO: 9491 - RNA, 20 nt, Artificial Sequence
  MKO10009491_A_Cdhr5
  gRNA
ccagaccauauuuagagucg

SEQ ID NO: 9492 - RNA, 20 nt, Artificial Sequence
  MKO10009492_A_Cdip1
  gRNA
accaagaucuccuacgagau

SEQ ID NO: 9493 - RNA, 20 nt, Artificial Sequence
  MKO10009493_A_Cdip1
  gRNA
cccugaugggaccaauacug

SEQ ID NO: 9494 - RNA, 20 nt, Artificial Sequence
  MKO10009494_A_Cdip1
  gRNA
agguccuacagccccacuac

SEQ ID NO: 9495 - RNA, 20 nt, Artificial Sequence
  MKO10009495_A_Cdipt
  gRNA
guauaguagauccgaagcac

SEQ ID NO: 9496 - RNA, 20 nt, Artificial Sequence
  MKO10009496_A_Cdipt
  gRNA
cguguccaucgaaagcgucu

SEQ ID NO: 9497 - RNA, 20 nt, Artificial Sequence
  MKO10009497_A_Cdipt
  gRNA
uucggaucuacuauaccucu

SEQ ID NO: 9498 - RNA, 20 nt, Artificial Sequence
  MKO10009498_A_Cdk10
  gRNA
uccuguuucagaucgggcca

SEQ ID NO: 9499 - RNA, 20 nt, Artificial Sequence
  MKO10009499_A_Cdk10
  gRNA
ucacaccugggccuccgaga

SEQ ID NO: 9500 - RNA, 20 nt, Artificial Sequence
  MKO10009500_A_Cdk10
  gRNA
ccacucacacacgaugccau

SEQ ID NO: 9501 - RNA, 20 nt, Artificial Sequence
  MKO10009501_A_Cdk11b
  gRNA
cugaugaccgcgauuccaaa

SEQ ID NO: 9502 - RNA, 20 nt, Artificial Sequence
  MKO10009502_A_Cdk11b
  gRNA
acaucguagccauucagcag

SEQ ID NO: 9503 - RNA, 20 nt, Artificial Sequence
  MKO10009503_A_Cdk11b
  gRNA
uccugauugugaucuccauu

SEQ ID NO: 9504 - RNA, 20 nt, Artificial Sequence
  MKO10009504_A_Cdk12
  gRNA
ggaaugacgacugcgugacc

SEQ ID NO: 9505 - RNA, 20 nt, Artificial Sequence
  MKO10009505_A_Cdk12
  gRNA
caguuccaaacgguccgugg

SEQ ID NO: 9506 - RNA, 20 nt, Artificial Sequence
  MKO10009506_A_Cdk12
  gRNA
gguacccaaagaugccgcuu

SEQ ID NO: 9507 - RNA, 20 nt, Artificial Sequence
  MKO10009507_A_Cdk13
  gRNA
auccagacguacuuucuuua

SEQ ID NO: 9508 - RNA, 20 nt, Artificial Sequence
  MKO10009508_A_Cdk13
  gRNA
agccuuaaagaaaguacguc

SEQ ID NO: 9509 - RNA, 20 nt, Artificial Sequence
  MKO10009509_A_Cdk13
  gRNA
agaauaugugggccucgcua

SEQ ID NO: 9510 - RNA, 20 nt, Artificial Sequence
  MKO10009510_A_Cdk14
  gRNA
ucuaaaggugauccggcugc

SEQ ID NO: 9511 - RNA, 20 nt, Artificial Sequence
  MKO10009511_A_Cdk14
  gRNA
aagagucaccuaaaguucgg

SEQ ID NO: 9512 - RNA, 20 nt, Artificial Sequence
  MKO10009512_A_Cdk14
  gRNA
caaacuuaccgagcuggggc

SEQ ID NO: 9513 - RNA, 20 nt, Artificial Sequence
  MKO10009513_A_Cdk15
  gRNA
ccuguccuuaccuucccgga

SEQ ID NO: 9514 - RNA, 20 nt, Artificial Sequence
  MKO10009514_A_Cdk15
  gRNA
gugaaaugaagccguggaac

SEQ ID NO: 9515 - RNA, 20 nt, Artificial Sequence
  MKO10009515_A_Cdk15
  gRNA
gcugaugcccuuguaaacuu

SEQ ID NO: 9516 - RNA, 20 nt, Artificial Sequence
  MKO10009516_A_Cdk16
  gRNA
accuucccggauagcaguac

SEQ ID NO: 9517 - RNA, 20 nt, Artificial Sequence
  MKO10009517_A_Cdk16
  gRNA
caccccagagauugugcacg

SEQ ID NO: 9518 - RNA, 20 nt, Artificial Sequence
  MKO10009518_A_Cdk16
  gRNA
ucaggcagccguaugucagc

SEQ ID NO: 9519 - RNA, 20 nt, Artificial Sequence
  MKO10009519_A_Cdk17
  gRNA
ccgcaacgggggcuucuuga

SEQ ID NO: 9520 - RNA, 20 nt, Artificial Sequence
  MKO10009520_A_Cdk17
  gRNA
ccuucaagaagcccccguug

SEQ ID NO: 9521 - RNA, 20 nt, Artificial Sequence
  MKO10009521_A_Cdk17
  gRNA
gcggcucaugggcuggucaa

SEQ ID NO: 9522 - RNA, 20 nt, Artificial Sequence
  MKO10009522_A_Cdk18
  gRNA
gcccugcacugcuauucgag

SEQ ID NO: 9523 - RNA, 20 nt, Artificial Sequence
  MKO10009523_A_Cdk18
  gRNA
gaaccagcgccgauucucca

SEQ ID NO: 9524 - RNA, 20 nt, Artificial Sequence
  MKO10009524_A_Cdk18
  gRNA
ucccagucagauaucggcuu

SEQ ID NO: 9525 - RNA, 20 nt, Artificial Sequence
  MKO10009525_A_Cdk19
  gRNA
aaagugggacgcggcaccua

SEQ ID NO: 9526 - RNA, 20 nt, Artificial Sequence
  MKO10009526_A_Cdk19
  gRNA
uccauuaccuccacgcaaac

SEQ ID NO: 9527 - RNA, 20 nt, Artificial Sequence
  MKO10009527_A_Cdk19
  gRNA
cccaguuugcguggagguaa

SEQ ID NO: 9528 - RNA, 20 nt, Artificial Sequence
  MKO10009528_A_Cdk1
  gRNA
cauggauucuucacucguua

SEQ ID NO: 9529 - RNA, 20 nt, Artificial Sequence
  MKO10009529_A_Cdk1
  gRNA
ucuuucagguacuuacggug

SEQ ID NO: 9530 - RNA, 20 nt, Artificial Sequence
  MKO10009530_A_Cdk1
  gRNA
ucguguguguacacucguau

SEQ ID NO: 9531 - RNA, 20 nt, Artificial Sequence
  MKO10009531_A_Cdk20
  gRNA
cgaauuuaugcugucggacc

SEQ ID NO: 9532 - RNA, 20 nt, Artificial Sequence
  MKO10009532_A_Cdk20
  gRNA
cauacugccgagcgccauac

SEQ ID NO: 9533 - RNA, 20 nt, Artificial Sequence
  MKO10009533_A_Cdk20
  gRNA
cgagaucguugcccucaaga

SEQ ID NO: 9534 - RNA, 20 nt, Artificial Sequence
  MKO10009534_A_Cdk2ap1
  gRNA
cucucacucaccggcguuga

SEQ ID NO: 9535 - RNA, 20 nt, Artificial Sequence
  MKO10009535_A_Cdk2ap1
  gRNA
uugcaggcaucauucaugcc

SEQ ID NO: 9536 - RNA, 20 nt, Artificial Sequence
  MKO10009536_A_Cdk2ap1
  gRNA
accuggguguagccuagcga

SEQ ID NO: 9537 - RNA, 20 nt, Artificial Sequence
  MKO10009537_A_Cdk2ap2
  gRNA
agaccgcuguuuaacgacuu

SEQ ID NO: 9538 - RNA, 20 nt, Artificial Sequence
  MKO10009538_A_Cdk2ap2
  gRNA
cgggagugucccaucgccau

SEQ ID NO: 9539 - RNA, 20 nt, Artificial Sequence
  MKO10009539_A_Cdk2ap2
  gRNA
gagauccggcccaccuaugc

SEQ ID NO: 9540 - RNA, 20 nt, Artificial Sequence
  MKO10009540_A_Cdk2
  gRNA
aggccacucacgugucgagc

SEQ ID NO: 9541 - RNA, 20 nt, Artificial Sequence
  MKO10009541_A_Cdk2
  gRNA
cagacuuacuugacgauauu

SEQ ID NO: 9542 - RNA, 20 nt, Artificial Sequence
  MKO10009542_A_Cdk2
  gRNA
ggggcuuaaggucucgguga

SEQ ID NO: 9543 - RNA, 20 nt, Artificial Sequence
  MKO10009543_A_Cdk4
  gRNA
gucuacauacgcaacacccg

SEQ ID NO: 9544 - RNA, 20 nt, Artificial Sequence
  MKO10009544_A_Cdk4
  gRNA
cucaccuuaauggucucaac

SEQ ID NO: 9545 - RNA, 20 nt, Artificial Sequence
  MKO10009545_A_Cdk4
  gRNA
cucuucaggugguuacgcuc

SEQ ID NO: 9546 - RNA, 20 nt, Artificial Sequence
  MKO10009546_A_Cdk5r1
  gRNA
acccaaacgggucaucgucc

SEQ ID NO: 9547 - RNA, 20 nt, Artificial Sequence
  MKO10009547_A_Cdk5r1
  gRNA
ccuuccgauagcugggggau

SEQ ID NO: 9548 - RNA, 20 nt, Artificial Sequence
  MKO10009548_A_Cdk5r1
  gRNA
cgcgccauccucaaacagug

SEQ ID NO: 9549 - RNA, 20 nt, Artificial Sequence
  MKO10009549_A_Cdk5r2
  gRNA
gccugcacgaugacccgccg

SEQ ID NO: 9550 - RNA, 20 nt, Artificial Sequence
  MKO10009550_A_Cdk5r2
  gRNA
gucgcuucguggggacgagc

SEQ ID NO: 9551 - RNA, 20 nt, Artificial Sequence
  MKO10009551_A_Cdk5r2
  gRNA
ccgacgcugcuaccgccuca

SEQ ID NO: 9552 - RNA, 20 nt, Artificial Sequence
  MKO10009552_A_Cdk5rap1
  gRNA
agcguggccgcuuugucuuc

SEQ ID NO: 9553 - RNA, 20 nt, Artificial Sequence
  MKO10009553_A_Cdk5rap1
  gRNA
cacgcucucgaguaccucug

SEQ ID NO: 9554 - RNA, 20 nt, Artificial Sequence
  MKO10009554_A_Cdk5rap1
  gRNA
gacuggcaugauaucugcgu

SEQ ID NO: 9555 - RNA, 20 nt, Artificial Sequence
  MKO10009555_A_Cdk5rap2
  gRNA
aagucugaagcgcgagcucc

SEQ ID NO: 9556 - RNA, 20 nt, Artificial Sequence
  MKO10009556_A_Cdk5rap2
  gRNA
caccgucuuguagaugugcu

SEQ ID NO: 9557 - RNA, 20 nt, Artificial Sequence
  MKO10009557_A_Cdk5rap2
  gRNA
cgagcaacugaucuuucucc

SEQ ID NO: 9558 - RNA, 20 nt, Artificial Sequence
  MKO10009558_A_Cdk5rap3
  gRNA
ucuccuaccgagcagcuugc

SEQ ID NO: 9559 - RNA, 20 nt, Artificial Sequence
  MKO10009559_A_Cdk5rap3
  gRNA
gaucguaagccuguaugaga

SEQ ID NO: 9560 - RNA, 20 nt, Artificial Sequence
  MKO10009560_A_Cdk5rap3
  gRNA
ugucgaugggcacgugcuga

SEQ ID NO: 9561 - RNA, 20 nt, Artificial Sequence
  MKO10009561_A_Cdk5
  gRNA
caggcuggaugaugacgaug

SEQ ID NO: 9562 - RNA, 20 nt, Artificial Sequence
  MKO10009562_A_Cdk5
  gRNA
gugugccaaguucagcccuc

SEQ ID NO: 9563 - RNA, 20 nt, Artificial Sequence
  MKO10009563_A_Cdk5
  gRNA
ucagcuucuugucacuaugc

SEQ ID NO: 9564 - RNA, 20 nt, Artificial Sequence
  MKO10009564_A_Cdk6
  gRNA
uguugcaggucgucacgcug

SEQ ID NO: 9565 - RNA, 20 nt, Artificial Sequence
  MKO10009565_A_Cdk6
  gRNA
ucugaacuuccacgaaaaag

SEQ ID NO: 9566 - RNA, 20 nt, Artificial Sequence
  MKO10009566_A_Cdk6
  gRNA
cucaaacacuaguguaagcu

SEQ ID NO: 9567 - RNA, 20 nt, Artificial Sequence
  MKO10009567_A_Cdk7
  gRNA
cuaguuugcgacggucuaua

SEQ ID NO: 9568 - RNA, 20 nt, Artificial Sequence
  MKO10009568_A_Cdk7
  gRNA
cuuucuuaauggcgacgauu

SEQ ID NO: 9569 - RNA, 20 nt, Artificial Sequence
  MKO10009569_A_Cdk7
  gRNA
cccagaucaaacuuggacac

SEQ ID NO: 9570 - RNA, 20 nt, Artificial Sequence
  MKO10009570_A_Cdk8
  gRNA
uucacuaucuucaugccaac

SEQ ID NO: 9571 - RNA, 20 nt, Artificial Sequence
  MKO10009571_A_Cdk8
  gRNA
aucccugugcaacacccagu

SEQ ID NO: 9572 - RNA, 20 nt, Artificial Sequence
  MKO10009572_A_Cdk8
  gRNA
gagcgaggaagaguaaaaau

SEQ ID NO: 9573 - RNA, 20 nt, Artificial Sequence
  MKO10009573_A_Cdk9
  gRNA
gacauugugguaccggccuc

SEQ ID NO: 9574 - RNA, 20 nt, Artificial Sequence
  MKO10009574_A_Cdk9
  gRNA
cucaccguauaaccgcugca

SEQ ID NO: 9575 - RNA, 20 nt, Artificial Sequence
  MKO10009575_A_Cdk9
  gRNA
ugggcuggcuauucuuagcu

SEQ ID NO: 9576 - RNA, 20 nt, Artificial Sequence
  MKO10009576_A_Cdkal1
  gRNA
ugcucacauaauaauucgga

SEQ ID NO: 9577 - RNA, 20 nt, Artificial Sequence
  MKO10009577_A_Cdkal1
  gRNA
uuacuuaacagcacuauucc

SEQ ID NO: 9578 - RNA, 20 nt, Artificial Sequence
  MKO10009578_A_Cdkal1
  gRNA
aauaagaaaguuguccucgc

SEQ ID NO: 9579 - RNA, 20 nt, Artificial Sequence
  MKO10009579_A_Cdkl1
  gRNA
acgagcuggaucgguaucag

SEQ ID NO: 9580 - RNA, 20 nt, Artificial Sequence
  MKO10009580_A_Cdkl1
  gRNA
uaguccguguaguagucacc

SEQ ID NO: 9581 - RNA, 20 nt, Artificial Sequence
  MKO10009581_A_Cdkl1
  gRNA
guucgaguacugcgaccaca

SEQ ID NO: 9582 - RNA, 20 nt, Artificial Sequence
  MKO10009582_A_Cdkl2
  gRNA
ucaagucaucaagaaucgug

SEQ ID NO: 9583 - RNA, 20 nt, Artificial Sequence
  MKO10009583_A_Cdkl2
  gRNA
acgucaccgaccagcaguuc

SEQ ID NO: 9584 - RNA, 20 nt, Artificial Sequence
  MKO10009584_A_Cdkl2
  gRNA
ggagguuuacacugacuaug

SEQ ID NO: 9585 - RNA, 20 nt, Artificial Sequence
  MKO10009585_A_Cdkl3
  gRNA
acucaauggcgcgaaggauc

SEQ ID NO: 9586 - RNA, 20 nt, Artificial Sequence
  MKO10009586_A_Cdkl3
  gRNA
agacguuuacacagacuacg

SEQ ID NO: 9587 - RNA, 20 nt, Artificial Sequence
  MKO10009587_A_Cdkl3
  gRNA
guauacauacuuuccguagg

SEQ ID NO: 9588 - RNA, 20 nt, Artificial Sequence
  MKO10009588_A_Cdkl4
  gRNA
cuggccgggaaaauccgacg

SEQ ID NO: 9589 - RNA, 20 nt, Artificial Sequence
  MKO10009589_A_Cdkl4
  gRNA
ucacacacuguuaaacgagc

SEQ ID NO: 9590 - RNA, 20 nt, Artificial Sequence
  MKO10009590_A_Cdkl4
  gRNA
ccgagcccccgaacuucucg

SEQ ID NO: 9591 - RNA, 20 nt, Artificial Sequence
  MKO10009591_A_Cdkl5
  gRNA
uguggacgaugucguucuug

SEQ ID NO: 9592 - RNA, 20 nt, Artificial Sequence
  MKO10009592_A_Cdkl5
  gRNA
aguggauagcuuugauuagu

SEQ ID NO: 9593 - RNA, 20 nt, Artificial Sequence
  MKO10009593_A_Cdkl5
  gRNA
aaugcuucgcacucucaagc

SEQ ID NO: 9594 - RNA, 20 nt, Artificial Sequence
  MKO10009594_A_Cdkn1a
  gRNA
acuucgucugggagcgcguu

SEQ ID NO: 9595 - RNA, 20 nt, Artificial Sequence
  MKO10009595_A_Cdkn1a
  gRNA
ccaugagcgcaucgcaauca

SEQ ID NO: 9596 - RNA, 20 nt, Artificial Sequence
  MKO10009596_A_Cdkn1a
  gRNA
cuaucacuccaagcgcagau

SEQ ID NO: 9597 - RNA, 20 nt, Artificial Sequence
  MKO10009597_A_Cdkn1b
  gRNA
cuguuuacgucuggcgucga

SEQ ID NO: 9598 - RNA, 20 nt, Artificial Sequence
  MKO10009598_A_Cdkn1b
  gRNA
ugucugacgagucaggcauu

SEQ ID NO: 9599 - RNA, 20 nt, Artificial Sequence
  MKO10009599_A_Cdkn1b
  gRNA
cgccaggcggugccuuuaau

SEQ ID NO: 9600 - RNA, 20 nt, Artificial Sequence
  MKO10009600_A_Cdkn1c
  gRNA
gcgcugcuacgcgcuaucac

SEQ ID NO: 9601 - RNA, 20 nt, Artificial Sequence
  MKO10009601_A_Cdkn1c
  gRNA
gcgucgaacgacgucccucc

SEQ ID NO: 9602 - RNA, 20 nt, Artificial Sequence
  MKO10009602_A_Cdkn1c
  gRNA
cuugaucgcaccguucgcau

SEQ ID NO: 9603 - RNA, 20 nt, Artificial Sequence
  MKO10009603_A_Cdkn2aipnl
  gRNA
acgaaacugcucggcgaagu

SEQ ID NO: 9604 - RNA, 20 nt, Artificial Sequence
  MKO10009604_A_Cdkn2aipnl
  gRNA
cgccgccgucgggugggucu

SEQ ID NO: 9605 - RNA, 20 nt, Artificial Sequence
  MKO10009605_A_Cdkn2aipnl
  gRNA
cuuucucauuaguucgcuuc

SEQ ID NO: 9606 - RNA, 20 nt, Artificial Sequence
  MKO10009606_A_Cdkn2aip
  gRNA
ccauaccacacgagacgaac

SEQ ID NO: 9607 - RNA, 20 nt, Artificial Sequence
  MKO10009607_A_Cdkn2aip
  gRNA
gacgcugaaccacguuuaug

SEQ ID NO: 9608 - RNA, 20 nt, Artificial Sequence
  MKO10009608_A_Cdkn2aip
  gRNA
gcugcugaacgcggcuauug

SEQ ID NO: 9609 - RNA, 20 nt, Artificial Sequence
  MKO10009609_A_Cdkn2a
  gRNA
gugcgauauuugcguuccgc

SEQ ID NO: 9610 - RNA, 20 nt, Artificial Sequence
  MKO10009610_A_Cdkn2a
  gRNA
cccaacgccccgaacucuuu

SEQ ID NO: 9611 - RNA, 20 nt, Artificial Sequence
  MKO10009611_A_Cdkn2a
  gRNA
gggguacgaccgaaagaguu

SEQ ID NO: 9612 - RNA, 20 nt, Artificial Sequence
  MKO10009612_A_Cdkn2b
  gRNA
ggauugggcgccucccgaag

SEQ ID NO: 9613 - RNA, 20 nt, Artificial Sequence
  MKO10009613_A_Cdkn2b
  gRNA
gaccugugcacgacgcagcu

SEQ ID NO: 9614 - RNA, 20 nt, Artificial Sequence
  MKO10009614_A_Cdkn2b
  gRNA
cagggcguugggaucugcgc

SEQ ID NO: 9615 - RNA, 20 nt, Artificial Sequence
  MKO10009615_A_Cdkn2c
  gRNA
guaaacgucaacgcucaaaa

SEQ ID NO: 9616 - RNA, 20 nt, Artificial Sequence
  MKO10009616_A_Cdkn2c
  gRNA
gggggacaccgccuucgacu

SEQ ID NO: 9617 - RNA, 20 nt, Artificial Sequence
  MKO10009617_A_Cdkn2c
  gRNA
gacgccaacucguuccccca

SEQ ID NO: 9618 - RNA, 20 nt, Artificial Sequence
  MKO10009618_A_Cdkn2d
  gRNA
ggaccucuugcacgucgcca

SEQ ID NO: 9619 - RNA, 20 nt, Artificial Sequence
  MKO10009619_A_Cdkn2d
  gRNA
ugagaccggaagcgucccug

SEQ ID NO: 9620 - RNA, 20 nt, Artificial Sequence
  MKO10009620_A_Cdkn2d
  gRNA
accggaggcaucuuggacau

SEQ ID NO: 9621 - RNA, 20 nt, Artificial Sequence
  MKO10009621_A_Cdkn3
  gRNA
gaacaauucacucgcgacag

SEQ ID NO: 9622 - RNA, 20 nt, Artificial Sequence
  MKO10009622_A_Cdkn3
  gRNA
gagcacauaaaccgagaaac

SEQ ID NO: 9623 - RNA, 20 nt, Artificial Sequence
  MKO10009623_A_Cdkn3
  gRNA
caucugggaucggaugauga

SEQ ID NO: 9624 - RNA, 20 nt, Artificial Sequence
  MKO10009624_A_Cdnf
  gRNA
gauacaaaacccggcgcaaa

SEQ ID NO: 9625 - RNA, 20 nt, Artificial Sequence
  MKO10009625_A_Cdnf
  gRNA
acuuggcgucgguggaccug

SEQ ID NO: 9626 - RNA, 20 nt, Artificial Sequence
  MKO10009626_A_Cdnf
  gRNA
uuguaucucgaacccugugc

SEQ ID NO: 9627 - RNA, 20 nt, Artificial Sequence
  MKO10009627_A_Cdo1
  gRNA
aaaggcguggcauguaucga

SEQ ID NO: 9628 - RNA, 20 nt, Artificial Sequence
  MKO10009628_A_Cdo1
  gRNA
uguggcugacguucucuacu

SEQ ID NO: 9629 - RNA, 20 nt, Artificial Sequence
  MKO10009629_A_Cdo1
  gRNA
uagguauacucgaaaucuug

SEQ ID NO: 9630 - RNA, 20 nt, Artificial Sequence
  MKO10009630_A_Cdon
  gRNA
gaauaguuccccgaauccgc

SEQ ID NO: 9631 - RNA, 20 nt, Artificial Sequence
  MKO10009631_A_Cdon
  gRNA
uccucacagccccguuaccu

SEQ ID NO: 9632 - RNA, 20 nt, Artificial Sequence
  MKO10009632_A_Cdon
  gRNA
cuguuacugcccgaaucuca

SEQ ID NO: 9633 - RNA, 20 nt, Artificial Sequence
  MKO10009633_A_Cdpf1
  gRNA
acacacugcaccgagagccg

SEQ ID NO: 9634 - RNA, 20 nt, Artificial Sequence
  MKO10009634_A_Cdpf1
  gRNA
gcagccuguucuacuccaag

SEQ ID NO: 9635 - RNA, 20 nt, Artificial Sequence
  MKO10009635_A_Cdpf1
  gRNA
uucugccccacauagcugua

SEQ ID NO: 9636 - RNA, 20 nt, Artificial Sequence
  MKO10009636_A_Cdr1
  gRNA
ucccgaaaauccacgucuuc

SEQ ID NO: 9637 - RNA, 20 nt, Artificial Sequence
  MKO10009637_A_Cdr1
  gRNA
uccugaaaaucuaagucuuc

SEQ ID NO: 9638 - RNA, 20 nt, Artificial Sequence
  MKO10009638_A_Cdr1
  gRNA
gacuuggauuauuuggaaga

SEQ ID NO: 9639 - RNA, 20 nt, Artificial Sequence
  MKO10009639_A_Cdr2l
  gRNA
cggugccggagugcggcacg

SEQ ID NO: 9640 - RNA, 20 nt, Artificial Sequence
  MKO10009640_A_Cdr2l
  gRNA
uugcaccuagccgccgagcu

SEQ ID NO: 9641 - RNA, 20 nt, Artificial Sequence
  MKO10009641_A_Cdr2l
  gRNA
ugcaugccaacagugugcgc

SEQ ID NO: 9642 - RNA, 20 nt, Artificial Sequence
  MKO10009642_A_Cdr2
  gRNA
ugaucuucucagcgaacacg

SEQ ID NO: 9643 - RNA, 20 nt, Artificial Sequence
  MKO10009643_A_Cdr2
  gRNA
ccgggcucgguaggcaucug

SEQ ID NO: 9644 - RNA, 20 nt, Artificial Sequence
  MKO10009644_A_Cdr2
  gRNA
ggugaucaauguugguuugc

SEQ ID NO: 9645 - RNA, 20 nt, Artificial Sequence
  MKO10009645_A_Cdrt4
  gRNA
cggggagauguaagcgacgu

SEQ ID NO: 9646 - RNA, 20 nt, Artificial Sequence
  MKO10009646_A_Cdrt4
  gRNA
guaacccgaaucaccgaaaa

SEQ ID NO: 9647 - RNA, 20 nt, Artificial Sequence
  MKO10009647_A_Cdrt4
  gRNA
aaugguaccugaauaauucc

SEQ ID NO: 9648 - RNA, 20 nt, Artificial Sequence
  MKO10009648_A_Cds1
  gRNA
aggcacgucggaaucgccuc

SEQ ID NO: 9649 - RNA, 20 nt, Artificial Sequence
  MKO10009649_A_Cds1
  gRNA
ugaaccugugguagcgaaug

SEQ ID NO: 9650 - RNA, 20 nt, Artificial Sequence
  MKO10009650_A_Cds1
  gRNA
cauauccuucgcccucuacc

SEQ ID NO: 9651 - RNA, 20 nt, Artificial Sequence
  MKO10009651_A_Cds2
  gRNA
gacggacuacuucuucacuc

SEQ ID NO: 9652 - RNA, 20 nt, Artificial Sequence
  MKO10009652_A_Cds2
  gRNA
aaugaagaaaaacgcgauca

SEQ ID NO: 9653 - RNA, 20 nt, Artificial Sequence
  MKO10009653_A_Cds2
  gRNA
gucugacagcgagagccgag

SEQ ID NO: 9654 - RNA, 20 nt, Artificial Sequence
  MKO10009654_A_Cdsn
  gRNA
ugaauucucguacccgagca

SEQ ID NO: 9655 - RNA, 20 nt, Artificial Sequence
  MKO10009655_A_Cdsn
  gRNA
auucggggaggugauccucg

SEQ ID NO: 9656 - RNA, 20 nt, Artificial Sequence
  MKO10009656_A_Cdsn
  gRNA
gcaccccggauggggagugu

SEQ ID NO: 9657 - RNA, 20 nt, Artificial Sequence
  MKO10009657_A_Cdt1
  gRNA
cacgucguaucgcuuccgcc

SEQ ID NO: 9658 - RNA, 20 nt, Artificial Sequence
  MKO10009658_A_Cdt1
  gRNA
gcgauacgacgugggauaca

SEQ ID NO: 9659 - RNA, 20 nt, Artificial Sequence
  MKO10009659_A_Cdt1
  gRNA
aguugagauguuccgcagca

SEQ ID NO: 9660 - RNA, 20 nt, Artificial Sequence
  MKO10009660_A_Cdv3
  gRNA
gcgccuccugcuccaguaac

SEQ ID NO: 9661 - RNA, 20 nt, Artificial Sequence
  MKO10009661_A_Cdv3
  gRNA
gaguucaggcaaugcaaaua

SEQ ID NO: 9662 - RNA, 20 nt, Artificial Sequence
  MKO10009662_A_Cdv3
  gRNA
ucuauuaguuacagaaaccc

SEQ ID NO: 9663 - RNA, 20 nt, Artificial Sequence
  MKO10009663_A_Cdx1
  gRNA
gcugcgccgcauccauucgu

SEQ ID NO: 9664 - RNA, 20 nt, Artificial Sequence
  MKO10009664_A_Cdx1
  gRNA
uauccggcgcaaguccgagc

SEQ ID NO: 9665 - RNA, 20 nt, Artificial Sequence
  MKO10009665_A_Cdx1
  gRNA
cagccagcucggacuugcgc

SEQ ID NO: 9666 - RNA, 20 nt, Artificial Sequence
  MKO10009666_A_Cdx2
  gRNA
agcggcgaaaccugugcgag

SEQ ID NO: 9667 - RNA, 20 nt, Artificial Sequence
  MKO10009667_A_Cdx2
  gRNA
ggcggcugcuacggcgaacu

SEQ ID NO: 9668 - RNA, 20 nt, Artificial Sequence
  MKO10009668_A_Cdx2
  gRNA
uuagucgauacaucaccauc

SEQ ID NO: 9669 - RNA, 20 nt, Artificial Sequence
  MKO10009669_A_Cdx4
  gRNA
accgccguugcuugcaccgc

SEQ ID NO: 9670 - RNA, 20 nt, Artificial Sequence
  MKO10009670_A_Cdx4
  gRNA
ugaggguaacccacguagug

SEQ ID NO: 9671 - RNA, 20 nt, Artificial Sequence
  MKO10009671_A_Cdx4
  gRNA
augaccugcuguaucucgau

SEQ ID NO: 9672 - RNA, 20 nt, Artificial Sequence
  MKO10009672_A_Cdyl2
  gRNA
aguuuaucgacgaguucaac

SEQ ID NO: 9673 - RNA, 20 nt, Artificial Sequence
  MKO10009673_A_Cdyl2
  gRNA
cgggucccaucagccggauc

SEQ ID NO: 9674 - RNA, 20 nt, Artificial Sequence
  MKO10009674_A_Cdyl2
  gRNA
cgcuggacagccggccgauc

SEQ ID NO: 9675 - RNA, 20 nt, Artificial Sequence
  MKO10009675_A_Cdyl
  gRNA
cgugccuaagagccccguua

SEQ ID NO: 9676 - RNA, 20 nt, Artificial Sequence
  MKO10009676_A_Cdyl
  gRNA
aaacgcaaccgcuugucaaa

SEQ ID NO: 9677 - RNA, 20 nt, Artificial Sequence
  MKO10009677_A_Cdyl
  gRNA
cagaaccagcuugcugucgu

SEQ ID NO: 9678 - RNA, 20 nt, Artificial Sequence
  MKO10009678_A_Ceacam10
  gRNA
aaauagcauaucuagugcgu

SEQ ID NO: 9679 - RNA, 20 nt, Artificial Sequence
  MKO10009679_A_Ceacam10
  gRNA
uccgagcaauuuacugguac

SEQ ID NO: 9680 - RNA, 20 nt, Artificial Sequence
  MKO10009680_A_Ceacam10
  gRNA
auuguugucugcaguaacgu

SEQ ID NO: 9681 - RNA, 20 nt, Artificial Sequence
  MKO10009681_A_Ceacam11
  gRNA
cucgaagagucgaagacgag

SEQ ID NO: 9682 - RNA, 20 nt, Artificial Sequence
  MKO10009682_A_Ceacam11
  gRNA
cgacucuucgagaaagucca

SEQ ID NO: 9683 - RNA, 20 nt, Artificial Sequence
  MKO10009683_A_Ceacam11
  gRNA
caccuuccgaaccauaucug

SEQ ID NO: 9684 - RNA, 20 nt, Artificial Sequence
  MKO10009684_A_Ceacam12
  gRNA
cagccuacgaaccauaccug

SEQ ID NO: 9685 - RNA, 20 nt, Artificial Sequence
  MKO10009685_A_Ceacam12
  gRNA
uucgacauccuuuguugaug

SEQ ID NO: 9686 - RNA, 20 nt, Artificial Sequence
  MKO10009686_A_Ceacam12
  gRNA
acgcauuauuucacgucuug

SEQ ID NO: 9687 - RNA, 20 nt, Artificial Sequence
  MKO10009687_A_Ceacam13
  gRNA
ccuguaaagacugcaccucu

SEQ ID NO: 9688 - RNA, 20 nt, Artificial Sequence
  MKO10009688_A_Ceacam13
  gRNA
agagugaaaguacgcaauga

SEQ ID NO: 9689 - RNA, 20 nt, Artificial Sequence
  MKO10009689_A_Ceacam13
  gRNA
uuccaucuaggcccacuauu

SEQ ID NO: 9690 - RNA, 20 nt, Artificial Sequence
  MKO10009690_A_Ceacam14
  gRNA
agauugacaguacgcaacga

SEQ ID NO: 9691 - RNA, 20 nt, Artificial Sequence
  MKO10009691_A_Ceacam14
  gRNA
uucucaacucaaaauugcgu

SEQ ID NO: 9692 - RNA, 20 nt, Artificial Sequence
  MKO10009692_A_Ceacam14
  gRNA
agacuuuaacauucuucggc

SEQ ID NO: 9693 - RNA, 20 nt, Artificial Sequence
  MKO10009693_A_Ceacam15
  gRNA
uccaaguugaagcgaaucgc

SEQ ID NO: 9694 - RNA, 20 nt, Artificial Sequence
  MKO10009694_A_Ceacam15
  gRNA
uccagcgauucgcuucaacu

SEQ ID NO: 9695 - RNA, 20 nt, Artificial Sequence
  MKO10009695_A_Ceacam15
  gRNA
cgacacgcaggugagaauug

SEQ ID NO: 9696 - RNA, 20 nt, Artificial Sequence
  MKO10009696_A_Ceacam16
  gRNA
aucgcuggcccggcgcacac

SEQ ID NO: 9697 - RNA, 20 nt, Artificial Sequence
  MKO10009697_A_Ceacam16
  gRNA
ugaaggauagcuacucguuc

SEQ ID NO: 9698 - RNA, 20 nt, Artificial Sequence
  MKO10009698_A_Ceacam16
  gRNA
ucugccaguugccguccgcu

SEQ ID NO: 9699 - RNA, 20 nt, Artificial Sequence
  MKO10009699_A_Ceacam18
  gRNA
uaaccgcaugacgauuuccc

SEQ ID NO: 9700 - RNA, 20 nt, Artificial Sequence
  MKO10009700_A_Ceacam18
  gRNA
ugcuuaggaaggagccguua

SEQ ID NO: 9701 - RNA, 20 nt, Artificial Sequence
  MKO10009701_A_Ceacam18
  gRNA
cacauaccaacugauguucg

SEQ ID NO: 9702 - RNA, 20 nt, Artificial Sequence
  MKO10009702_A_Ceacam19
  gRNA
aucacuccuaggugcacgcg

SEQ ID NO: 9703 - RNA, 20 nt, Artificial Sequence
  MKO10009703_A_Ceacam19
  gRNA
auguccuggucacucgaagc

SEQ ID NO: 9704 - RNA, 20 nt, Artificial Sequence
  MKO10009704_A_Ceacam19
  gRNA
agcuacauggacguuaaucu

SEQ ID NO: 9705 - RNA, 20 nt, Artificial Sequence
  MKO10009705_A_Ceacam1
  gRNA
uccaaugucauucgacaagc

SEQ ID NO: 9706 - RNA, 20 nt, Artificial Sequence
  MKO10009706_A_Ceacam1
  gRNA
ugaaaacuaucgucguacuc

SEQ ID NO: 9707 - RNA, 20 nt, Artificial Sequence
  MKO10009707_A_Ceacam1
  gRNA
aucgugauuggaguuguggc

SEQ ID NO: 9708 - RNA, 20 nt, Artificial Sequence
  MKO10009708_A_Ceacam20
  gRNA
gucaccaacuugucccgccu

SEQ ID NO: 9709 - RNA, 20 nt, Artificial Sequence
  MKO10009709_A_Ceacam20
  gRNA
uguugcuaagcaggucggca

SEQ ID NO: 9710 - RNA, 20 nt, Artificial Sequence
  MKO10009710_A_Ceacam20
  gRNA
cucacaguucaccgucagcg

SEQ ID NO: 9711 - RNA, 20 nt, Artificial Sequence
  MKO10009711_A_Ceacam2
  gRNA
cagaucaaaacuaucgucgu

SEQ ID NO: 9712 - RNA, 20 nt, Artificial Sequence
  MKO10009712_A_Ceacam2
  gRNA
uugacggucuuucgacaagc

SEQ ID NO: 9713 - RNA, 20 nt, Artificial Sequence
  MKO10009713_A_Ceacam2
  gRNA
gccggggugauucuaauagc

SEQ ID NO: 9714 - RNA, 20 nt, Artificial Sequence
  MKO10009714_A_Ceacam3
  gRNA
guaaggauucgaugucgacu

SEQ ID NO: 9715 - RNA, 20 nt, Artificial Sequence
  MKO10009715_A_Ceacam3
  gRNA
gauuguguucaagaaucucg

SEQ ID NO: 9716 - RNA, 20 nt, Artificial Sequence
  MKO10009716_A_Ceacam3
  gRNA
aacuggaucgaucgugagug

SEQ ID NO: 9717 - RNA, 20 nt, Artificial Sequence
  MKO10009717_A_Ceacam5
  gRNA
cauguuuauuuaugauucgu

SEQ ID NO: 9718 - RNA, 20 nt, Artificial Sequence
  MKO10009718_A_Ceacam5
  gRNA
acccagcacaguaacuuuag

SEQ ID NO: 9719 - RNA, 20 nt, Artificial Sequence
  MKO10009719_A_Ceacam5
  gRNA
gugauaacaagucaaaagau

SEQ ID NO: 9720 - RNA, 20 nt, Artificial Sequence
  MKO10009720_A_Ceacam9
  gRNA
guuuccgccuucggcaacca

SEQ ID NO: 9721 - RNA, 20 nt, Artificial Sequence
  MKO10009721_A_Ceacam9
  gRNA
cgaagagcuacgaagucgca

SEQ ID NO: 9722 - RNA, 20 nt, Artificial Sequence
  MKO10009722_A_Ceacam9
  gRNA
caucuuagagcuguagccgu

SEQ ID NO: 9723 - RNA, 20 nt, Artificial Sequence
  MKO10009723_A_Cebpa
  gRNA
ggagucggccgacuucuacg

SEQ ID NO: 9724 - RNA, 20 nt, Artificial Sequence
  MKO10009724_A_Cebpa
  gRNA
gcacgcgucucccgcgcacc

SEQ ID NO: 9725 - RNA, 20 nt, Artificial Sequence
  MKO10009725_A_Cebpa
  gRNA
gcgccccgacgcgcucguac

SEQ ID NO: 9726 - RNA, 20 nt, Artificial Sequence
  MKO10009726_A_Cebpb
  gRNA
cgcguucaugcaccgccugc

SEQ ID NO: 9727 - RNA, 20 nt, Artificial Sequence
  MKO10009727_A_Cebpb
  gRNA
gcgcagggcgaacgggaaac

SEQ ID NO: 9728 - RNA, 20 nt, Artificial Sequence
  MKO10009728_A_Cebpb
  gRNA
cggcuuggcgccguagucgu

SEQ ID NO: 9729 - RNA, 20 nt, Artificial Sequence
  MKO10009729_A_Cebpd
  gRNA
cgcucaagcgcgaacccgac

SEQ ID NO: 9730 - RNA, 20 nt, Artificial Sequence
  MKO10009730_A_Cebpd
  gRNA
cgagaagcugcaucagcgcg

SEQ ID NO: 9731 - RNA, 20 nt, Artificial Sequence
  MKO10009731_A_Cebpd
  gRNA
cgccgacugccgguaacgcg

SEQ ID NO: 9732 - RNA, 20 nt, Artificial Sequence
  MKO10009732_A_Cebpe
  gRNA
uguuacguucacgucgcagu

SEQ ID NO: 9733 - RNA, 20 nt, Artificial Sequence
  MKO10009733_A_Cebpe
  gRNA
gcgaauggccgagggucagc

SEQ ID NO: 9734 - RNA, 20 nt, Artificial Sequence
  MKO10009734_A_Cebpe
  gRNA
cucuccgccuacaucgaguc

SEQ ID NO: 9735 - RNA, 20 nt, Artificial Sequence
  MKO10009735_A_Cebpg
  gRNA
uucgucacuauuccgaucca

SEQ ID NO: 9736 - RNA, 20 nt, Artificial Sequence
  MKO10009736_A_Cebpg
  gRNA
uauuguuccgcucucugcgc

SEQ ID NO: 9737 - RNA, 20 nt, Artificial Sequence
  MKO10009737_A_Cebpg
  gRNA
cgcuguaguuuccgugcuga

SEQ ID NO: 9738 - RNA, 20 nt, Artificial Sequence
  MKO10009738_A_Cebpz
  gRNA
cgaagaaaacuucguugacg

SEQ ID NO: 9739 - RNA, 20 nt, Artificial Sequence
  MKO10009739_A_Cebpz
  gRNA
uuguacuuggacacgacauc

SEQ ID NO: 9740 - RNA, 20 nt, Artificial Sequence
  MKO10009740_A_Cebpz
  gRNA
accauugacgaccuucaaca

SEQ ID NO: 9741 - RNA, 20 nt, Artificial Sequence
  MKO10009741_A_Cecr2
  gRNA
aucucuacucgaguacgcag

SEQ ID NO: 9742 - RNA, 20 nt, Artificial Sequence
  MKO10009742_A_Cecr2
  gRNA
aagauaucauuaacuaccgu

SEQ ID NO: 9743 - RNA, 20 nt, Artificial Sequence
  MKO10009743_A_Cecr2
  gRNA
uccaaagcgaaaaaagcuac

SEQ ID NO: 9744 - RNA, 20 nt, Artificial Sequence
  MKO10009744_A_Cecr5
  gRNA
acaugguggaccuucagcgg

SEQ ID NO: 9745 - RNA, 20 nt, Artificial Sequence
  MKO10009745_A_Cecr5
  gRNA
ucguagcguucucccaccuu

SEQ ID NO: 9746 - RNA, 20 nt, Artificial Sequence
  MKO10009746_A_Cecr5
  gRNA
acgcucuggcguucuccacc

SEQ ID NO: 9747 - RNA, 20 nt, Artificial Sequence
  MKO10009747_A_Cecr6
  gRNA
uuggaucgccaccgaccucg

SEQ ID NO: 9748 - RNA, 20 nt, Artificial Sequence
  MKO10009748_A_Cecr6
  gRNA
gggcgcgcccgccucgcuaa

SEQ ID NO: 9749 - RNA, 20 nt, Artificial Sequence
  MKO10009749_A_Cecr6
  gRNA
ccuagugcgugccauuagcg

SEQ ID NO: 9750 - RNA, 20 nt, Artificial Sequence
  MKO10009750_A_Cela1
  gRNA
uccggaaacugacgcccgcg

SEQ ID NO: 9751 - RNA, 20 nt, Artificial Sequence
  MKO10009751_A_Cela1
  gRNA
gacaaccacucgauaaguca

SEQ ID NO: 9752 - RNA, 20 nt, Artificial Sequence
  MKO10009752_A_Cela1
  gRNA
gcacccucauccgaagcaac

SEQ ID NO: 9753 - RNA, 20 nt, Artificial Sequence
  MKO10009753_A_Cela2a
  gRNA
cauacccauugccgacguuu

SEQ ID NO: 9754 - RNA, 20 nt, Artificial Sequence
  MKO10009754_A_Cela2a
  gRNA
agguggaacucccaaaacgu

SEQ ID NO: 9755 - RNA, 20 nt, Artificial Sequence
  MKO10009755_A_Cela2a
  gRNA
guaccccacuuaugaggugg

SEQ ID NO: 9756 - RNA, 20 nt, Artificial Sequence
  MKO10009756_A_Cela3b
  gRNA
caggacuucucgcaccuacc

SEQ ID NO: 9757 - RNA, 20 nt, Artificial Sequence
  MKO10009757_A_Cela3b
  gRNA
guggaacucacgagaugcag

SEQ ID NO: 9758 - RNA, 20 nt, Artificial Sequence
  MKO10009758_A_Cela3b
  gRNA
ccccagcaaugacaucgccc

SEQ ID NO: 9759 - RNA, 20 nt, Artificial Sequence
  MKO10009759_A_Celf1
  gRNA
uugaagagugccggauauug

SEQ ID NO: 9760 - RNA, 20 nt, Artificial Sequence
  MKO10009760_A_Celf1
  gRNA
ccaccucugcucaagccauc

SEQ ID NO: 9761 - RNA, 20 nt, Artificial Sequence
  MKO10009761_A_Celf1
  gRNA
cagggaggaccuucauguua

SEQ ID NO: 9762 - RNA, 20 nt, Artificial Sequence
  MKO10009762_A_Celf2
  gRNA
cauucuucuaucugaccgaa

SEQ ID NO: 9763 - RNA, 20 nt, Artificial Sequence
  MKO10009763_A_Celf2
  gRNA
uagaagaaugccggauucuc

SEQ ID NO: 9764 - RNA, 20 nt, Artificial Sequence
  MKO10009764_A_Celf2
  gRNA
ucuaccagaucaacguccuc

SEQ ID NO: 9765 - RNA, 20 nt, Artificial Sequence
  MKO10009765_A_Celf3
  gRNA
aaucgcgagcacaguacguc

SEQ ID NO: 9766 - RNA, 20 nt, Artificial Sequence
  MKO10009766_A_Celf3
  gRNA
uggggcucaccgguaggguc

SEQ ID NO: 9767 - RNA, 20 nt, Artificial Sequence
  MKO10009767_A_Celf3
  gRNA
ggagagucuucuguucgugc

SEQ ID NO: 9768 - RNA, 20 nt, Artificial Sequence
  MKO10009768_A_Celf4
  gRNA
cgacgugcgccgccucuucg

SEQ ID NO: 9769 - RNA, 20 nt, Artificial Sequence
  MKO10009769_A_Celf4
  gRNA
agccuguccguuugcuaacg

SEQ ID NO: 9770 - RNA, 20 nt, Artificial Sequence
  MKO10009770_A_Celf4
  gRNA
gcacccuugcuguugccguc

SEQ ID NO: 9771 - RNA, 20 nt, Artificial Sequence
  MKO10009771_A_Celf5
  gRNA
gcacucgucuaugacgccaa

SEQ ID NO: 9772 - RNA, 20 nt, Artificial Sequence
  MKO10009772_A_Celf5
  gRNA
acagauggcgcggccgaucc

SEQ ID NO: 9773 - RNA, 20 nt, Artificial Sequence
  MKO10009773_A_Celf5
  gRNA
ccggcagacagugaaagccg

SEQ ID NO: 9774 - RNA, 20 nt, Artificial Sequence
  MKO10009774_A_Celf6
  gRNA
acacgguagccggacaauga

SEQ ID NO: 9775 - RNA, 20 nt, Artificial Sequence
  MKO10009775_A_Celf6
  gRNA
ggacagugcacuccucgaua

SEQ ID NO: 9776 - RNA, 20 nt, Artificial Sequence
  MKO10009776_A_Celf6
  gRNA
aguccggacgguaccaguaa

SEQ ID NO: 9777 - RNA, 20 nt, Artificial Sequence
  MKO10009777_A_Celsr1
  gRNA
ggccugagcgaacguucacc

SEQ ID NO: 9778 - RNA, 20 nt, Artificial Sequence
  MKO10009778_A_Celsr1
  gRNA
cuuugcuacuccaauccgug

SEQ ID NO: 9779 - RNA, 20 nt, Artificial Sequence
  MKO10009779_A_Celsr1
  gRNA
ugaaguggaagcguugccgc

SEQ ID NO: 9780 - RNA, 20 nt, Artificial Sequence
  MKO10009780_A_Celsr2
  gRNA
gagcacgcgcugcgccgaga

SEQ ID NO: 9781 - RNA, 20 nt, Artificial Sequence
  MKO10009781_A_Celsr2
  gRNA
caguagcccguuacgcuccu

SEQ ID NO: 9782 - RNA, 20 nt, Artificial Sequence
  MKO10009782_A_Celsr2
  gRNA
acaucgcauguaauucucgc

SEQ ID NO: 9783 - RNA, 20 nt, Artificial Sequence
  MKO10009783_A_Celsr3
  gRNA
cccgacuuaccggugaagcg

SEQ ID NO: 9784 - RNA, 20 nt, Artificial Sequence
  MKO10009784_A_Celsr3
  gRNA
cacgcgccgccauugcgaca

SEQ ID NO: 9785 - RNA, 20 nt, Artificial Sequence
  MKO10009785_A_Celsr3
  gRNA
ggaagcgcugucgaaggccg

SEQ ID NO: 9786 - RNA, 20 nt, Artificial Sequence
  MKO10009786_A_Cel
  gRNA
cacaaugacguugccccgag

SEQ ID NO: 9787 - RNA, 20 nt, Artificial Sequence
  MKO10009787_A_Cel
  gRNA
cgaucuccuccccgucauac

SEQ ID NO: 9788 - RNA, 20 nt, Artificial Sequence
  MKO10009788_A_Cel
  gRNA
guuaucagggucccccccaa

SEQ ID NO: 9789 - RNA, 20 nt, Artificial Sequence
  MKO10009789_A_Cend1
  gRNA
ggugucuucuucguagcggc

SEQ ID NO: 9790 - RNA, 20 nt, Artificial Sequence
  MKO10009790_A_Cend1
  gRNA
gcugggggcugccggcacug

SEQ ID NO: 9791 - RNA, 20 nt, Artificial Sequence
  MKO10009791_A_Cend1
  gRNA
aaaaccaucauggaaucccg

SEQ ID NO: 9792 - RNA, 20 nt, Artificial Sequence
  MKO10009792_A_Cenpa
  gRNA
cgguuugcgacgcgggccca

SEQ ID NO: 9793 - RNA, 20 nt, Artificial Sequence
  MKO10009793_A_Cenpa
  gRNA
cgugacccgaccagcaugua

SEQ ID NO: 9794 - RNA, 20 nt, Artificial Sequence
  MKO10009794_A_Cenpa
  gRNA
uacacuggagcucugucgcg

SEQ ID NO: 9795 - RNA, 20 nt, Artificial Sequence
  MKO10009795_A_Cenpb
  gRNA
cguacuugcgcuccgacgcc

SEQ ID NO: 9796 - RNA, 20 nt, Artificial Sequence
  MKO10009796_A_Cenpb
  gRNA
gcgcgaucucgcccuugcgu

SEQ ID NO: 9797 - RNA, 20 nt, Artificial Sequence
  MKO10009797_A_Cenpb
  gRNA
gucggagcgcaaguacggag

SEQ ID NO: 9798 - RNA, 20 nt, Artificial Sequence
  MKO10009798_A_Cenpc1
  gRNA
gcagagcccagugaagccgc

SEQ ID NO: 9799 - RNA, 20 nt, Artificial Sequence
  MKO10009799_A_Cenpc1
  gRNA
auaccaaccugauccaccag

SEQ ID NO: 9800 - RNA, 20 nt, Artificial Sequence
  MKO10009800_A_Cenpc1
  gRNA
acuaccacagaagauauugc

SEQ ID NO: 9801 - RNA, 20 nt, Artificial Sequence
  MKO10009801_A_Cenpe
  gRNA
gugucuucccgaauuaucaa

SEQ ID NO: 9802 - RNA, 20 nt, Artificial Sequence
  MKO10009802_A_Cenpe
  gRNA
aucaucagcuccgccauaca

SEQ ID NO: 9803 - RNA, 20 nt, Artificial Sequence
  MKO10009803_A_Cenpe
  gRNA
acagguacuauauuugccua

SEQ ID NO: 9804 - RNA, 20 nt, Artificial Sequence
  MKO10009804_A_Cenpf
  gRNA
gauggagauaugcgaacauu

SEQ ID NO: 9805 - RNA, 20 nt, Artificial Sequence
  MKO10009805_A_Cenpf
  gRNA
caauacugacucggugugag

SEQ ID NO: 9806 - RNA, 20 nt, Artificial Sequence
  MKO10009806_A_Cenpf
  gRNA
cugccgauugugcaacuugu

SEQ ID NO: 9807 - RNA, 20 nt, Artificial Sequence
  MKO10009807_A_Cenph
  gRNA
ugacuuacuugugucgauca

SEQ ID NO: 9808 - RNA, 20 nt, Artificial Sequence
  MKO10009808_A_Cenph
  gRNA
ugaaaagucuugcacugagc

SEQ ID NO: 9809 - RNA, 20 nt, Artificial Sequence
  MKO10009809_A_Cenph
  gRNA
ugaaacuuucaguugcacuu

SEQ ID NO: 9810 - RNA, 20 nt, Artificial Sequence
  MKO10009810_A_Cenpi
  gRNA
ccgugcuuaaagcaguaucc

SEQ ID NO: 9811 - RNA, 20 nt, Artificial Sequence
  MKO10009811_A_Cenpi
  gRNA
uauaacaaauggcaaacgua

SEQ ID NO: 9812 - RNA, 20 nt, Artificial Sequence
  MKO10009812_A_Cenpi
  gRNA
uuacuuagugaagcuuucuu

SEQ ID NO: 9813 - RNA, 20 nt, Artificial Sequence
  MKO10009813_A_Cenpj
  gRNA
ucugcacagcacgcguuucc

SEQ ID NO: 9814 - RNA, 20 nt, Artificial Sequence
  MKO10009814_A_Cenpj
  gRNA
cuccgggagagcgaugcuuc

SEQ ID NO: 9815 - RNA, 20 nt, Artificial Sequence
  MKO10009815_A_Cenpj
  gRNA
gggaaggugcuuugccacgu

SEQ ID NO: 9816 - RNA, 20 nt, Artificial Sequence
  MKO10009816_A_Cenpk
  gRNA
acucacgaaugcagaugcuc

SEQ ID NO: 9817 - RNA, 20 nt, Artificial Sequence
  MKO10009817_A_Cenpk
  gRNA
cagaauaaauuaucacuuau

SEQ ID NO: 9818 - RNA, 20 nt, Artificial Sequence
  MKO10009818_A_Cenpk
  gRNA
aaauguuugacugcugaacu

SEQ ID NO: 9819 - RNA, 20 nt, Artificial Sequence
  MKO10009819_A_Cenpl
  gRNA
ugagacacgaaccaaucuug

SEQ ID NO: 9820 - RNA, 20 nt, Artificial Sequence
  MKO10009820_A_Cenpl
  gRNA
agucaguccucgaaaaucac

SEQ ID NO: 9821 - RNA, 20 nt, Artificial Sequence
  MKO10009821_A_Cenpl
  gRNA
auucaguaguagccauauaa

SEQ ID NO: 9822 - RNA, 20 nt, Artificial Sequence
  MKO10009822_A_Cenpm
  gRNA
augacugugcguccgagcug

SEQ ID NO: 9823 - RNA, 20 nt, Artificial Sequence
  MKO10009823_A_Cenpm
  gRNA
acaagcugcccgaccugaac

SEQ ID NO: 9824 - RNA, 20 nt, Artificial Sequence
  MKO10009824_A_Cenpm
  gRNA
ccgcugagaugucggugcug

SEQ ID NO: 9825 - RNA, 20 nt, Artificial Sequence
  MKO10009825_A_Cenpn
  gRNA
ggauaauacaccacgaacgu

SEQ ID NO: 9826 - RNA, 20 nt, Artificial Sequence
  MKO10009826_A_Cenpn
  gRNA
ccaguacaagcccacguucg

SEQ ID NO: 9827 - RNA, 20 nt, Artificial Sequence
  MKO10009827_A_Cenpn
  gRNA
gcgugcaagucuugaugacg

SEQ ID NO: 9828 - RNA, 20 nt, Artificial Sequence
  MKO10009828_A_Cenpo
  gRNA
uugccgcaguucucgaaucu

SEQ ID NO: 9829 - RNA, 20 nt, Artificial Sequence
  MKO10009829_A_Cenpo
  gRNA
ucuggaggcauaucgcuuua

SEQ ID NO: 9830 - RNA, 20 nt, Artificial Sequence
  MKO10009830_A_Cenpo
  gRNA
gaauaccuaaaugccuacgc

SEQ ID NO: 9831 - RNA, 20 nt, Artificial Sequence
  MKO10009831_A_Cenpp
  gRNA
cccacuccucagaaucugau

SEQ ID NO: 9832 - RNA, 20 nt, Artificial Sequence
  MKO10009832_A_Cenpp
  gRNA
cuacagaaacacagauuauc

SEQ ID NO: 9833 - RNA, 20 nt, Artificial Sequence
  MKO10009833_A_Cenpp
  gRNA
guuuacaaugucuuccaucu

SEQ ID NO: 9834 - RNA, 20 nt, Artificial Sequence
  MKO10009834_A_Cenpq
  gRNA
caacguauguucaucuaaaa

SEQ ID NO: 9835 - RNA, 20 nt, Artificial Sequence
  MKO10009835_A_Cenpq
  gRNA
ggcauaccugcagugaagcc

SEQ ID NO: 9836 - RNA, 20 nt, Artificial Sequence
  MKO10009836_A_Cenpq
  gRNA
gcaaagcaucuguccucuaa

SEQ ID NO: 9837 - RNA, 20 nt, Artificial Sequence
  MKO10009837_A_Cenpt
  gRNA
ggcagaucgacucguguuca

SEQ ID NO: 9838 - RNA, 20 nt, Artificial Sequence
  MKO10009838_A_Cenpt
  gRNA
cucaaacgccauacucuaac

SEQ ID NO: 9839 - RNA, 20 nt, Artificial Sequence
  MKO10009839_A_Cenpt
  gRNA
gccacuucugguacuugugc

SEQ ID NO: 9840 - RNA, 20 nt, Artificial Sequence
  MKO10009840_A_Cenpu
  gRNA
uagauagccguacugugcag

SEQ ID NO: 9841 - RNA, 20 nt, Artificial Sequence
  MKO10009841_A_Cenpu
  gRNA
gaggagacuuacgaaaccuu

SEQ ID NO: 9842 - RNA, 20 nt, Artificial Sequence
  MKO10009842_A_Cenpu
  gRNA
uucugaugccucaagcauac

SEQ ID NO: 9843 - RNA, 20 nt, Artificial Sequence
  MKO10009843_A_Cenpv
  gRNA
agcgcggaguauagaagcuc

SEQ ID NO: 9844 - RNA, 20 nt, Artificial Sequence
  MKO10009844_A_Cenpv
  gRNA
uauacuccgcgcuccaaccc

SEQ ID NO: 9845 - RNA, 20 nt, Artificial Sequence
  MKO10009845_A_Cenpv
  gRNA
aggaguuugaaccgagaagc

SEQ ID NO: 9846 - RNA, 20 nt, Artificial Sequence
  MKO10009846_A_Cenpw
  gRNA
cuuuacccgccuagugacug

SEQ ID NO: 9847 - RNA, 20 nt, Artificial Sequence
  MKO10009847_A_Cenpw
  gRNA
ucauguacuggcugcaggaa

SEQ ID NO: 9848 - RNA, 20 nt, Artificial Sequence
  MKO10009848_A_Cenpw
  gRNA
ggggaggugcugcgaccucc

SEQ ID NO: 9849 - RNA, 20 nt, Artificial Sequence
  MKO10009849_A_Cep104
  gRNA
cuuugcuagagaucauguac

SEQ ID NO: 9850 - RNA, 20 nt, Artificial Sequence
  MKO10009850_A_Cep104
  gRNA
gucgaucagcuucucccuag

SEQ ID NO: 9851 - RNA, 20 nt, Artificial Sequence
  MKO10009851_A_Cep104
  gRNA
gcccuagauggaacuuucuc

SEQ ID NO: 9852 - RNA, 20 nt, Artificial Sequence
  MKO10009852_A_Cep110
  gRNA
cagcucguguagacgagcua

SEQ ID NO: 9853 - RNA, 20 nt, Artificial Sequence
  MKO10009853_A_Cep110
  gRNA
aaaacuccuaaggcguacuc

SEQ ID NO: 9854 - RNA, 20 nt, Artificial Sequence
  MKO10009854_A_Cep110
  gRNA
gagcuucguuugcugcuauc

SEQ ID NO: 9855 - RNA, 20 nt, Artificial Sequence
  MKO10009855_A_Cep112
  gRNA
acuagaaacccgcucucauc

SEQ ID NO: 9856 - RNA, 20 nt, Artificial Sequence
  MKO10009856_A_Cep112
  gRNA
aguucuugucuuagagacgc

SEQ ID NO: 9857 - RNA, 20 nt, Artificial Sequence
  MKO10009857_A_Cep112
  gRNA
cauauccucccuaaagucac

SEQ ID NO: 9858 - RNA, 20 nt, Artificial Sequence
  MKO10009858_A_Cep120
  gRNA
acguccaaagcaucugcucg

SEQ ID NO: 9859 - RNA, 20 nt, Artificial Sequence
  MKO10009859_A_Cep120
  gRNA
gcuccgcugguccaaucuga

SEQ ID NO: 9860 - RNA, 20 nt, Artificial Sequence
  MKO10009860_A_Cep120
  gRNA
uugucgugcaggcucccaaa

SEQ ID NO: 9861 - RNA, 20 nt, Artificial Sequence
  MKO10009861_A_Cep128
  gRNA
cacaugucgcagauuccgag

SEQ ID NO: 9862 - RNA, 20 nt, Artificial Sequence
  MKO10009862_A_Cep128
  gRNA
cgcuaucgcgaauacagcac

SEQ ID NO: 9863 - RNA, 20 nt, Artificial Sequence
  MKO10009863_A_Cep128
  gRNA
ccgcgaccucagcagugaac

SEQ ID NO: 9864 - RNA, 20 nt, Artificial Sequence
  MKO10009864_A_Cep135
  gRNA
ggcuuucugucguaugaacg

SEQ ID NO: 9865 - RNA, 20 nt, Artificial Sequence
  MKO10009865_A_Cep135
  gRNA
guucaucgauuugcauccgc

SEQ ID NO: 9866 - RNA, 20 nt, Artificial Sequence
  MKO10009866_A_Cep135
  gRNA
cucagaagucagcgcauacc

SEQ ID NO: 9867 - RNA, 20 nt, Artificial Sequence
  MKO10009867_A_Cep152
  gRNA
ugcuucgaaccgccggugua

SEQ ID NO: 9868 - RNA, 20 nt, Artificial Sequence
  MKO10009868_A_Cep152
  gRNA
auacaccggcgguucgaagc

SEQ ID NO: 9869 - RNA, 20 nt, Artificial Sequence
  MKO10009869_A_Cep152
  gRNA
ucaucguccagcaugucgug

SEQ ID NO: 9870 - RNA, 20 nt, Artificial Sequence
  MKO10009870_A_Cep164
  gRNA
uuucgauagugcucgucaca

SEQ ID NO: 9871 - RNA, 20 nt, Artificial Sequence
  MKO10009871_A_Cep164
  gRNA
cugcgacccacgaagagcag

SEQ ID NO: 9872 - RNA, 20 nt, Artificial Sequence
  MKO10009872_A_Cep164
  gRNA
ugacgagcacuaucgaaagu

SEQ ID NO: 9873 - RNA, 20 nt, Artificial Sequence
  MKO10009873_A_Cep170b
  gRNA
uucccuccagucccguagug

SEQ ID NO: 9874 - RNA, 20 nt, Artificial Sequence
  MKO10009874_A_Cep170b
  gRNA
cucaaugacgucauccgcuu

SEQ ID NO: 9875 - RNA, 20 nt, Artificial Sequence
  MKO10009875_A_Cep170b
  gRNA
ucaaggucucugcgcccaag

SEQ ID NO: 9876 - RNA, 20 nt, Artificial Sequence
  MKO10009876_A_Cep170
  gRNA
aaagugauguacgucugcuc

SEQ ID NO: 9877 - RNA, 20 nt, Artificial Sequence
  MKO10009877_A_Cep170
  gRNA
aaucucuucacuguaguacg

SEQ ID NO: 9878 - RNA, 20 nt, Artificial Sequence
  MKO10009878_A_Cep170
  gRNA
aaucaauuaugaugcaucua

SEQ ID NO: 9879 - RNA, 20 nt, Artificial Sequence
  MKO10009879_A_Cep192
  gRNA
agcuaacgcugcgucuguuc

SEQ ID NO: 9880 - RNA, 20 nt, Artificial Sequence
  MKO10009880_A_Cep192
  gRNA
ucgaaaugcuucuuaggauc

SEQ ID NO: 9881 - RNA, 20 nt, Artificial Sequence
  MKO10009881_A_Cep192
  gRNA
cuucaauuaaguaugauucc

SEQ ID NO: 9882 - RNA, 20 nt, Artificial Sequence
  MKO10009882_A_Cep19
  gRNA
ggaaacgaccaucgaucccg

SEQ ID NO: 9883 - RNA, 20 nt, Artificial Sequence
  MKO10009883_A_Cep19
  gRNA
cucgacgucguacacaaaag

SEQ ID NO: 9884 - RNA, 20 nt, Artificial Sequence
  MKO10009884_A_Cep19
  gRNA
gaaccuaacuccacauuucu

SEQ ID NO: 9885 - RNA, 20 nt, Artificial Sequence
  MKO10009885_A_Cep250
  gRNA
agagacaagcaacccucgug

SEQ ID NO: 9886 - RNA, 20 nt, Artificial Sequence
  MKO10009886_A_Cep250
  gRNA
aggggcugaucccucagcgc

SEQ ID NO: 9887 - RNA, 20 nt, Artificial Sequence
  MKO10009887_A_Cep250
  gRNA
acaguugcugauccgauugg

SEQ ID NO: 9888 - RNA, 20 nt, Artificial Sequence
  MKO10009888_A_Cep290
  gRNA
cgcuuuggaagaaguugaaa

SEQ ID NO: 9889 - RNA, 20 nt, Artificial Sequence
  MKO10009889_A_Cep290
  gRNA
uacaaaccuucauuagagac

SEQ ID NO: 9890 - RNA, 20 nt, Artificial Sequence
  MKO10009890_A_Cep290
  gRNA
uaauguucagaugaaagccc

SEQ ID NO: 9891 - RNA, 20 nt, Artificial Sequence
  MKO10009891_A_Cep350
  gRNA
acucggugacaacgaaaguc

SEQ ID NO: 9892 - RNA, 20 nt, Artificial Sequence
  MKO10009892_A_Cep350
  gRNA
agaaaucccguaguccucuc

SEQ ID NO: 9893 - RNA, 20 nt, Artificial Sequence
  MKO10009893_A_Cep350
  gRNA
gugcuacccgaaaaauaagu

SEQ ID NO: 9894 - RNA, 20 nt, Artificial Sequence
  MKO10009894_A_Cep41
  gRNA
ucccauuaccuucgagccuu

SEQ ID NO: 9895 - RNA, 20 nt, Artificial Sequence
  MKO10009895_A_Cep41
  gRNA
gacuugacauguugauaccu

SEQ ID NO: 9896 - RNA, 20 nt, Artificial Sequence
  MKO10009896_A_Cep41
  gRNA
acuuaccagcugggcaaaag

SEQ ID NO: 9897 - RNA, 20 nt, Artificial Sequence
  MKO10009897_A_Cep44
  gRNA
uuacguagccgaacuccuaa

SEQ ID NO: 9898 - RNA, 20 nt, Artificial Sequence
  MKO10009898_A_Cep44
  gRNA
caaccuucucgucaguguac

SEQ ID NO: 9899 - RNA, 20 nt, Artificial Sequence
  MKO10009899_A_Cep44
  gRNA
auuaggaguucggcuacgua

SEQ ID NO: 9900 - RNA, 20 nt, Artificial Sequence
  MKO10009900_A_Cep55
  gRNA
uuuagcaaagaucuucgagc

SEQ ID NO: 9901 - RNA, 20 nt, Artificial Sequence
  MKO10009901_A_Cep55
  gRNA
ugcuaaaagcccuuuaacgu

SEQ ID NO: 9902 - RNA, 20 nt, Artificial Sequence
  MKO10009902_A_Cep55
  gRNA
uucuucauuguucgagcagc

SEQ ID NO: 9903 - RNA, 20 nt, Artificial Sequence
  MKO10009903_A_Cep57l1
  gRNA
aaagauucgucgucucgagc

SEQ ID NO: 9904 - RNA, 20 nt, Artificial Sequence
  MKO10009904_A_Cep57l1
  gRNA
cuagaagaauacaacgagac

SEQ ID NO: 9905 - RNA, 20 nt, Artificial Sequence
  MKO10009905_A_Cep57l1
  gRNA
uucagcauuaaaaacucucc

SEQ ID NO: 9906 - RNA, 20 nt, Artificial Sequence
  MKO10009906_A_Cep57
  gRNA
ucaagauaagauucgacgcc

SEQ ID NO: 9907 - RNA, 20 nt, Artificial Sequence
  MKO10009907_A_Cep57
  gRNA
gcguccuagcugaaccauca

SEQ ID NO: 9908 - RNA, 20 nt, Artificial Sequence
  MKO10009908_A_Cep57
  gRNA
ucagguggauacaauacaua

SEQ ID NO: 9909 - RNA, 20 nt, Artificial Sequence
  MKO10009909_A_Cep63
  gRNA
gagccuucagcucccgauca

SEQ ID NO: 9910 - RNA, 20 nt, Artificial Sequence
  MKO10009910_A_Cep63
  gRNA
cauccgugaucgggagcuga

SEQ ID NO: 9911 - RNA, 20 nt, Artificial Sequence
  MKO10009911_A_Cep63
  gRNA
auacaaaaucgggggcauag

SEQ ID NO: 9912 - RNA, 20 nt, Artificial Sequence
  MKO10009912_A_Cep68
  gRNA
gagagucaugucuuaagcgc

SEQ ID NO: 9913 - RNA, 20 nt, Artificial Sequence
  MKO10009913_A_Cep68
  gRNA
cucuagggguugaugcaagc

SEQ ID NO: 9914 - RNA, 20 nt, Artificial Sequence
  MKO10009914_A_Cep68
  gRNA
gucccugacagagagcgucu

SEQ ID NO: 9915 - RNA, 20 nt, Artificial Sequence
  MKO10009915_A_Cep70
  gRNA
ucagcuagaacagaaccgag

SEQ ID NO: 9916 - RNA, 20 nt, Artificial Sequence
  MKO10009916_A_Cep70
  gRNA
uccaguagccucuaaagccc

SEQ ID NO: 9917 - RNA, 20 nt, Artificial Sequence
  MKO10009917_A_Cep70
  gRNA
ucaugagucuguuugauaaa

SEQ ID NO: 9918 - RNA, 20 nt, Artificial Sequence
  MKO10009918_A_Cep72
  gRNA
ggugcgcaccuugggcauaa

SEQ ID NO: 9919 - RNA, 20 nt, Artificial Sequence
  MKO10009919_A_Cep72
  gRNA
uucucaaccacuuuaaccgu

SEQ ID NO: 9920 - RNA, 20 nt, Artificial Sequence
  MKO10009920_A_Cep72
  gRNA
ccaccuagcugucggagcuu

SEQ ID NO: 9921 - RNA, 20 nt, Artificial Sequence
  MKO10009921_A_Cep76
  gRNA
cagguuuggagcgaaaucgu

SEQ ID NO: 9922 - RNA, 20 nt, Artificial Sequence
  MKO10009922_A_Cep76
  gRNA
aucaaagcucuaagacgucg

SEQ ID NO: 9923 - RNA, 20 nt, Artificial Sequence
  MKO10009923_A_Cep76
  gRNA
cuucaagcaaaaagccguca

SEQ ID NO: 9924 - RNA, 20 nt, Artificial Sequence
  MKO10009924_A_Cep78
  gRNA
gggcggagagccuccgcuac

SEQ ID NO: 9925 - RNA, 20 nt, Artificial Sequence
  MKO10009925_A_Cep78
  gRNA
guagcggaggcucuccgccc

SEQ ID NO: 9926 - RNA, 20 nt, Artificial Sequence
  MKO10009926_A_Cep78
  gRNA
cucaagaccgucaacuuuac

SEQ ID NO: 9927 - RNA, 20 nt, Artificial Sequence
  MKO10009927_A_Cep85l
  gRNA
cucguacgugaguaauuuac

SEQ ID NO: 9928 - RNA, 20 nt, Artificial Sequence
  MKO10009928_A_Cep85l
  gRNA
uugcauacccgcaagagcug

SEQ ID NO: 9929 - RNA, 20 nt, Artificial Sequence
  MKO10009929_A_Cep85l
  gRNA
gcucagauuauucgucagca

SEQ ID NO: 9930 - RNA, 20 nt, Artificial Sequence
  MKO10009930_A_Cep85
  gRNA
ugaguauaacgucucuagca

SEQ ID NO: 9931 - RNA, 20 nt, Artificial Sequence
  MKO10009931_A_Cep85
  gRNA
caguacuugucgacagcagu

SEQ ID NO: 9932 - RNA, 20 nt, Artificial Sequence
  MKO10009932_A_Cep85
  gRNA
ggagaugcucguuacuguuc

SEQ ID NO: 9933 - RNA, 20 nt, Artificial Sequence
  MKO10009933_A_Cep89
  gRNA
cccguagccuaacaucucaa

SEQ ID NO: 9934 - RNA, 20 nt, Artificial Sequence
  MKO10009934_A_Cep89
  gRNA
cacucucagaccgagaucuc

SEQ ID NO: 9935 - RNA, 20 nt, Artificial Sequence
  MKO10009935_A_Cep89
  gRNA
augaugcuccucaaccagac

SEQ ID NO: 9936 - RNA, 20 nt, Artificial Sequence
  MKO10009936_A_Cep95
  gRNA
cgagugaaucaauuaccgcu

SEQ ID NO: 9937 - RNA, 20 nt, Artificial Sequence
  MKO10009937_A_Cep95
  gRNA
acucgcuuuggauuaccuuc

SEQ ID NO: 9938 - RNA, 20 nt, Artificial Sequence
  MKO10009938_A_Cep95
  gRNA
cuugaaguucguguauccuc

SEQ ID NO: 9939 - RNA, 20 nt, Artificial Sequence
  MKO10009939_A_Cep97
  gRNA
auggcgguggcgcgagucga

SEQ ID NO: 9940 - RNA, 20 nt, Artificial Sequence
  MKO10009940_A_Cep97
  gRNA
auuucgacacaucaccuauc

SEQ ID NO: 9941 - RNA, 20 nt, Artificial Sequence
  MKO10009941_A_Cep97
  gRNA
gucaguggcuaacaaucgcu

SEQ ID NO: 9942 - RNA, 20 nt, Artificial Sequence
  MKO10009942_A_Cept1
  gRNA
ggcugugacucacuaucgac

SEQ ID NO: 9943 - RNA, 20 nt, Artificial Sequence
  MKO10009943_A_Cept1
  gRNA
caccaccugugaagauuaca

SEQ ID NO: 9944 - RNA, 20 nt, Artificial Sequence
  MKO10009944_A_Cept1
  gRNA
guuucuggaacauugcgauu

SEQ ID NO: 9945 - RNA, 20 nt, Artificial Sequence
  MKO10009945_A_Cer1
  gRNA
ggcacggccacaaacagauc

SEQ ID NO: 9946 - RNA, 20 nt, Artificial Sequence
  MKO10009946_A_Cer1
  gRNA
cagaaagggcccggcguucc

SEQ ID NO: 9947 - RNA, 20 nt, Artificial Sequence
  MKO10009947_A_Cer1
  gRNA
uugcaucaccaucuugacca

SEQ ID NO: 9948 - RNA, 20 nt, Artificial Sequence
  MKO10009948_A_Cercam
  gRNA
ccagggcuacuaucgccgca

SEQ ID NO: 9949 - RNA, 20 nt, Artificial Sequence
  MKO10009949_A_Cercam
  gRNA
uacuaagaaccgccagcgcc

SEQ ID NO: 9950 - RNA, 20 nt, Artificial Sequence
  MKO10009950_A_Cercam
  gRNA
gccggugguggccccgaugc

SEQ ID NO: 9951 - RNA, 20 nt, Artificial Sequence
  MKO10009951_A_Cerkl
  gRNA
gacugcaucccgacucucgu

SEQ ID NO: 9952 - RNA, 20 nt, Artificial Sequence
  MKO10009952_A_Cerkl
  gRNA
cuugacgaaugugaacuccg

SEQ ID NO: 9953 - RNA, 20 nt, Artificial Sequence
  MKO10009953_A_Cerkl
  gRNA
ccaccuucucguaauagacg

SEQ ID NO: 9954 - RNA, 20 nt, Artificial Sequence
  MKO10009954_A_Cerk
  gRNA
gucggagaucaucgcuguug

SEQ ID NO: 9955 - RNA, 20 nt, Artificial Sequence
  MKO10009955_A_Cerk
  gRNA
agcgaguacgacaucaccgc

SEQ ID NO: 9956 - RNA, 20 nt, Artificial Sequence
  MKO10009956_A_Cerk
  gRNA
gaugucguacucgcuucaca

SEQ ID NO: 9957 - RNA, 20 nt, Artificial Sequence
  MKO10009957_A_Cers1
  gRNA
gcagacgacaccgcuuggcc

SEQ ID NO: 9958 - RNA, 20 nt, Artificial Sequence
  MKO10009958_A_Cers1
  gRNA
guggcguacagaaccuugag

SEQ ID NO: 9959 - RNA, 20 nt, Artificial Sequence
  MKO10009959_A_Cers1
  gRNA
gguucugguuccgccucuac

SEQ ID NO: 9960 - RNA, 20 nt, Artificial Sequence
  MKO10009960_A_Cers2
  gRNA
ggcggaaccagcguucuacc

SEQ ID NO: 9961 - RNA, 20 nt, Artificial Sequence
  MKO10009961_A_Cers2
  gRNA
cauugggaggugcccgcagu

SEQ ID NO: 9962 - RNA, 20 nt, Artificial Sequence
  MKO10009962_A_Cers2
  gRNA
gcccacucugccgugacaaa

SEQ ID NO: 9963 - RNA, 20 nt, Artificial Sequence
  MKO10009963_A_Cers3
  gRNA
guguaacuugacagagcgcc

SEQ ID NO: 9964 - RNA, 20 nt, Artificial Sequence
  MKO10009964_A_Cers3
  gRNA
gcccugcuuaccaagacucc

SEQ ID NO: 9965 - RNA, 20 nt, Artificial Sequence
  MKO10009965_A_Cers3
  gRNA
ucugacgaccauuaaaagaa

SEQ ID NO: 9966 - RNA, 20 nt, Artificial Sequence
  MKO10009966_A_Cers4
  gRNA
guugagucugccgaagcgug

SEQ ID NO: 9967 - RNA, 20 nt, Artificial Sequence
  MKO10009967_A_Cers4
  gRNA
gauaaagcccaacccggugc

SEQ ID NO: 9968 - RNA, 20 nt, Artificial Sequence
  MKO10009968_A_Cers4
  gRNA
aacgcugguucaggagacgu

SEQ ID NO: 9969 - RNA, 20 nt, Artificial Sequence
  MKO10009969_A_Cers5
  gRNA
ucacagaauuucgugagcgu

SEQ ID NO: 9970 - RNA, 20 nt, Artificial Sequence
  MKO10009970_A_Cers5
  gRNA
cugguacaacuauccguauc

SEQ ID NO: 9971 - RNA, 20 nt, Artificial Sequence
  MKO10009971_A_Cers5
  gRNA
gcuuguccugauuccuccga

SEQ ID NO: 9972 - RNA, 20 nt, Artificial Sequence
  MKO10009972_A_Cers6
  gRNA
cugguauaacuacccuuacc

SEQ ID NO: 9973 - RNA, 20 nt, Artificial Sequence
  MKO10009973_A_Cers6
  gRNA
auguucggagcauucaacgc

SEQ ID NO: 9974 - RNA, 20 nt, Artificial Sequence
  MKO10009974_A_Cers6
  gRNA
cuccguagcuaaauacauag

SEQ ID NO: 9975 - RNA, 20 nt, Artificial Sequence
  MKO10009975_A_Ces1a
  gRNA
cccaggugcucgcaaauuac

SEQ ID NO: 9976 - RNA, 20 nt, Artificial Sequence
  MKO10009976_A_Ces1a
  gRNA
aguagucauucaauaccguc

SEQ ID NO: 9977 - RNA, 20 nt, Artificial Sequence
  MKO10009977_A_Ces1a
  gRNA
cuccugcugacucgccaaag

SEQ ID NO: 9978 - RNA, 20 nt, Artificial Sequence
  MKO10009978_A_Ces1b
  gRNA
gguguccacuaccggugaug

SEQ ID NO: 9979 - RNA, 20 nt, Artificial Sequence
  MKO10009979_A_Ces1b
  gRNA
ccagauucagugaccgucuu

SEQ ID NO: 9980 - RNA, 20 nt, Artificial Sequence
  MKO10009980_A_Ces1b
  gRNA
guguucaaauccuucuaagc

SEQ ID NO: 9981 - RNA, 20 nt, Artificial Sequence
  MKO10009981_A_Ces1c
  gRNA
agauauguucagcaccgaaa

SEQ ID NO: 9982 - RNA, 20 nt, Artificial Sequence
  MKO10009982_A_Ces1c
  gRNA
ccggauuccgugaccaucuu

SEQ ID NO: 9983 - RNA, 20 nt, Artificial Sequence
  MKO10009983_A_Ces1c
  gRNA
acacucacucuuaccaccug

SEQ ID NO: 9984 - RNA, 20 nt, Artificial Sequence
  MKO10009984_A_Ces1d
  gRNA
agcauccaccuaugauggac

SEQ ID NO: 9985 - RNA, 20 nt, Artificial Sequence
  MKO10009985_A_Ces1d
  gRNA
ccuuuaacaguguucaccac

SEQ ID NO: 9986 - RNA, 20 nt, Artificial Sequence
  MKO10009986_A_Ces1d
  gRNA
aggggcuuacauaggcgggu

SEQ ID NO: 9987 - RNA, 20 nt, Artificial Sequence
  MKO10009987_A_Ces1e
  gRNA
gguggucauccaauaccguu

SEQ ID NO: 9988 - RNA, 20 nt, Artificial Sequence
  MKO10009988_A_Ces1e
  gRNA
gucuacgcaugaaaaugucg

SEQ ID NO: 9989 - RNA, 20 nt, Artificial Sequence
  MKO10009989_A_Ces1e
  gRNA
gccuugcacgguguccacca

SEQ ID NO: 9990 - RNA, 20 nt, Artificial Sequence
  MKO10009990_A_Ces1f
  gRNA
cuacguucacguguuucccc

SEQ ID NO: 9991 - RNA, 20 nt, Artificial Sequence
  MKO10009991_A_Ces1f
  gRNA
ugcucccaagaugcagcuag

SEQ ID NO: 9992 - RNA, 20 nt, Artificial Sequence
  MKO10009992_A_Ces1f
  gRNA
gccuggguccccgccaaagu

SEQ ID NO: 9993 - RNA, 20 nt, Artificial Sequence
  MKO10009993_A_Ces1g
  gRNA
aguggucauucaguaucgcc

SEQ ID NO: 9994 - RNA, 20 nt, Artificial Sequence
  MKO10009994_A_Ces1g
  gRNA
agcgaggggcacuccaucau

SEQ ID NO: 9995 - RNA, 20 nt, Artificial Sequence
  MKO10009995_A_Ces1g
  gRNA
acacccauccuuaccgccug

SEQ ID NO: 9996 - RNA, 20 nt, Artificial Sequence
  MKO10009996_A_Ces2a
  gRNA
uagucuuaccaugcacaugc

SEQ ID NO: 9997 - RNA, 20 nt, Artificial Sequence
  MKO10009997_A_Ces2a
  gRNA
caugaaugauguaucuaaac

SEQ ID NO: 9998 - RNA, 20 nt, Artificial Sequence
  MKO10009998_A_Ces2a
  gRNA
uccucuaaauucauuauauc

SEQ ID NO: 9999 - RNA, 20 nt, Artificial Sequence
  MKO10009999_A_Ces2b
  gRNA
cauguacgauggaucucuau

SEQ ID NO: 10000 - RNA, 20 nt, Artificial Sequence
  MKO10010000_A_Ces2b
  gRNA
caauagagauccaucguaca

SEQ ID NO: 10001 - RNA, 20 nt, Artificial Sequence
  MKO10010001_A_Ces2b
  gRNA
caucaggugucugcaaaauc

SEQ ID NO: 10002 - RNA, 20 nt, Artificial Sequence
  MKO10010002_A_Ces2c
  gRNA
cuugacaugcugaaugaagc

SEQ ID NO: 10003 - RNA, 20 nt, Artificial Sequence
  MKO10010003_A_Ces2c
  gRNA
cagcagaacaucgcucacuu

SEQ ID NO: 10004 - RNA, 20 nt, Artificial Sequence
  MKO10010004_A_Ces2c
  gRNA
aggcagccuuauccacguga

SEQ ID NO: 10005 - RNA, 20 nt, Artificial Sequence
  MKO10010005_A_Ces2e
  gRNA
cgaugucaguguccuucacg

SEQ ID NO: 10006 - RNA, 20 nt, Artificial Sequence
  MKO10010006_A_Ces2e
  gRNA
caucgcuguucauaccuucc

SEQ ID NO: 10007 - RNA, 20 nt, Artificial Sequence
  MKO10010007_A_Ces2e
  gRNA
cagcaaaacauuguccacuu

SEQ ID NO: 10008 - RNA, 20 nt, Artificial Sequence
  MKO10010008_A_Ces2f
  gRNA
ucaguaccgccugggaaucc

SEQ ID NO: 10009 - RNA, 20 nt, Artificial Sequence
  MKO10010009_A_Ces2f
  gRNA
aacaggucuugacucaucag

SEQ ID NO: 10010 - RNA, 20 nt, Artificial Sequence
  MKO10010010_A_Ces2f
  gRNA
cuuacugugaagaucaucuc

SEQ ID NO: 10011 - RNA, 20 nt, Artificial Sequence
  MKO10010011_A_Ces2g
  gRNA
aggcaggcucauucacguga

SEQ ID NO: 10012 - RNA, 20 nt, Artificial Sequence
  MKO10010012_A_Ces2g
  gRNA
aguggaguagcucuguugcc

SEQ ID NO: 10013 - RNA, 20 nt, Artificial Sequence
  MKO10010013_A_Ces2g
  gRNA
acaaaauguuacgaugaaua

SEQ ID NO: 10014 - RNA, 20 nt, Artificial Sequence
  MKO10010014_A_Ces2h
  gRNA
acuggagaugagcgcgccag

SEQ ID NO: 10015 - RNA, 20 nt, Artificial Sequence
  MKO10010015_A_Ces2h
  gRNA
gaccacuacuacauucucca

SEQ ID NO: 10016 - RNA, 20 nt, Artificial Sequence
  MKO10010016_A_Ces2h
  gRNA
gccagcguagggcggccacu

SEQ ID NO: 10017 - RNA, 20 nt, Artificial Sequence
  MKO10010017_A_Ces3a
  gRNA
gacaacuaccacauccccau

SEQ ID NO: 10018 - RNA, 20 nt, Artificial Sequence
  MKO10010018_A_Ces3a
  gRNA
cuggguccaguguccgaguc

SEQ ID NO: 10019 - RNA, 20 nt, Artificial Sequence
  MKO10010019_A_Ces3a
  gRNA
guaugucuuaccaaugacag

SEQ ID NO: 10020 - RNA, 20 nt, Artificial Sequence
  MKO10010020_A_Ces3b
  gRNA
aacuaccacauccccguacg

SEQ ID NO: 10021 - RNA, 20 nt, Artificial Sequence
  MKO10010021_A_Ces3b
  gRNA
aguccguuaugacaaauaug

SEQ ID NO: 10022 - RNA, 20 nt, Artificial Sequence
  MKO10010022_A_Ces3b
  gRNA
acuaggacacuggacccagc

SEQ ID NO: 10023 - RNA, 20 nt, Artificial Sequence
  MKO10010023_A_Ces4a
  gRNA
uaugccccaguacucgcccc

SEQ ID NO: 10024 - RNA, 20 nt, Artificial Sequence
  MKO10010024_A_Ces4a
  gRNA
gcccaccggagguuuagaga

SEQ ID NO: 10025 - RNA, 20 nt, Artificial Sequence
  MKO10010025_A_Ces4a
  gRNA
ggcaucucugaugccguucc

SEQ ID NO: 10026 - RNA, 20 nt, Artificial Sequence
  MKO10010026_A_Ces5a
  gRNA
cgggagacuggagccguuau

SEQ ID NO: 10027 - RNA, 20 nt, Artificial Sequence
  MKO10010027_A_Ces5a
  gRNA
ggcuucucgcaaauuauccc

SEQ ID NO: 10028 - RNA, 20 nt, Artificial Sequence
  MKO10010028_A_Ces5a
  gRNA
aacccgugaacguguuucuu

SEQ ID NO: 10029 - RNA, 20 nt, Artificial Sequence
  MKO10010029_A_Cetn1
  gRNA
gagcgggaccaucgauguga

SEQ ID NO: 10030 - RNA, 20 nt, Artificial Sequence
  MKO10010030_A_Cetn1
  gRNA
cgcucccaucagaaucgaag

SEQ ID NO: 10031 - RNA, 20 nt, Artificial Sequence
  MKO10010031_A_Cetn1
  gRNA
uuguuugaugacgacgaaac

SEQ ID NO: 10032 - RNA, 20 nt, Artificial Sequence
  MKO10010032_A_Cetn2
  gRNA
auucaagaaucuuaagcgcg

SEQ ID NO: 10033 - RNA, 20 nt, Artificial Sequence
  MKO10010033_A_Cetn2
  gRNA
cgaacaacuugaaagcuuuc

SEQ ID NO: 10034 - RNA, 20 nt, Artificial Sequence
  MKO10010034_A_Cetn2
  gRNA
gguugucuucuuaaaauuag

SEQ ID NO: 10035 - RNA, 20 nt, Artificial Sequence
  MKO10010035_A_Cetn3
  gRNA
cuauuugacgaugacgauuc

SEQ ID NO: 10036 - RNA, 20 nt, Artificial Sequence
  MKO10010036_A_Cetn3
  gRNA
cauagauuaucaugaauuaa

SEQ ID NO: 10037 - RNA, 20 nt, Artificial Sequence
  MKO10010037_A_Cetn3
  gRNA
cuuuaauucaugauaaucua

SEQ ID NO: 10038 - RNA, 20 nt, Artificial Sequence
  MKO10010038_A_Cetn4
  gRNA
ugccaucaugagcguaaaaa

SEQ ID NO: 10039 - RNA, 20 nt, Artificial Sequence
  MKO10010039_A_Cetn4
  gRNA
uccuauugcagauugcaaug

SEQ ID NO: 10040 - RNA, 20 nt, Artificial Sequence
  MKO10010040_A_Cetn4
  gRNA
auugaccuguaauucaucuu

SEQ ID NO: 10041 - RNA, 20 nt, Artificial Sequence
  MKO10010041_A_Cfb
  gRNA
uucgagucugcacgggguau

SEQ ID NO: 10042 - RNA, 20 nt, Artificial Sequence
  MKO10010042_A_Cfb
  gRNA
aauacgcugcccacgaccgc

SEQ ID NO: 10043 - RNA, 20 nt, Artificial Sequence
  MKO10010043_A_Cfb
  gRNA
gcuggauacugucccaaucc

SEQ ID NO: 10044 - RNA, 20 nt, Artificial Sequence
  MKO10010044_A_Cfc1
  gRNA
gcuauugcgagcacgaccag

SEQ ID NO: 10045 - RNA, 20 nt, Artificial Sequence
  MKO10010045_A_Cfc1
  gRNA
guaucccgcuguugccacaa

SEQ ID NO: 10046 - RNA, 20 nt, Artificial Sequence
  MKO10010046_A_Cfc1
  gRNA
uaccacaguggcugaacguu

SEQ ID NO: 10047 - RNA, 20 nt, Artificial Sequence
  MKO10010047_A_Cfdp1
  gRNA
gauuaguucgaauaaaccgu

SEQ ID NO: 10048 - RNA, 20 nt, Artificial Sequence
  MKO10010048_A_Cfdp1
  gRNA
ggaaguagaugcugcgucua

SEQ ID NO: 10049 - RNA, 20 nt, Artificial Sequence
  MKO10010049_A_Cfdp1
  gRNA
accaagguguuugacuucgc

SEQ ID NO: 10050 - RNA, 20 nt, Artificial Sequence
  MKO10010050_A_Cfd
  gRNA
acccggcacgcucugcgacg

SEQ ID NO: 10051 - RNA, 20 nt, Artificial Sequence
  MKO10010051_A_Cfd
  gRNA
ucucacguggggacccaacg

SEQ ID NO: 10052 - RNA, 20 nt, Artificial Sequence
  MKO10010052_A_Cfd
  gRNA
cagucgaaggugugguuacg

SEQ ID NO: 10053 - RNA, 20 nt, Artificial Sequence
  MKO10010053_A_Cfhr1
  gRNA
cguacugguggaaaugcauu

SEQ ID NO: 10054 - RNA, 20 nt, Artificial Sequence
  MKO10010054_A_Cfhr1
  gRNA
gcaagugaugcgaguccaga

SEQ ID NO: 10055 - RNA, 20 nt, Artificial Sequence
  MKO10010055_A_Cfhr1
  gRNA
cgcaucacuugcacagaauc

SEQ ID NO: 10056 - RNA, 20 nt, Artificial Sequence
  MKO10010056_A_Cfhr2
  gRNA
agguacuuacguaagcacau

SEQ ID NO: 10057 - RNA, 20 nt, Artificial Sequence
  MKO10010057_A_Cfhr2
  gRNA
agaauggagacucuacauac

SEQ ID NO: 10058 - RNA, 20 nt, Artificial Sequence
  MKO10010058_A_Cfhr2
  gRNA
uuauugucuuauuucccuua

SEQ ID NO: 10059 - RNA, 20 nt, Artificial Sequence
  MKO10010059_A_Cfh
  gRNA
guacuuacuccgacauaucc

SEQ ID NO: 10060 - RNA, 20 nt, Artificial Sequence
  MKO10010060_A_Cfh
  gRNA
gaaauugauuaccgugaaug

SEQ ID NO: 10061 - RNA, 20 nt, Artificial Sequence
  MKO10010061_A_Cfh
  gRNA
ggguggcgucuaacccaucc

SEQ ID NO: 10062 - RNA, 20 nt, Artificial Sequence
  MKO10010062_A_Cfi
  gRNA
aacguggccugcgucgaccu

SEQ ID NO: 10063 - RNA, 20 nt, Artificial Sequence
  MKO10010063_A_Cfi
  gRNA
cacgcaucgcuccuguaaca

SEQ ID NO: 10064 - RNA, 20 nt, Artificial Sequence
  MKO10010064_A_Cfi
  gRNA
acagucauugacaccguugc

SEQ ID NO: 10065 - RNA, 20 nt, Artificial Sequence
  MKO10010065_A_Cfl1
  gRNA
ggccgcguucagucggaucc

SEQ ID NO: 10066 - RNA, 20 nt, Artificial Sequence
  MKO10010066_A_Cfl1
  gRNA
cgacugaacgcggccucucc

SEQ ID NO: 10067 - RNA, 20 nt, Artificial Sequence
  MKO10010067_A_Cfl1
  gRNA
cucaccagaagaugaacacc

SEQ ID NO: 10068 - RNA, 20 nt, Artificial Sequence
  MKO10010068_A_Cfl2
  gRNA
guuucucucccagcgucgag

SEQ ID NO: 10069 - RNA, 20 nt, Artificial Sequence
  MKO10010069_A_Cfl2
  gRNA
aaauggcuuggacgauauua

SEQ ID NO: 10070 - RNA, 20 nt, Artificial Sequence
  MKO10010070_A_Cfl2
  gRNA
gcauaucggcaaucauucag

SEQ ID NO: 10071 - RNA, 20 nt, Artificial Sequence
  MKO10010071_A_Cflar
  gRNA
gguuuacaggguccugcuga

SEQ ID NO: 10072 - RNA, 20 nt, Artificial Sequence
  MKO10010072_A_Cflar
  gRNA
uacuggacuggguguacuuc

SEQ ID NO: 10073 - RNA, 20 nt, Artificial Sequence
  MKO10010073_A_Cflar
  gRNA
cuuaccuauaaucagaaacc

SEQ ID NO: 10074 - RNA, 20 nt, Artificial Sequence
  MKO10010074_A_Cfp
  gRNA
gauuaucacauacucguuga

SEQ ID NO: 10075 - RNA, 20 nt, Artificial Sequence
  MKO10010075_A_Cfp
  gRNA
cacagcgccugugucgcagc

SEQ ID NO: 10076 - RNA, 20 nt, Artificial Sequence
  MKO10010076_A_Cfp
  gRNA
aggaccagccuaugagcaua

SEQ ID NO: 10077 - RNA, 20 nt, Artificial Sequence
  MKO10010077_A_Cftr
  gRNA
uccagaaaaagcaucgccga

SEQ ID NO: 10078 - RNA, 20 nt, Artificial Sequence
  MKO10010078_A_Cftr
  gRNA
cccagcuuauccacgcccuu

SEQ ID NO: 10079 - RNA, 20 nt, Artificial Sequence
  MKO10010079_A_Cftr
  gRNA
ucugcauuccaaugcgauga

SEQ ID NO: 10080 - RNA, 20 nt, Artificial Sequence
  MKO10010080_A_Cga
  gRNA
cgcucagaagcuacgacuug

SEQ ID NO: 10081 - RNA, 20 nt, Artificial Sequence
  MKO10010081_A_Cga
  gRNA
ggcgggagugggauaugccc

SEQ ID NO: 10082 - RNA, 20 nt, Artificial Sequence
  MKO10010082_A_Cga
  gRNA
gggcauaucccacucccgcc

SEQ ID NO: 10083 - RNA, 20 nt, Artificial Sequence
  MKO10010083_A_Cggbp1
  gRNA
gucuuagaacgauuucgagc

SEQ ID NO: 10084 - RNA, 20 nt, Artificial Sequence
  MKO10010084_A_Cggbp1
  gRNA
gacaggaacgcucgcacugc

SEQ ID NO: 10085 - RNA, 20 nt, Artificial Sequence
  MKO10010085_A_Cggbp1
  gRNA
cagugcgagcguuccugucc

SEQ ID NO: 10086 - RNA, 20 nt, Artificial Sequence
  MKO10010086_A_Cgnl1
  gRNA
gcucacacaacaaacgaacg

SEQ ID NO: 10087 - RNA, 20 nt, Artificial Sequence
  MKO10010087_A_Cgnl1
  gRNA
auuuagaagagcugcgaguc

SEQ ID NO: 10088 - RNA, 20 nt, Artificial Sequence
  MKO10010088_A_Cgnl1
  gRNA
ggccacaccagaucucuuaa

SEQ ID NO: 10089 - RNA, 20 nt, Artificial Sequence
  MKO10010089_A_Cgn
  gRNA
ggcugagcuuacccgaaaaa

SEQ ID NO: 10090 - RNA, 20 nt, Artificial Sequence
  MKO10010090_A_Cgn
  gRNA
ugaagagugccaccgacugc

SEQ ID NO: 10091 - RNA, 20 nt, Artificial Sequence
  MKO10010091_A_Cgn
  gRNA
caugugaaggccaccaucua

SEQ ID NO: 10092 - RNA, 20 nt, Artificial Sequence
  MKO10010092_A_Cgref1
  gRNA
ggagcgcuuaccggguugau

SEQ ID NO: 10093 - RNA, 20 nt, Artificial Sequence
  MKO10010093_A_Cgref1
  gRNA
ggccguccagcuguccauuc

SEQ ID NO: 10094 - RNA, 20 nt, Artificial Sequence
  MKO10010094_A_Cgref1
  gRNA
ucaacgcuugcaucagccac

SEQ ID NO: 10095 - RNA, 20 nt, Artificial Sequence
  MKO10010095_A_Cgrrf1
  gRNA
auagucgucugacgugcuac

SEQ ID NO: 10096 - RNA, 20 nt, Artificial Sequence
  MKO10010096_A_Cgrrf1
  gRNA
acgucagacgacuauccucc

SEQ ID NO: 10097 - RNA, 20 nt, Artificial Sequence
  MKO10010097_A_Cgrrf1
  gRNA
uaccaaaggauagcgagauc

SEQ ID NO: 10098 - RNA, 20 nt, Artificial Sequence
  MKO10010098_A_Ch25h
  gRNA
ucgacaccgagaucuucgcg

SEQ ID NO: 10099 - RNA, 20 nt, Artificial Sequence
  MKO10010099_A_Ch25h
  gRNA
cuucgacgugcugaacgucg

SEQ ID NO: 10100 - RNA, 20 nt, Artificial Sequence
  MKO10010100_A_Ch25h
  gRNA
gguggaucuuguagcgucgc

SEQ ID NO: 10101 - RNA, 20 nt, Artificial Sequence
  MKO10010101_A_Chac1
  gRNA
ucguucguggcuauagccga

SEQ ID NO: 10102 - RNA, 20 nt, Artificial Sequence
  MKO10010102_A_Chac1
  gRNA
agccguacccgaaaauccac

SEQ ID NO: 10103 - RNA, 20 nt, Artificial Sequence
  MKO10010103_A_Chac1
  gRNA
ccuugaguacuuauugcguu

SEQ ID NO: 10104 - RNA, 20 nt, Artificial Sequence
  MKO10010104_A_Chac2
  gRNA
caagguagcacggaccaccg

SEQ ID NO: 10105 - RNA, 20 nt, Artificial Sequence
  MKO10010105_A_Chac2
  gRNA
uuaguaaaggaacgcuuaga

SEQ ID NO: 10106 - RNA, 20 nt, Artificial Sequence
  MKO10010106_A_Chac2
  gRNA
uuaccuugccugggaccccg

SEQ ID NO: 10107 - RNA, 20 nt, Artificial Sequence
  MKO10010107_A_Chadl
  gRNA
cggcgcucaggcccgagagc

SEQ ID NO: 10108 - RNA, 20 nt, Artificial Sequence
  MKO10010108_A_Chadl
  gRNA
ugcgcucggauggcgcgugc

SEQ ID NO: 10109 - RNA, 20 nt, Artificial Sequence
  MKO10010109_A_Chadl
  gRNA
ucgcugggcagcuacgugcc

SEQ ID NO: 10110 - RNA, 20 nt, Artificial Sequence
  MKO10010110_A_Chad
  gRNA
ccagacugaauaagagcgcg

SEQ ID NO: 10111 - RNA, 20 nt, Artificial Sequence
  MKO10010111_A_Chad
  gRNA
gcaguuccgacacuuuguug

SEQ ID NO: 10112 - RNA, 20 nt, Artificial Sequence
  MKO10010112_A_Chad
  gRNA
ucaggcgguuguuguccaga

SEQ ID NO: 10113 - RNA, 20 nt, Artificial Sequence
  MKO10010113_A_Chaf1a
  gRNA
ggaagagauacgacgagcca

SEQ ID NO: 10114 - RNA, 20 nt, Artificial Sequence
  MKO10010114_A_Chaf1a
  gRNA
ggaaaaacgcaaggagcggc

SEQ ID NO: 10115 - RNA, 20 nt, Artificial Sequence
  MKO10010115_A_Chaf1a
  gRNA
auaaugaccacacucgguac

SEQ ID NO: 10116 - RNA, 20 nt, Artificial Sequence
  MKO10010116_A_Chaf1b
  gRNA
aucauaugggaugucaguaa

SEQ ID NO: 10117 - RNA, 20 nt, Artificial Sequence
  MKO10010117_A_Chaf1b
  gRNA
gucgcaauauauugacccaa

SEQ ID NO: 10118 - RNA, 20 nt, Artificial Sequence
  MKO10010118_A_Chaf1b
  gRNA
gcguacaacauugacagcuu

SEQ ID NO: 10119 - RNA, 20 nt, Artificial Sequence
  MKO10010119_A_Champ1
  gRNA
ccgagcaaagacaccgaguc

SEQ ID NO: 10120 - RNA, 20 nt, Artificial Sequence
  MKO10010120_A_Champ1
  gRNA
cagggugggucuacacgcuc

SEQ ID NO: 10121 - RNA, 20 nt, Artificial Sequence
  MKO10010121_A_Champ1
  gRNA
aucgcaaaguacaugaagcg

SEQ ID NO: 10122 - RNA, 20 nt, Artificial Sequence
  MKO10010122_A_Chau
  gRNA
ggccccaaaccgcuucacaa

SEQ ID NO: 10123 - RNA, 20 nt, Artificial Sequence
  MKO10010123_A_Chau
  gRNA
ugccgagcaaagaucacagc

SEQ ID NO: 10124 - RNA, 20 nt, Artificial Sequence
  MKO10010124_A_Chau
  gRNA
gccucaccuuagcuggucau

SEQ ID NO: 10125 - RNA, 20 nt, Artificial Sequence
  MKO10010125_A_Chchd10
  gRNA
gccucggggaagccgcagug

SEQ ID NO: 10126 - RNA, 20 nt, Artificial Sequence
  MKO10010126_A_Chchd10
  gRNA
gccgcacugcggcuuccccg

SEQ ID NO: 10127 - RNA, 20 nt, Artificial Sequence
  MKO10010127_A_Chchd10
  gRNA
caccgccgcaggcguagccg

SEQ ID NO: 10128 - RNA, 20 nt, Artificial Sequence
  MKO10010128_A_Chchd1
  gRNA
gcagaaugaauuccgcgacg

SEQ ID NO: 10129 - RNA, 20 nt, Artificial Sequence
  MKO10010129_A_Chchd1
  gRNA
ccuggcgcgguuugcgaacc

SEQ ID NO: 10130 - RNA, 20 nt, Artificial Sequence
  MKO10010130_A_Chchd1
  gRNA
cgccaggcggccgcguagac

SEQ ID NO: 10131 - RNA, 20 nt, Artificial Sequence
  MKO10010131_A_Chchd2
  gRNA
accuggccggaggagucacc

SEQ ID NO: 10132 - RNA, 20 nt, Artificial Sequence
  MKO10010132_A_Chchd2
  gRNA
gaagccgaagccgcacuucc

SEQ ID NO: 10133 - RNA, 20 nt, Artificial Sequence
  MKO10010133_A_Chchd2
  gRNA
ccagccgggccccucagaug

SEQ ID NO: 10134 - RNA, 20 nt, Artificial Sequence
  MKO10010134_A_Chchd3
  gRNA
cagcgauauuccagcguuua

SEQ ID NO: 10135 - RNA, 20 nt, Artificial Sequence
  MKO10010135_A_Chchd3
  gRNA
cuucaugcgcuccucuucac

SEQ ID NO: 10136 - RNA, 20 nt, Artificial Sequence
  MKO10010136_A_Chchd3
  gRNA
accugaagcaccauaaacgc

SEQ ID NO: 10137 - RNA, 20 nt, Artificial Sequence
  MKO10010137_A_Chchd4
  gRNA
gaacaaccauguccuacugc

SEQ ID NO: 10138 - RNA, 20 nt, Artificial Sequence
  MKO10010138_A_Chchd4
  gRNA
uuccaguuaauaucuccguu

SEQ ID NO: 10139 - RNA, 20 nt, Artificial Sequence
  MKO10010139_A_Chchd4
  gRNA
ugaccccaaugaucccuaug

SEQ ID NO: 10140 - RNA, 20 nt, Artificial Sequence
  MKO10010140_A_Chchd5
  gRNA
gaucauccgccagauccgcc

SEQ ID NO: 10141 - RNA, 20 nt, Artificial Sequence
  MKO10010141_A_Chchd5
  gRNA
ucgauacugcagccgagagc

SEQ ID NO: 10142 - RNA, 20 nt, Artificial Sequence
  MKO10010142_A_Chchd5
  gRNA
aguaucgagcagugacuucc

SEQ ID NO: 10143 - RNA, 20 nt, Artificial Sequence
  MKO10010143_A_Chchd6
  gRNA
ccuucgggccucggcgcucu

SEQ ID NO: 10144 - RNA, 20 nt, Artificial Sequence
  MKO10010144_A_Chchd6
  gRNA
ccgaaggguguccuucgaga

SEQ ID NO: 10145 - RNA, 20 nt, Artificial Sequence
  MKO10010145_A_Chchd6
  gRNA
gcuccuucauccucuguacg

SEQ ID NO: 10146 - RNA, 20 nt, Artificial Sequence
  MKO10010146_A_Chchd7
  gRNA
ucucagccgccgagugacca

SEQ ID NO: 10147 - RNA, 20 nt, Artificial Sequence
  MKO10010147_A_Chchd7
  gRNA
aagcacccuaccgacaagca

SEQ ID NO: 10148 - RNA, 20 nt, Artificial Sequence
  MKO10010148_A_Chchd7
  gRNA
uugggcuuacccagaaucgc

SEQ ID NO: 10149 - RNA, 20 nt, Artificial Sequence
  MKO10010149_A_Chd1l
  gRNA
cgugcugcugacgacauacg

SEQ ID NO: 10150 - RNA, 20 nt, Artificial Sequence
  MKO10010150_A_Chd1l
  gRNA
gucuccccaccaaguaaaug

SEQ ID NO: 10151 - RNA, 20 nt, Artificial Sequence
  MKO10010151_A_Chd1l
  gRNA
ucgucuacguucuuaccaac

SEQ ID NO: 10152 - RNA, 20 nt, Artificial Sequence
  MKO10010152_A_Chd1
  gRNA
gacuccgacgacucguccag

SEQ ID NO: 10153 - RNA, 20 nt, Artificial Sequence
  MKO10010153_A_Chd1
  gRNA
accucggcuccgucgacuuu

SEQ ID NO: 10154 - RNA, 20 nt, Artificial Sequence
  MKO10010154_A_Chd1
  gRNA
cgcccagcuucaucuaauag

SEQ ID NO: 10155 - RNA, 20 nt, Artificial Sequence
  MKO10010155_A_Chd2
  gRNA
accaucacgauuuaauguua

SEQ ID NO: 10156 - RNA, 20 nt, Artificial Sequence
  MKO10010156_A_Chd2
  gRNA
uccuuaacauuaaaucguga

SEQ ID NO: 10157 - RNA, 20 nt, Artificial Sequence
  MKO10010157_A_Chd2
  gRNA
cagcgaguccaauagcaguu

SEQ ID NO: 10158 - RNA, 20 nt, Artificial Sequence
  MKO10010158_A_Chd3
  gRNA
ggugugaagaagcgaaaacg

SEQ ID NO: 10159 - RNA, 20 nt, Artificial Sequence
  MKO10010159_A_Chd3
  gRNA
uguggaacacguguucuccg

SEQ ID NO: 10160 - RNA, 20 nt, Artificial Sequence
  MKO10010160_A_Chd3
  gRNA
cagcugccgacccuuugaag

SEQ ID NO: 10161 - RNA, 20 nt, Artificial Sequence
  MKO10010161_A_Chd4
  gRNA
gcuucggauaaauccucguc

SEQ ID NO: 10162 - RNA, 20 nt, Artificial Sequence
  MKO10010162_A_Chd4
  gRNA
ucggacccucaccaacuaca

SEQ ID NO: 10163 - RNA, 20 nt, Artificial Sequence
  MKO10010163_A_Chd4
  gRNA
uccugacuuaccuaacaaau

SEQ ID NO: 10164 - RNA, 20 nt, Artificial Sequence
  MKO10010164_A_Chd5
  gRNA
aucuccuccgcgaacagccg

SEQ ID NO: 10165 - RNA, 20 nt, Artificial Sequence
  MKO10010165_A_Chd5
  gRNA
cuccgccaugaguugucccg

SEQ ID NO: 10166 - RNA, 20 nt, Artificial Sequence
  MKO10010166_A_Chd5
  gRNA
gacaacucauggcggagugg

SEQ ID NO: 10167 - RNA, 20 nt, Artificial Sequence
  MKO10010167_A_Chd6
  gRNA
guucugcagaaacggcgcuc

SEQ ID NO: 10168 - RNA, 20 nt, Artificial Sequence
  MKO10010168_A_Chd6
  gRNA
cuuauggggcagacaaugau

SEQ ID NO: 10169 - RNA, 20 nt, Artificial Sequence
  MKO10010169_A_Chd6
  gRNA
cggaggccucccggugcuuc

SEQ ID NO: 10170 - RNA, 20 nt, Artificial Sequence
  MKO10010170_A_Chd7
  gRNA
gagcguucugugcgcugacc

SEQ ID NO: 10171 - RNA, 20 nt, Artificial Sequence
  MKO10010171_A_Chd7
  gRNA
gaaggucaaaaaagauccga

SEQ ID NO: 10172 - RNA, 20 nt, Artificial Sequence
  MKO10010172_A_Chd7
  gRNA
accgucccccgcuccugaag

SEQ ID NO: 10173 - RNA, 20 nt, Artificial Sequence
  MKO10010173_A_Chd8
  gRNA
aucgucugacaacucugacg

SEQ ID NO: 10174 - RNA, 20 nt, Artificial Sequence
  MKO10010174_A_Chd8
  gRNA
ugaaucgaaacgcaucacuu

SEQ ID NO: 10175 - RNA, 20 nt, Artificial Sequence
  MKO10010175_A_Chd8
  gRNA
ggacaucggcauguuguguu

SEQ ID NO: 10176 - RNA, 20 nt, Artificial Sequence
  MKO10010176_A_Chd9
  gRNA
agcuguccgaugccgagcag

SEQ ID NO: 10177 - RNA, 20 nt, Artificial Sequence
  MKO10010177_A_Chd9
  gRNA
cucggcaucggacagcucau

SEQ ID NO: 10178 - RNA, 20 nt, Artificial Sequence
  MKO10010178_A_Chd9
  gRNA
uucucagggcucauuacucg

SEQ ID NO: 10179 - RNA, 20 nt, Artificial Sequence
  MKO10010179_A_Chdh
  gRNA
caccgggugcaaguaggcgc

SEQ ID NO: 10180 - RNA, 20 nt, Artificial Sequence
  MKO10010180_A_Chdh
  gRNA
ccauggucaaucacuugcga

SEQ ID NO: 10181 - RNA, 20 nt, Artificial Sequence
  MKO10010181_A_Chdh
  gRNA
aguugauggcucccccgcuc

SEQ ID NO: 10182 - RNA, 20 nt, Artificial Sequence
  MKO10010182_A_Chek1
  gRNA
augcagaaccaguugauguu

SEQ ID NO: 10183 - RNA, 20 nt, Artificial Sequence
  MKO10010183_A_Chek1
  gRNA
ugcaguaaguacuauuccac

SEQ ID NO: 10184 - RNA, 20 nt, Artificial Sequence
  MKO10010184_A_Chek1
  gRNA
uucuuccaccaacucauggc

SEQ ID NO: 10185 - RNA, 20 nt, Artificial Sequence
  MKO10010185_A_Chek2
  gRNA
acuguguuaacgacaacuac

SEQ ID NO: 10186 - RNA, 20 nt, Artificial Sequence
  MKO10010186_A_Chek2
  gRNA
ccgcuugcuaaugaucuuua

SEQ ID NO: 10187 - RNA, 20 nt, Artificial Sequence
  MKO10010187_A_Chek2
  gRNA
uuguuacaucguauacauag

SEQ ID NO: 10188 - RNA, 20 nt, Artificial Sequence
  MKO10010188_A_Cherp
  gRNA
ucaaugacgugcugcaccac

SEQ ID NO: 10189 - RNA, 20 nt, Artificial Sequence
  MKO10010189_A_Cherp
  gRNA
cgcaaccgcaucacugcuga

SEQ ID NO: 10190 - RNA, 20 nt, Artificial Sequence
  MKO10010190_A_Cherp
  gRNA
cgauaagcucgcucaguuug

SEQ ID NO: 10191 - RNA, 20 nt, Artificial Sequence
  MKO10010191_A_Chfr
  gRNA
augauauccccgcucuguaa

SEQ ID NO: 10192 - RNA, 20 nt, Artificial Sequence
  MKO10010192_A_Chfr
  gRNA
aggucugaugucgauguuga

SEQ ID NO: 10193 - RNA, 20 nt, Artificial Sequence
  MKO10010193_A_Chfr
  gRNA
caugugaccaaagauugcuc

SEQ ID NO: 10194 - RNA, 20 nt, Artificial Sequence
  MKO10010194_A_Chga
  gRNA
gcgacaccagaaucugcuga

SEQ ID NO: 10195 - RNA, 20 nt, Artificial Sequence
  MKO10010195_A_Chga
  gRNA
ccaggugaugaagugcgucc

SEQ ID NO: 10196 - RNA, 20 nt, Artificial Sequence
  MKO10010196_A_Chga
  gRNA
gcuggguuuggacagcgagu

SEQ ID NO: 10197 - RNA, 20 nt, Artificial Sequence
  MKO10010197_A_Chgb
  gRNA
ccccuuccucgccauaguug

SEQ ID NO: 10198 - RNA, 20 nt, Artificial Sequence
  MKO10010198_A_Chgb
  gRNA
cuccuccgagucguagaaau

SEQ ID NO: 10199 - RNA, 20 nt, Artificial Sequence
  MKO10010199_A_Chgb
  gRNA
gaacuuggcugcgauggauc

SEQ ID NO: 10200 - RNA, 20 nt, Artificial Sequence
  MKO10010200_A_Chia1
  gRNA
cucacgugggagcccuccuc

SEQ ID NO: 10201 - RNA, 20 nt, Artificial Sequence
  MKO10010201_A_Chia1
  gRNA
gcccaguaucggccaggucu

SEQ ID NO: 10202 - RNA, 20 nt, Artificial Sequence
  MKO10010202_A_Chia1
  gRNA
ugauaugcuauuucaccaac

SEQ ID NO: 10203 - RNA, 20 nt, Artificial Sequence
  MKO10010203_A_Chic1
  gRNA
uaacuucugaaucgaucuuc

SEQ ID NO: 10204 - RNA, 20 nt, Artificial Sequence
  MKO10010204_A_Chic1
  gRNA
gaauuuccgucaguucugac

SEQ ID NO: 10205 - RNA, 20 nt, Artificial Sequence
  MKO10010205_A_Chic1
  gRNA
agcagccauuucacauugac

SEQ ID NO: 10206 - RNA, 20 nt, Artificial Sequence
  MKO10010206_A_Chic2
  gRNA
agcaaccaccgcacauuaac

SEQ ID NO: 10207 - RNA, 20 nt, Artificial Sequence
  MKO10010207_A_Chic2
  gRNA
gaauucccuucuucauuaac

SEQ ID NO: 10208 - RNA, 20 nt, Artificial Sequence
  MKO10010208_A_Chic2
  gRNA
augucuagcugugcuugcac

SEQ ID NO: 10209 - RNA, 20 nt, Artificial Sequence
  MKO10010209_A_Chid1
  gRNA
aucguagcuacugcucauca

SEQ ID NO: 10210 - RNA, 20 nt, Artificial Sequence
  MKO10010210_A_Chid1
  gRNA
ucaccaccagaccccgaucu

SEQ ID NO: 10211 - RNA, 20 nt, Artificial Sequence
  MKO10010211_A_Chid1
  gRNA
cucaccuaugcgcacaccuu

SEQ ID NO: 10212 - RNA, 20 nt, Artificial Sequence
  MKO10010212_A_Chil1
  gRNA
agagacgcacugcuuucguc

SEQ ID NO: 10213 - RNA, 20 nt, Artificial Sequence
  MKO10010213_A_Chil1
  gRNA
uacugcuugucucuuaagcg

SEQ ID NO: 10214 - RNA, 20 nt, Artificial Sequence
  MKO10010214_A_Chil1
  gRNA
gguggaaauuuggcgaaaaa

SEQ ID NO: 10215 - RNA, 20 nt, Artificial Sequence
  MKO10010215_A_Chil3
  gRNA
cgugacuaugaagcauugaa

SEQ ID NO: 10216 - RNA, 20 nt, Artificial Sequence
  MKO10010216_A_Chil3
  gRNA
gguuugaaacucccuucuau

SEQ ID NO: 10217 - RNA, 20 nt, Artificial Sequence
  MKO10010217_A_Chil3
  gRNA
aauucuucugaacguacagc

SEQ ID NO: 10218 - RNA, 20 nt, Artificial Sequence
  MKO10010218_A_Chil4
  gRNA
cgugacuaugaagcauuaaa

SEQ ID NO: 10219 - RNA, 20 nt, Artificial Sequence
  MKO10010219_A_Chil4
  gRNA
gcuaaggacaggccaacaga

SEQ ID NO: 10220 - RNA, 20 nt, Artificial Sequence
  MKO10010220_A_Chil4
  gRNA
cugacuuaaugaaugucuga

SEQ ID NO: 10221 - RNA, 20 nt, Artificial Sequence
  MKO10010221_A_Chil6
  gRNA
caucaaauccauacuuccgc

SEQ ID NO: 10222 - RNA, 20 nt, Artificial Sequence
  MKO10010222_A_Chil6
  gRNA
aguuccagcaaccaauagac

SEQ ID NO: 10223 - RNA, 20 nt, Artificial Sequence
  MKO10010223_A_Chil6
  gRNA
uggauuugauggacuuaauu

SEQ ID NO: 10224 - RNA, 20 nt, Artificial Sequence
  MKO10010224_A_Chit1
  gRNA
agaaccgaacugccuccguc

SEQ ID NO: 10225 - RNA, 20 nt, Artificial Sequence
  MKO10010225_A_Chit1
  gRNA
gagauucacagcccugauac

SEQ ID NO: 10226 - RNA, 20 nt, Artificial Sequence
  MKO10010226_A_Chit1
  gRNA
cucaagacccuguuagccgu

SEQ ID NO: 10227 - RNA, 20 nt, Artificial Sequence
  MKO10010227_A_Chka
  gRNA
cucaucgccaacgcuggcua

SEQ ID NO: 10228 - RNA, 20 nt, Artificial Sequence
  MKO10010228_A_Chka
  gRNA
ucacuugggccaaaacucuu

SEQ ID NO: 10229 - RNA, 20 nt, Artificial Sequence
  MKO10010229_A_Chka
  gRNA
ccgggauaaacugcuccagu

SEQ ID NO: 10230 - RNA, 20 nt, Artificial Sequence
  MKO10010230_A_Chkb
  gRNA
accgaaccacguacccagug

SEQ ID NO: 10231 - RNA, 20 nt, Artificial Sequence
  MKO10010231_A_Chkb
  gRNA
acgggccauccucguugcaa

SEQ ID NO: 10232 - RNA, 20 nt, Artificial Sequence
  MKO10010232_A_Chkb
  gRNA
uagagaccgcucugcgagaa

SEQ ID NO: 10233 - RNA, 20 nt, Artificial Sequence
  MKO10010233_A_Chl1
  gRNA
uuguuagccgcaauuauccg

SEQ ID NO: 10234 - RNA, 20 nt, Artificial Sequence
  MKO10010234_A_Chl1
  gRNA
uguuucgcauccaauagacu

SEQ ID NO: 10235 - RNA, 20 nt, Artificial Sequence
  MKO10010235_A_Chl1
  gRNA
uguaaagcagucauacgugc

SEQ ID NO: 10236 - RNA, 20 nt, Artificial Sequence
  MKO10010236_A_Chml
  gRNA
auuucuccguggccguauaa

SEQ ID NO: 10237 - RNA, 20 nt, Artificial Sequence
  MKO10010237_A_Chml
  gRNA
agccaucucucuucgcaaga

SEQ ID NO: 10238 - RNA, 20 nt, Artificial Sequence
  MKO10010238_A_Chml
  gRNA
gcugguccgaaucugucuuc

SEQ ID NO: 10239 - RNA, 20 nt, Artificial Sequence
  MKO10010239_A_Chmp1a
  gRNA
gcuccgaauggccucccgug

SEQ ID NO: 10240 - RNA, 20 nt, Artificial Sequence
  MKO10010240_A_Chmp1a
  gRNA
auuacgcaccuucuucacuu

SEQ ID NO: 10241 - RNA, 20 nt, Artificial Sequence
  MKO10010241_A_Chmp1a
  gRNA
uacaaaccuucaacuggaac

SEQ ID NO: 10242 - RNA, 20 nt, Artificial Sequence
  MKO10010242_A_Chmp1b
  gRNA
gccgucagacuugaucccga

SEQ ID NO: 10243 - RNA, 20 nt, Artificial Sequence
  MKO10010243_A_Chmp1b
  gRNA
acaucgucgugcggcuucgg

SEQ ID NO: 10244 - RNA, 20 nt, Artificial Sequence
  MKO10010244_A_Chmp1b
  gRNA
guucuuuggccgcgaauuuc

SEQ ID NO: 10245 - RNA, 20 nt, Artificial Sequence
  MKO10010245_A_Chmp2a
  gRNA
caaacuugcguacauaucuc

SEQ ID NO: 10246 - RNA, 20 nt, Artificial Sequence
  MKO10010246_A_Chmp2a
  gRNA
gcaggaugcuguucgaauca

SEQ ID NO: 10247 - RNA, 20 nt, Artificial Sequence
  MKO10010247_A_Chmp2a
  gRNA
ucugcagaccuucccuccac

SEQ ID NO: 10248 - RNA, 20 nt, Artificial Sequence
  MKO10010248_A_Chmp2b
  gRNA
gaacuugauucacgaugucc

SEQ ID NO: 10249 - RNA, 20 nt, Artificial Sequence
  MKO10010249_A_Chmp2b
  gRNA
auucaucacuuucguuugug

SEQ ID NO: 10250 - RNA, 20 nt, Artificial Sequence
  MKO10010250_A_Chmp2b
  gRNA
uugguaauaaggaagcgugc

SEQ ID NO: 10251 - RNA, 20 nt, Artificial Sequence
  MKO10010251_A_Chmp3
  gRNA
ucagcgguccugcgaguagc

SEQ ID NO: 10252 - RNA, 20 nt, Artificial Sequence
  MKO10010252_A_Chmp3
  gRNA
aauuuccccagguuaaugaa

SEQ ID NO: 10253 - RNA, 20 nt, Artificial Sequence
  MKO10010253_A_Chmp3
  gRNA
uauucaggcuggaaucauag

SEQ ID NO: 10254 - RNA, 20 nt, Artificial Sequence
  MKO10010254_A_Chmp4b
  gRNA
cuuuggagaagaguucgacg

SEQ ID NO: 10255 - RNA, 20 nt, Artificial Sequence
  MKO10010255_A_Chmp4b
  gRNA
gcauacucaccggguuugga

SEQ ID NO: 10256 - RNA, 20 nt, Artificial Sequence
  MKO10010256_A_Chmp4b
  gRNA
cuucccucuagccgcccugc

SEQ ID NO: 10257 - RNA, 20 nt, Artificial Sequence
  MKO10010257_A_Chmp4c
  gRNA
guuccguaagaccuccgugu

SEQ ID NO: 10258 - RNA, 20 nt, Artificial Sequence
  MKO10010258_A_Chmp4c
  gRNA
accuaccucaucgaagccau

SEQ ID NO: 10259 - RNA, 20 nt, Artificial Sequence
  MKO10010259_A_Chmp4c
  gRNA
aguucuccagcgcuucucgc

SEQ ID NO: 10260 - RNA, 20 nt, Artificial Sequence
  MKO10010260_A_Chmp5
  gRNA
ugagcaacagcgagacaacc

SEQ ID NO: 10261 - RNA, 20 nt, Artificial Sequence
  MKO10010261_A_Chmp5
  gRNA
ucacuaguucagcauccagc

SEQ ID NO: 10262 - RNA, 20 nt, Artificial Sequence
  MKO10010262_A_Chmp5
  gRNA
ugcugaacuagugaaauaua

SEQ ID NO: 10263 - RNA, 20 nt, Artificial Sequence
  MKO10010263_A_Chmp6
  gRNA
accgggagcaacugcucgau

SEQ ID NO: 10264 - RNA, 20 nt, Artificial Sequence
  MKO10010264_A_Chmp6
  gRNA
uccuaucgagcaguugcucc

SEQ ID NO: 10265 - RNA, 20 nt, Artificial Sequence
  MKO10010265_A_Chmp6
  gRNA
ucaucaggugauguccauag

SEQ ID NO: 10266 - RNA, 20 nt, Artificial Sequence
  MKO10010266_A_Chmp7
  gRNA
gguaucuccugugaacgacg

SEQ ID NO: 10267 - RNA, 20 nt, Artificial Sequence
  MKO10010267_A_Chmp7
  gRNA
gaagguccucucauccgggc

SEQ ID NO: 10268 - RNA, 20 nt, Artificial Sequence
  MKO10010268_A_Chmp7
  gRNA
guauaggcgauacaccuccu

SEQ ID NO: 10269 - RNA, 20 nt, Artificial Sequence
  MKO10010269_A_Chm
  gRNA
ugcuucagugauguccgcac

SEQ ID NO: 10270 - RNA, 20 nt, Artificial Sequence
  MKO10010270_A_Chm
  gRNA
uucacagcuccucgugcuua

SEQ ID NO: 10271 - RNA, 20 nt, Artificial Sequence
  MKO10010271_A_Chm
  gRNA
guccuggcuaaaggaauacc

SEQ ID NO: 10272 - RNA, 20 nt, Artificial Sequence
  MKO10010272_A_Chn1
  gRNA
cgacauacgcuaucagagac

SEQ ID NO: 10273 - RNA, 20 nt, Artificial Sequence
  MKO10010273_A_Chn1
  gRNA
gcgaucucagugcuucguga

SEQ ID NO: 10274 - RNA, 20 nt, Artificial Sequence
  MKO10010274_A_Chn1
  gRNA
uauggacccugacgagcaau

SEQ ID NO: 10275 - RNA, 20 nt, Artificial Sequence
  MKO10010275_A_Chn2
  gRNA
gcagucauuggggacgugcu

SEQ ID NO: 10276 - RNA, 20 nt, Artificial Sequence
  MKO10010276_A_Chn2
  gRNA
guugugagcuuugacaagcg

SEQ ID NO: 10277 - RNA, 20 nt, Artificial Sequence
  MKO10010277_A_Chn2
  gRNA
uaccugaacaccggacuccc

SEQ ID NO: 10278 - RNA, 20 nt, Artificial Sequence
  MKO10010278_A_Chodl
  gRNA
ucacccggcuagacaguuca

SEQ ID NO: 10279 - RNA, 20 nt, Artificial Sequence
  MKO10010279_A_Chodl
  gRNA
uccgcugcucuuacugauac

SEQ ID NO: 10280 - RNA, 20 nt, Artificial Sequence
  MKO10010280_A_Chodl
  gRNA
gaggucccuaccuuuaccag

SEQ ID NO: 10281 - RNA, 20 nt, Artificial Sequence
  MKO10010281_A_Chordc1
  gRNA
uagugagaagccaccugaac

SEQ ID NO: 10282 - RNA, 20 nt, Artificial Sequence
  MKO10010282_A_Chordc1
  gRNA
ugucuuucaugaugcccuaa

SEQ ID NO: 10283 - RNA, 20 nt, Artificial Sequence
  MKO10010283_A_Chordc1
  gRNA
uacuaacagggcuguacaaa

SEQ ID NO: 10284 - RNA, 20 nt, Artificial Sequence
  MKO10010284_A_Chp1
  gRNA
aaggggagaacgggacucuc

SEQ ID NO: 10285 - RNA, 20 nt, Artificial Sequence
  MKO10010285_A_Chp1
  gRNA
guacagccgcuucaccagcc

SEQ ID NO: 10286 - RNA, 20 nt, Artificial Sequence
  MKO10010286_A_Chp1
  gRNA
uacagugcagcuuguugcuc

SEQ ID NO: 10287 - RNA, 20 nt, Artificial Sequence
  MKO10010287_A_Chp2
  gRNA
gccugcuccgccucuaccac

SEQ ID NO: 10288 - RNA, 20 nt, Artificial Sequence
  MKO10010288_A_Chp2
  gRNA
agucagagacuguauuucgc

SEQ ID NO: 10289 - RNA, 20 nt, Artificial Sequence
  MKO10010289_A_Chp2
  gRNA
ugcauuucagcucuaugauc

SEQ ID NO: 10290 - RNA, 20 nt, Artificial Sequence
  MKO10010290_A_Chpf2
  gRNA
uacuguacgguuaaccgcga

SEQ ID NO: 10291 - RNA, 20 nt, Artificial Sequence
  MKO10010291_A_Chpf2
  gRNA
gauguggccgcaagcgcaau

SEQ ID NO: 10292 - RNA, 20 nt, Artificial Sequence
  MKO10010292_A_Chpf2
  gRNA
cucuuucgagccguagagcc

SEQ ID NO: 10293 - RNA, 20 nt, Artificial Sequence
  MKO10010293_A_Chpf
  gRNA
gagcacugacgaugucguug

SEQ ID NO: 10294 - RNA, 20 nt, Artificial Sequence
  MKO10010294_A_Chpf
  gRNA
uacgcguucuccugcgccga

SEQ ID NO: 10295 - RNA, 20 nt, Artificial Sequence
  MKO10010295_A_Chpf
  gRNA
gccgcguugguguugccgcg

SEQ ID NO: 10296 - RNA, 20 nt, Artificial Sequence
  MKO10010296_A_Chpt1
  gRNA
uguuccuaggcgaacagcaa

SEQ ID NO: 10297 - RNA, 20 nt, Artificial Sequence
  MKO10010297_A_Chpt1
  gRNA
gaacagcgacucucccaccg

SEQ ID NO: 10298 - RNA, 20 nt, Artificial Sequence
  MKO10010298_A_Chpt1
  gRNA
ggaggagcaccgcuacaccg

SEQ ID NO: 10299 - RNA, 20 nt, Artificial Sequence
  MKO10010299_A_Chrac1
  gRNA
ggggcaaugacacgagccgc

SEQ ID NO: 10300 - RNA, 20 nt, Artificial Sequence
  MKO10010300_A_Chrac1
  gRNA
gacgcggaagauggcggacg

SEQ ID NO: 10301 - RNA, 20 nt, Artificial Sequence
  MKO10010301_A_Chrac1
  gRNA
gagacacuucaguuucucgc

SEQ ID NO: 10302 - RNA, 20 nt, Artificial Sequence
  MKO10010302_A_Chrdl1
  gRNA
agcaagucaugcgaauacaa

SEQ ID NO: 10303 - RNA, 20 nt, Artificial Sequence
  MKO10010303_A_Chrdl1
  gRNA
auuguauucgcaugacuugc

SEQ ID NO: 10304 - RNA, 20 nt, Artificial Sequence
  MKO10010304_A_Chrdl1
  gRNA
acacaguaaaccaguccaua

SEQ ID NO: 10305 - RNA, 20 nt, Artificial Sequence
  MKO10010305_A_Chrdl2
  gRNA
acgcaguauaucgugccuug

SEQ ID NO: 10306 - RNA, 20 nt, Artificial Sequence
  MKO10010306_A_Chrdl2
  gRNA
uauauacccccggccagagc

SEQ ID NO: 10307 - RNA, 20 nt, Artificial Sequence
  MKO10010307_A_Chrdl2
  gRNA
cacugguuggacaggcgggc

SEQ ID NO: 10308 - RNA, 20 nt, Artificial Sequence
  MKO10010308_A_Chrd
  gRNA
caucgcaguuacagugaucg

SEQ ID NO: 10309 - RNA, 20 nt, Artificial Sequence
  MKO10010309_A_Chrd
  gRNA
cgagcuaccgccugcgaccu

SEQ ID NO: 10310 - RNA, 20 nt, Artificial Sequence
  MKO10010310_A_Chrd
  gRNA
cgggugccacgucucgucca

SEQ ID NO: 10311 - RNA, 20 nt, Artificial Sequence
  MKO10010311_A_Chrm1
  gRNA
cucugaugauuggccucgcg

SEQ ID NO: 10312 - RNA, 20 nt, Artificial Sequence
  MKO10010312_A_Chrm1
  gRNA
cgaaggaaaccaaccacgcg

SEQ ID NO: 10313 - RNA, 20 nt, Artificial Sequence
  MKO10010313_A_Chrm1
  gRNA
gagccaagcgcacuccccgc

SEQ ID NO: 10314 - RNA, 20 nt, Artificial Sequence
  MKO10010314_A_Chrm2
  gRNA
uccaacgcugccgucaccuu

SEQ ID NO: 10315 - RNA, 20 nt, Artificial Sequence
  MKO10010315_A_Chrm2
  gRNA
cgaucccacuaguucuacug

SEQ ID NO: 10316 - RNA, 20 nt, Artificial Sequence
  MKO10010316_A_Chrm2
  gRNA
agccaaaggucgcacacuac

SEQ ID NO: 10317 - RNA, 20 nt, Artificial Sequence
  MKO10010317_A_Chrm3
  gRNA
cccgaugaucagaucugcgc

SEQ ID NO: 10318 - RNA, 20 nt, Artificial Sequence
  MKO10010318_A_Chrm3
  gRNA
ggcagcgaucgccgugccga

SEQ ID NO: 10319 - RNA, 20 nt, Artificial Sequence
  MKO10010319_A_Chrm3
  gRNA
ccuacaucauuaugaaccgc

SEQ ID NO: 10320 - RNA, 20 nt, Artificial Sequence
  MKO10010320_A_Chrm4
  gRNA
cugugccgauguuccgauac

SEQ ID NO: 10321 - RNA, 20 nt, Artificial Sequence
  MKO10010321_A_Chrm4
  gRNA
cguggcagguacgaucucga

SEQ ID NO: 10322 - RNA, 20 nt, Artificial Sequence
  MKO10010322_A_Chrm4
  gRNA
ugccagcaucgcucguaacc

SEQ ID NO: 10323 - RNA, 20 nt, Artificial Sequence
  MKO10010323_A_Chrm5
  gRNA
cgcuuggcucgguaugucag

SEQ ID NO: 10324 - RNA, 20 nt, Artificial Sequence
  MKO10010324_A_Chrm5
  gRNA
uguugccuauaaguuccgau

SEQ ID NO: 10325 - RNA, 20 nt, Artificial Sequence
  MKO10010325_A_Chrm5
  gRNA
gcaucaugaucggcuuggca

SEQ ID NO: 10326 - RNA, 20 nt, Artificial Sequence
  MKO10010326_A_Chrna10
  gRNA
gccgugcguccaugagccga

SEQ ID NO: 10327 - RNA, 20 nt, Artificial Sequence
  MKO10010327_A_Chrna10
  gRNA
uccaaucuucauggcggcgc

SEQ ID NO: 10328 - RNA, 20 nt, Artificial Sequence
  MKO10010328_A_Chrna10
  gRNA
acggcacgagcugcguguga

SEQ ID NO: 10329 - RNA, 20 nt, Artificial Sequence
  MKO10010329_A_Chrna1
  gRNA
cuccgaacaugagacgcguc

SEQ ID NO: 10330 - RNA, 20 nt, Artificial Sequence
  MKO10010330_A_Chrna1
  gRNA
caccagacgcgucucauguu

SEQ ID NO: 10331 - RNA, 20 nt, Artificial Sequence
  MKO10010331_A_Chrna1
  gRNA
uuguuauagagaacgacguc

SEQ ID NO: 10332 - RNA, 20 nt, Artificial Sequence
  MKO10010332_A_Chrna2
  gRNA
ccuacuacuucguuauccgc

SEQ ID NO: 10333 - RNA, 20 nt, Artificial Sequence
  MKO10010333_A_Chrna2
  gRNA
caagaaguacgacugcugcg

SEQ ID NO: 10334 - RNA, 20 nt, Artificial Sequence
  MKO10010334_A_Chrna2
  gRNA
aaagcgcacgaugaccacau

SEQ ID NO: 10335 - RNA, 20 nt, Artificial Sequence
  MKO10010335_A_Chrna3
  gRNA
ggauggucucggugaucacg

SEQ ID NO: 10336 - RNA, 20 nt, Artificial Sequence
  MKO10010336_A_Chrna3
  gRNA
auagcgaguacgugaugucu

SEQ ID NO: 10337 - RNA, 20 nt, Artificial Sequence
  MKO10010337_A_Chrna3
  gRNA
ggaugggacacguuagccac

SEQ ID NO: 10338 - RNA, 20 nt, Artificial Sequence
  MKO10010338_A_Chrna4
  gRNA
gaccuucucgccgcacuccg

SEQ ID NO: 10339 - RNA, 20 nt, Artificial Sequence
  MKO10010339_A_Chrna4
  gRNA
cgccuucuacugcccguguc

SEQ ID NO: 10340 - RNA, 20 nt, Artificial Sequence
  MKO10010340_A_Chrna4
  gRNA
gccgcuccuccgcaugggcc

SEQ ID NO: 10341 - RNA, 20 nt, Artificial Sequence
  MKO10010341_A_Chrna5
  gRNA
gaaagagaacgacguccgcg

SEQ ID NO: 10342 - RNA, 20 nt, Artificial Sequence
  MKO10010342_A_Chrna5
  gRNA
cagaaacgagagcccgaugc

SEQ ID NO: 10343 - RNA, 20 nt, Artificial Sequence
  MKO10010343_A_Chrna5
  gRNA
caccugcuucaaccagacgu

SEQ ID NO: 10344 - RNA, 20 nt, Artificial Sequence
  MKO10010344_A_Chrna6
  gRNA
gaaugucuccgaucccguca

SEQ ID NO: 10345 - RNA, 20 nt, Artificial Sequence
  MKO10010345_A_Chrna6
  gRNA
ucgaugccaucauacuccgu

SEQ ID NO: 10346 - RNA, 20 nt, Artificial Sequence
  MKO10010346_A_Chrna6
  gRNA
ugggaaauugucgacgccuc

SEQ ID NO: 10347 - RNA, 20 nt, Artificial Sequence
  MKO10010347_A_Chrna7
  gRNA
cacauuccacaccaacgucu

SEQ ID NO: 10348 - RNA, 20 nt, Artificial Sequence
  MKO10010348_A_Chrna7
  gRNA
ggucaagaacuacaacccgc

SEQ ID NO: 10349 - RNA, 20 nt, Artificial Sequence
  MKO10010349_A_Chrna7
  gRNA
ggcgggcuuaccuguuauag

SEQ ID NO: 10350 - RNA, 20 nt, Artificial Sequence
  MKO10010350_A_Chrna9
  gRNA
uggaguccagcccgucauac

SEQ ID NO: 10351 - RNA, 20 nt, Artificial Sequence
  MKO10010351_A_Chrna9
  gRNA
gguacgcaucgugccaaguu

SEQ ID NO: 10352 - RNA, 20 nt, Artificial Sequence
  MKO10010352_A_Chrna9
  gRNA
accgcguccguaucuucuac

SEQ ID NO: 10353 - RNA, 20 nt, Artificial Sequence
  MKO10010353_A_Chrnb1
  gRNA
cggaaauuucgacguugccc

SEQ ID NO: 10354 - RNA, 20 nt, Artificial Sequence
  MKO10010354_A_Chrnb1
  gRNA
uucgucaggcgcccgcgggu

SEQ ID NO: 10355 - RNA, 20 nt, Artificial Sequence
  MKO10010355_A_Chrnb1
  gRNA
cuuaggaguggaccgacuac

SEQ ID NO: 10356 - RNA, 20 nt, Artificial Sequence
  MKO10010356_A_Chrnb2
  gRNA
caccucccucgacguaccgc

SEQ ID NO: 10357 - RNA, 20 nt, Artificial Sequence
  MKO10010357_A_Chrnb2
  gRNA
gcccaucgagcgccccagac

SEQ ID NO: 10358 - RNA, 20 nt, Artificial Sequence
  MKO10010358_A_Chrnb2
  gRNA
acggaucagcuuguuauagc

SEQ ID NO: 10359 - RNA, 20 nt, Artificial Sequence
  MKO10010359_A_Chrnb3
  gRNA
uucuaccuacccuccgacga

SEQ ID NO: 10360 - RNA, 20 nt, Artificial Sequence
  MKO10010360_A_Chrnb3
  gRNA
ugguggaauuaauucgauaa

SEQ ID NO: 10361 - RNA, 20 nt, Artificial Sequence
  MKO10010361_A_Chrnb3
  gRNA
ggccaugggaugguacguug

SEQ ID NO: 10362 - RNA, 20 nt, Artificial Sequence
  MKO10010362_A_Chrnb4
  gRNA
aacgugaucgugcguuccaa

SEQ ID NO: 10363 - RNA, 20 nt, Artificial Sequence
  MKO10010363_A_Chrnb4
  gRNA
ggaauggacugacuaccgcc

SEQ ID NO: 10364 - RNA, 20 nt, Artificial Sequence
  MKO10010364_A_Chrnb4
  gRNA
uuguggcccucccgggucga

SEQ ID NO: 10365 - RNA, 20 nt, Artificial Sequence
  MKO10010365_A_Chrnd
  gRNA
cguagcccuucucauugaau

SEQ ID NO: 10366 - RNA, 20 nt, Artificial Sequence
  MKO10010366_A_Chrnd
  gRNA
guggcuaccagagauuguac

SEQ ID NO: 10367 - RNA, 20 nt, Artificial Sequence
  MKO10010367_A_Chrnd
  gRNA
agugauguucccgaagucgu

SEQ ID NO: 10368 - RNA, 20 nt, Artificial Sequence
  MKO10010368_A_Chrne
  gRNA
cuuaggacuggcacgacuau

SEQ ID NO: 10369 - RNA, 20 nt, Artificial Sequence
  MKO10010369_A_Chrne
  gRNA
gggucccuucagaacaugua

SEQ ID NO: 10370 - RNA, 20 nt, Artificial Sequence
  MKO10010370_A_Chrne
  gRNA
gacuagaacauugcugucgu

SEQ ID NO: 10371 - RNA, 20 nt, Artificial Sequence
  MKO10010371_A_Chrng
  gRNA
cuggcggccagauaucgucc

SEQ ID NO: 10372 - RNA, 20 nt, Artificial Sequence
  MKO10010372_A_Chrng
  gRNA
aggcccucacaacuaacguc

SEQ ID NO: 10373 - RNA, 20 nt, Artificial Sequence
  MKO10010373_A_Chrng
  gRNA
gggggucguaguuucgcauc

SEQ ID NO: 10374 - RNA, 20 nt, Artificial Sequence
  MKO10010374_A_Chst10
  gRNA
gugcucaccuucgggacuuc

SEQ ID NO: 10375 - RNA, 20 nt, Artificial Sequence
  MKO10010375_A_Chst10
  gRNA
ccuaccauccggauccuuaa

SEQ ID NO: 10376 - RNA, 20 nt, Artificial Sequence
  MKO10010376_A_Chst10
  gRNA
gcggaaccucucacacaccg

SEQ ID NO: 10377 - RNA, 20 nt, Artificial Sequence
  MKO10010377_A_Chst11
  gRNA
ugucaaguucgaggaguucg

SEQ ID NO: 10378 - RNA, 20 nt, Artificial Sequence
  MKO10010378_A_Chst11
  gRNA
ccacauccacuacgaccucg

SEQ ID NO: 10379 - RNA, 20 nt, Artificial Sequence
  MKO10010379_A_Chst11
  gRNA
gucaugcggaggaaccccuu

SEQ ID NO: 10380 - RNA, 20 nt, Artificial Sequence
  MKO10010380_A_Chst12
  gRNA
ccguccuguuccgauaacug

SEQ ID NO: 10381 - RNA, 20 nt, Artificial Sequence
  MKO10010381_A_Chst12
  gRNA
ugucgccagugcucguugaa

SEQ ID NO: 10382 - RNA, 20 nt, Artificial Sequence
  MKO10010382_A_Chst12
  gRNA
gucgcgcacgaacaggaacu

SEQ ID NO: 10383 - RNA, 20 nt, Artificial Sequence
  MKO10010383_A_Chst13
  gRNA
cgaagcgcacgucguggccg

SEQ ID NO: 10384 - RNA, 20 nt, Artificial Sequence
  MKO10010384_A_Chst13
  gRNA
gcaggguccacgcuccgcga

SEQ ID NO: 10385 - RNA, 20 nt, Artificial Sequence
  MKO10010385_A_Chst13
  gRNA
cgcgcacucaccgggacgca

SEQ ID NO: 10386 - RNA, 20 nt, Artificial Sequence
  MKO10010386_A_Chst14
  gRNA
cccgaaaagcgcggagaccc

SEQ ID NO: 10387 - RNA, 20 nt, Artificial Sequence
  MKO10010387_A_Chst14
  gRNA
cggcccaauggggcccgccu

SEQ ID NO: 10388 - RNA, 20 nt, Artificial Sequence
  MKO10010388_A_Chst14
  gRNA
uuguccgcacacggcccuca

SEQ ID NO: 10389 - RNA, 20 nt, Artificial Sequence
  MKO10010389_A_Chst15
  gRNA
acuacgagaccgcuacccug

SEQ ID NO: 10390 - RNA, 20 nt, Artificial Sequence
  MKO10010390_A_Chst15
  gRNA
ccgcuuggaguagagcacgu

SEQ ID NO: 10391 - RNA, 20 nt, Artificial Sequence
  MKO10010391_A_Chst15
  gRNA
ugguggacccggaagcgcuu

SEQ ID NO: 10392 - RNA, 20 nt, Artificial Sequence
  MKO10010392_A_Chst1
  gRNA
ggucgccccucguauuguuc

SEQ ID NO: 10393 - RNA, 20 nt, Artificial Sequence
  MKO10010393_A_Chst1
  gRNA
uugucgugagcgcagucaug

SEQ ID NO: 10394 - RNA, 20 nt, Artificial Sequence
  MKO10010394_A_Chst1
  gRNA
guacaugcugguacguuaug

SEQ ID NO: 10395 - RNA, 20 nt, Artificial Sequence
  MKO10010395_A_Chst2
  gRNA
cgcgggcuaugcacugcuac

SEQ ID NO: 10396 - RNA, 20 nt, Artificial Sequence
  MKO10010396_A_Chst2
  gRNA
gugucgcaaguaccgcacgc

SEQ ID NO: 10397 - RNA, 20 nt, Artificial Sequence
  MKO10010397_A_Chst2
  gRNA
ucccgcauccgcucgcguca

SEQ ID NO: 10398 - RNA, 20 nt, Artificial Sequence
  MKO10010398_A_Chst3
  gRNA
cguugaguggcccgcagcga

SEQ ID NO: 10399 - RNA, 20 nt, Artificial Sequence
  MKO10010399_A_Chst3
  gRNA
ccgcacggguuccucguucg

SEQ ID NO: 10400 - RNA, 20 nt, Artificial Sequence
  MKO10010400_A_Chst3
  gRNA
cguaucugccucgaaucuuu

SEQ ID NO: 10401 - RNA, 20 nt, Artificial Sequence
  MKO10010401_A_Chst4
  gRNA
ggaccaggugcacgacgugc

SEQ ID NO: 10402 - RNA, 20 nt, Artificial Sequence
  MKO10010402_A_Chst4
  gRNA
uuacaaugucacccgcggca

SEQ ID NO: 10403 - RNA, 20 nt, Artificial Sequence
  MKO10010403_A_Chst4
  gRNA
uugguccuuaccuuacgaaa

SEQ ID NO: 10404 - RNA, 20 nt, Artificial Sequence
  MKO10010404_A_Chst5
  gRNA
ugcaccuagugcgcgacccg

SEQ ID NO: 10405 - RNA, 20 nt, Artificial Sequence
  MKO10010405_A_Chst5
  gRNA
cgucugggauacguugucgc

SEQ ID NO: 10406 - RNA, 20 nt, Artificial Sequence
  MKO10010406_A_Chst5
  gRNA
gcacuaggugcacgaugcgc

SEQ ID NO: 10407 - RNA, 20 nt, Artificial Sequence
  MKO10010407_A_Chst7
  gRNA
cgcgaguugugcacggcccg

SEQ ID NO: 10408 - RNA, 20 nt, Artificial Sequence
  MKO10010408_A_Chst7
  gRNA
gucccacguccgcgcgugcc

SEQ ID NO: 10409 - RNA, 20 nt, Artificial Sequence
  MKO10010409_A_Chst7
  gRNA
ccgcgucauauugaaugcga

SEQ ID NO: 10410 - RNA, 20 nt, Artificial Sequence
  MKO10010410_A_Chst8
  gRNA
agccgcaucguuccgagucg

SEQ ID NO: 10411 - RNA, 20 nt, Artificial Sequence
  MKO10010411_A_Chst8
  gRNA
gguaccgcgccaacgccucg

SEQ ID NO: 10412 - RNA, 20 nt, Artificial Sequence
  MKO10010412_A_Chst8
  gRNA
cgaguucguccaguaccugu

SEQ ID NO: 10413 - RNA, 20 nt, Artificial Sequence
  MKO10010413_A_Chst9
  gRNA
aaagauuagucuccgcauuu

SEQ ID NO: 10414 - RNA, 20 nt, Artificial Sequence
  MKO10010414_A_Chst9
  gRNA
ucccauagugcacaguauca

SEQ ID NO: 10415 - RNA, 20 nt, Artificial Sequence
  MKO10010415_A_Chst9
  gRNA
ccugauucgugaucuguuuc

SEQ ID NO: 10416 - RNA, 20 nt, Artificial Sequence
  MKO10010416_A_Chsy1
  gRNA
ucgcaucagcucgaccuguu

SEQ ID NO: 10417 - RNA, 20 nt, Artificial Sequence
  MKO10010417_A_Chsy1
  gRNA
aacauucugaucccguuguc

SEQ ID NO: 10418 - RNA, 20 nt, Artificial Sequence
  MKO10010418_A_Chsy1
  gRNA
acugcacgccugcgaaucuc

SEQ ID NO: 10419 - RNA, 20 nt, Artificial Sequence
  MKO10010419_A_Chsy3
  gRNA
cgacugcucuagccgcggcc

SEQ ID NO: 10420 - RNA, 20 nt, Artificial Sequence
  MKO10010420_A_Chsy3
  gRNA
gguagccgagcggccguagu

SEQ ID NO: 10421 - RNA, 20 nt, Artificial Sequence
  MKO10010421_A_Chsy3
  gRNA
cacacugcgucccgccgaaa

SEQ ID NO: 10422 - RNA, 20 nt, Artificial Sequence
  MKO10010422_A_Chtf18
  gRNA
ucaggacaggauugcgauuu

SEQ ID NO: 10423 - RNA, 20 nt, Artificial Sequence
  MKO10010423_A_Chtf18
  gRNA
gccccauggucaaacgaccc

SEQ ID NO: 10424 - RNA, 20 nt, Artificial Sequence
  MKO10010424_A_Chtf18
  gRNA
aagaccucuggacucggugg

SEQ ID NO: 10425 - RNA, 20 nt, Artificial Sequence
  MKO10010425_A_Chtf8
  gRNA
gacguuggugauaauaggcu

SEQ ID NO: 10426 - RNA, 20 nt, Artificial Sequence
  MKO10010426_A_Chtf8
  gRNA
aucgaggcucgcuacagcac

SEQ ID NO: 10427 - RNA, 20 nt, Artificial Sequence
  MKO10010427_A_Chtf8
  gRNA
acuuucaguacgggggcuga

SEQ ID NO: 10428 - RNA, 20 nt, Artificial Sequence
  MKO10010428_A_Chtop
  gRNA
gagcuacggcucguccaccu

SEQ ID NO: 10429 - RNA, 20 nt, Artificial Sequence
  MKO10010429_A_Chtop
  gRNA
uggccaggucgggguaugau

SEQ ID NO: 10430 - RNA, 20 nt, Artificial Sequence
  MKO10010430_A_Chtop
  gRNA
acgagccguagcuccccgaa

SEQ ID NO: 10431 - RNA, 20 nt, Artificial Sequence
  MKO10010431_A_Chuk
  gRNA
acugacguucccgaaaccgc

SEQ ID NO: 10432 - RNA, 20 nt, Artificial Sequence
  MKO10010432_A_Chuk
  gRNA
aagccguucccgcaucuccc

SEQ ID NO: 10433 - RNA, 20 nt, Artificial Sequence
  MKO10010433_A_Chuk
  gRNA
ggaccaugcgaauguuguaa

SEQ ID NO: 10434 - RNA, 20 nt, Artificial Sequence
  MKO10010434_A_Churc1
  gRNA
ucguucuuacugaacuucgc

SEQ ID NO: 10435 - RNA, 20 nt, Artificial Sequence
  MKO10010435_A_Churc1
  gRNA
gcugaauguauacucguguc

SEQ ID NO: 10436 - RNA, 20 nt, Artificial Sequence
  MKO10010436_A_Churc1
  gRNA
gaacgauccauucuccagac

SEQ ID NO: 10437 - RNA, 20 nt, Artificial Sequence
  MKO10010437_A_Ciao1
  gRNA
ggcgccagaugcguacaguu

SEQ ID NO: 10438 - RNA, 20 nt, Artificial Sequence
  MKO10010438_A_Ciao1
  gRNA
augaccgaacuguacgcauc

SEQ ID NO: 10439 - RNA, 20 nt, Artificial Sequence
  MKO10010439_A_Ciao1
  gRNA
cgugguuuggcacccgagcc

SEQ ID NO: 10440 - RNA, 20 nt, Artificial Sequence
  MKO10010440_A_Ciapin1
  gRNA
cgacagaaugacaucgaagc

SEQ ID NO: 10441 - RNA, 20 nt, Artificial Sequence
  MKO10010441_A_Ciapin1
  gRNA
ugaggagguacaguccgugc

SEQ ID NO: 10442 - RNA, 20 nt, Artificial Sequence
  MKO10010442_A_Ciapin1
  gRNA
cugcgcucaguccgugucac

SEQ ID NO: 10443 - RNA, 20 nt, Artificial Sequence
  MKO10010443_A_Cib1
  gRNA
ugccuagacuuugaugacga

SEQ ID NO: 10444 - RNA, 20 nt, Artificial Sequence
  MKO10010444_A_Cib1
  gRNA
ggaucugcucaaacgauacu

SEQ ID NO: 10445 - RNA, 20 nt, Artificial Sequence
  MKO10010445_A_Cib1
  gRNA
gugcuuaccaaagaugcgga

SEQ ID NO: 10446 - RNA, 20 nt, Artificial Sequence
  MKO10010446_A_Cib2
  gRNA
ggcucccaaccucgucccga

SEQ ID NO: 10447 - RNA, 20 nt, Artificial Sequence
  MKO10010447_A_Cib2
  gRNA
ugcucugcgaaucagcgccu

SEQ ID NO: 10448 - RNA, 20 nt, Artificial Sequence
  MKO10010448_A_Cib2
  gRNA
uaguuugccuugagcucccg

SEQ ID NO: 10449 - RNA, 20 nt, Artificial Sequence
  MKO10010449_A_Cib3
  gRNA
uuuccgccagagaauugcgc

SEQ ID NO: 10450 - RNA, 20 nt, Artificial Sequence
  MKO10010450_A_Cib3
  gRNA
caggcuguucuaucgauacc

SEQ ID NO: 10451 - RNA, 20 nt, Artificial Sequence
  MKO10010451_A_Cib3
  gRNA
agaagaccugcgcaauucuc

SEQ ID NO: 10452 - RNA, 20 nt, Artificial Sequence
  MKO10010452_A_Cib4
  gRNA
guaccuaccauagauacgaa

SEQ ID NO: 10453 - RNA, 20 nt, Artificial Sequence
  MKO10010453_A_Cib4
  gRNA
gaaaagugacgacgcgucug

SEQ ID NO: 10454 - RNA, 20 nt, Artificial Sequence
  MKO10010454_A_Cib4
  gRNA
cuccuuauagugcuugcccg

SEQ ID NO: 10455 - RNA, 20 nt, Artificial Sequence
  MKO10010455_A_Cic
  gRNA
acgagaggccgcgccagacg

SEQ ID NO: 10456 - RNA, 20 nt, Artificial Sequence
  MKO10010456_A_Cic
  gRNA
ccugauacccgcgucuggcg

SEQ ID NO: 10457 - RNA, 20 nt, Artificial Sequence
  MKO10010457_A_Cic
  gRNA
acugcuccagggggccgucc

SEQ ID NO: 10458 - RNA, 20 nt, Artificial Sequence
  MKO10010458_A_Cidea
  gRNA
cgaguacaucucguacaucg

SEQ ID NO: 10459 - RNA, 20 nt, Artificial Sequence
  MKO10010459_A_Cidea
  gRNA
caaaccaugaccgaaguagc

SEQ ID NO: 10460 - RNA, 20 nt, Artificial Sequence
  MKO10010460_A_Cidea
  gRNA
cauccgaugcacaagcuuca

SEQ ID NO: 10461 - RNA, 20 nt, Artificial Sequence
  MKO10010461_A_Cideb
  gRNA
ggaggacgacacgugcuuga

SEQ ID NO: 10462 - RNA, 20 nt, Artificial Sequence
  MKO10010462_A_Cideb
  gRNA
agaauguagcuuucacguug

SEQ ID NO: 10463 - RNA, 20 nt, Artificial Sequence
  MKO10010463_A_Cideb
  gRNA
uuggcccuaaaagaguacuc

SEQ ID NO: 10464 - RNA, 20 nt, Artificial Sequence
  MKO10010464_A_Cidec
  gRNA
uuugcgaaccuuccgaucug

SEQ ID NO: 10465 - RNA, 20 nt, Artificial Sequence
  MKO10010465_A_Cidec
  gRNA
cacucacuucacgaugcgcu

SEQ ID NO: 10466 - RNA, 20 nt, Artificial Sequence
  MKO10010466_A_Cidec
  gRNA
gccaacuaagaagaucgaug

SEQ ID NO: 10467 - RNA, 20 nt, Artificial Sequence
  MKO10010467_A_Ciiua
  gRNA
acuggaucaguacguguucc

SEQ ID NO: 10468 - RNA, 20 nt, Artificial Sequence
  MKO10010468_A_Ciiua
  gRNA
gaggagaucgaacucagcuc

SEQ ID NO: 10469 - RNA, 20 nt, Artificial Sequence
  MKO10010469_A_Ciiua
  gRNA
ccugcaacagcuugcugaac

SEQ ID NO: 10470 - RNA, 20 nt, Artificial Sequence
  MKO10010470_A_Cilp2
  gRNA
acgaccuagcccgcaacucu

SEQ ID NO: 10471 - RNA, 20 nt, Artificial Sequence
  MKO10010471_A_Cilp2
  gRNA
cacgugucccgggagccccc

SEQ ID NO: 10472 - RNA, 20 nt, Artificial Sequence
  MKO10010472_A_Cilp2
  gRNA
ucgaagucgccaucuccucc

SEQ ID NO: 10473 - RNA, 20 nt, Artificial Sequence
  MKO10010473_A_Cilp
  gRNA
ugguuuaacaucgaccaccc

SEQ ID NO: 10474 - RNA, 20 nt, Artificial Sequence
  MKO10010474_A_Cilp
  gRNA
gacccguacccgcaccugcu

SEQ ID NO: 10475 - RNA, 20 nt, Artificial Sequence
  MKO10010475_A_Cilp
  gRNA
cauccuguaggguccuugcg

SEQ ID NO: 10476 - RNA, 20 nt, Artificial Sequence
  MKO10010476_A_Cinp
  gRNA
cgccaauggugugcuucaaa

SEQ ID NO: 10477 - RNA, 20 nt, Artificial Sequence
  MKO10010477_A_Cinp
  gRNA
ggcccccucuauuucacacg

SEQ ID NO: 10478 - RNA, 20 nt, Artificial Sequence
  MKO10010478_A_Cinp
  gRNA
cugcagaugaggucucccgc

SEQ ID NO: 10479 - RNA, 20 nt, Artificial Sequence
  MKO10010479_A_Cir1
  gRNA
cggguaccuuucuuaacucc

SEQ ID NO: 10480 - RNA, 20 nt, Artificial Sequence
  MKO10010480_A_Cir1
  gRNA
auuucauucagauugcuuau

SEQ ID NO: 10481 - RNA, 20 nt, Artificial Sequence
  MKO10010481_A_Cir1
  gRNA
acuguuguagaaagaagaaa

SEQ ID NO: 10482 - RNA, 20 nt, Artificial Sequence
  MKO10010482_A_Cirbp
  gRNA
ucuucugacaaccggucccg

SEQ ID NO: 10483 - RNA, 20 nt, Artificial Sequence
  MKO10010483_A_Cirbp
  gRNA
ugaaaauaucgaugacgcua

SEQ ID NO: 10484 - RNA, 20 nt, Artificial Sequence
  MKO10010484_A_Cirbp
  gRNA
cagcuaugguuaucggagcu

SEQ ID NO: 10485 - RNA, 20 nt, Artificial Sequence
  MKO10010485_A_Cirh1a
  gRNA
gcggguacccacgucgcagc

SEQ ID NO: 10486 - RNA, 20 nt, Artificial Sequence
  MKO10010486_A_Cirh1a
  gRNA
gcugcgacguggguacccgc

SEQ ID NO: 10487 - RNA, 20 nt, Artificial Sequence
  MKO10010487_A_Cirh1a
  gRNA
ggacagcggcucuuuagugc

SEQ ID NO: 10488 - RNA, 20 nt, Artificial Sequence
  MKO10010488_A_Cisd1
  gRNA
ucuugcaguugaguggaucg

SEQ ID NO: 10489 - RNA, 20 nt, Artificial Sequence
  MKO10010489_A_Cisd1
  gRNA
gggcggcucaccucgcacag

SEQ ID NO: 10490 - RNA, 20 nt, Artificial Sequence
  MKO10010490_A_Cisd1
  gRNA
agcuccaacuccgcugugcg

SEQ ID NO: 10491 - RNA, 20 nt, Artificial Sequence
  MKO10010491_A_Cisd2
  gRNA
cgaacccggugaugcugucg

SEQ ID NO: 10492 - RNA, 20 nt, Artificial Sequence
  MKO10010492_A_Cisd2
  gRNA
ccagaagcgcaaguaccccg

SEQ ID NO: 10493 - RNA, 20 nt, Artificial Sequence
  MKO10010493_A_Cisd2
  gRNA
gcagcugcaccuucacgaug

SEQ ID NO: 10494 - RNA, 20 nt, Artificial Sequence
  MKO10010494_A_Cisd3
  gRNA
auguggccgaagcaagaauc

SEQ ID NO: 10495 - RNA, 20 nt, Artificial Sequence
  MKO10010495_A_Cisd3
  gRNA
ugguugccgggaaaaccuac

SEQ ID NO: 10496 - RNA, 20 nt, Artificial Sequence
  MKO10010496_A_Cisd3
  gRNA
acaguaagggggccgcugag

SEQ ID NO: 10497 - RNA, 20 nt, Artificial Sequence
  MKO10010497_A_Cish
  gRNA
ggagguagucggccauacgc

SEQ ID NO: 10498 - RNA, 20 nt, Artificial Sequence
  MKO10010498_A_Cish
  gRNA
ggcguacucgauccgcacgu

SEQ ID NO: 10499 - RNA, 20 nt, Artificial Sequence
  MKO10010499_A_Cish
  gRNA
gagcuuaccccuguacgcaa

SEQ ID NO: 10500 - RNA, 20 nt, Artificial Sequence
  MKO10010500_A_Cited1
  gRNA
cugaaaugccaacuaugucg

SEQ ID NO: 10501 - RNA, 20 nt, Artificial Sequence
  MKO10010501_A_Cited1
  gRNA
aagcuuaauagccaguacca

SEQ ID NO: 10502 - RNA, 20 nt, Artificial Sequence
  MKO10010502_A_Cited1
  gRNA
ucuggaucgacaucuccaau

SEQ ID NO: 10503 - RNA, 20 nt, Artificial Sequence
  MKO10010503_A_Cited2
  gRNA
ugccgucggggaagcgcccg

SEQ ID NO: 10504 - RNA, 20 nt, Artificial Sequence
  MKO10010504_A_Cited2
  gRNA
cgcggggacgugagccaccg

SEQ ID NO: 10505 - RNA, 20 nt, Artificial Sequence
  MKO10010505_A_Cited2
  gRNA
ggcgugccugaugccgcucg

SEQ ID NO: 10506 - RNA, 20 nt, Artificial Sequence
  MKO10010506_A_Cited4
  gRNA
cgccucuucgucgaugagcu

SEQ ID NO: 10507 - RNA, 20 nt, Artificial Sequence
  MKO10010507_A_Cited4
  gRNA
gcuccggcagcucgcguacg

SEQ ID NO: 10508 - RNA, 20 nt, Artificial Sequence
  MKO10010508_A_Cited4
  gRNA
agaagcaaucgaacucgcuc

SEQ ID NO: 10509 - RNA, 20 nt, Artificial Sequence
  MKO10010509_A_Cit
  gRNA
acuucgaagucucucgccga

SEQ ID NO: 10510 - RNA, 20 nt, Artificial Sequence
  MKO10010510_A_Cit
  gRNA
ccgacaccauagccgaguug

SEQ ID NO: 10511 - RNA, 20 nt, Artificial Sequence
  MKO10010511_A_Cit
  gRNA
gucgcuucugaacagauacg

SEQ ID NO: 10512 - RNA, 20 nt, Artificial Sequence
  MKO10010512_A_Ciz1
  gRNA
gcacuacucaccuugcgauu

SEQ ID NO: 10513 - RNA, 20 nt, Artificial Sequence
  MKO10010513_A_Ciz1
  gRNA
gaggcuggcaccgucauacg

SEQ ID NO: 10514 - RNA, 20 nt, Artificial Sequence
  MKO10010514_A_Ciz1
  gRNA
ggaguacccaguguugccgu

SEQ ID NO: 10515 - RNA, 20 nt, Artificial Sequence
  MKO10010515_A_Ckap2l
  gRNA
gguaaacucacuuggcguug

SEQ ID NO: 10516 - RNA, 20 nt, Artificial Sequence
  MKO10010516_A_Ckap2l
  gRNA
ccaguacagcagccgcaagu

SEQ ID NO: 10517 - RNA, 20 nt, Artificial Sequence
  MKO10010517_A_Ckap2l
  gRNA
cguguagaaucugcaacugu

SEQ ID NO: 10518 - RNA, 20 nt, Artificial Sequence
  MKO10010518_A_Ckap2
  gRNA
accugugagcacugcgucga

SEQ ID NO: 10519 - RNA, 20 nt, Artificial Sequence
  MKO10010519_A_Ckap2
  gRNA
ggcccuguuucgcagcuccg

SEQ ID NO: 10520 - RNA, 20 nt, Artificial Sequence
  MKO10010520_A_Ckap2
  gRNA
augccugaaccuuauuaaug

SEQ ID NO: 10521 - RNA, 20 nt, Artificial Sequence
  MKO10010521_A_Ckap4
  gRNA
acgucauccgcgccgcccga

SEQ ID NO: 10522 - RNA, 20 nt, Artificial Sequence
  MKO10010522_A_Ckap4
  gRNA
ggaugaccugcggaacgacc

SEQ ID NO: 10523 - RNA, 20 nt, Artificial Sequence
  MKO10010523_A_Ckap4
  gRNA
aagggcgcccacccgucggg

SEQ ID NO: 10524 - RNA, 20 nt, Artificial Sequence
  MKO10010524_A_Ckap5
  gRNA
ugucacugauuccaaugcag

SEQ ID NO: 10525 - RNA, 20 nt, Artificial Sequence
  MKO10010525_A_Ckap5
  gRNA
acuauuugaaucucgagaca

SEQ ID NO: 10526 - RNA, 20 nt, Artificial Sequence
  MKO10010526_A_Ckap5
  gRNA
uguuuacagaacaacgggag

SEQ ID NO: 10527 - RNA, 20 nt, Artificial Sequence
  MKO10010527_A_Ckb
  gRNA
uucccaggguggcgaugacc

SEQ ID NO: 10528 - RNA, 20 nt, Artificial Sequence
  MKO10010528_A_Ckb
  gRNA
ccccgcaccugcagguuguc

SEQ ID NO: 10529 - RNA, 20 nt, Artificial Sequence
  MKO10010529_A_Ckb
  gRNA
ucgcgagcucagcacguagu

SEQ ID NO: 10530 - RNA, 20 nt, Artificial Sequence
  MKO10010530_A_Cklf
  gRNA
cgacggcuuacgaccggccg

SEQ ID NO: 10531 - RNA, 20 nt, Artificial Sequence
  MKO10010531_A_Cklf
  gRNA
guccacacguguauaagacu

SEQ ID NO: 10532 - RNA, 20 nt, Artificial Sequence
  MKO10010532_A_Cklf
  gRNA
uuccuagucuuauacacgug

SEQ ID NO: 10533 - RNA, 20 nt, Artificial Sequence
  MKO10010533_A_Ckmt1
  gRNA
cauauccauuaugccgcucu

SEQ ID NO: 10534 - RNA, 20 nt, Artificial Sequence
  MKO10010534_A_Ckmt1
  gRNA
gccuauaguaccguccagcc

SEQ ID NO: 10535 - RNA, 20 nt, Artificial Sequence
  MKO10010535_A_Ckmt1
  gRNA
accuggcuggacgguacuau

SEQ ID NO: 10536 - RNA, 20 nt, Artificial Sequence
  MKO10010536_A_Ckmt2
  gRNA
ucggccagugcguacccgag

SEQ ID NO: 10537 - RNA, 20 nt, Artificial Sequence
  MKO10010537_A_Ckmt2
  gRNA
ccacccggcagauuacucac

SEQ ID NO: 10538 - RNA, 20 nt, Artificial Sequence
  MKO10010538_A_Ckmt2
  gRNA
cugguccaggguauagccac

SEQ ID NO: 10539 - RNA, 20 nt, Artificial Sequence
  MKO10010539_A_Ckm
  gRNA
ccaccuccgcgugaucucca

SEQ ID NO: 10540 - RNA, 20 nt, Artificial Sequence
  MKO10010540_A_Ckm
  gRNA
ugcccuugaacucgcccguc

SEQ ID NO: 10541 - RNA, 20 nt, Artificial Sequence
  MKO10010541_A_Ckm
  gRNA
gggcuguguggccggcgaug

SEQ ID NO: 10542 - RNA, 20 nt, Artificial Sequence
  MKO10010542_A_Cks1b
  gRNA
ccugacucugcugaacgccg

SEQ ID NO: 10543 - RNA, 20 nt, Artificial Sequence
  MKO10010543_A_Cks1b
  gRNA
cacuauaugauccaugaacc

SEQ ID NO: 10544 - RNA, 20 nt, Artificial Sequence
  MKO10010544_A_Cks1b
  gRNA
cucacaucuuacuguuccga

SEQ ID NO: 10545 - RNA, 20 nt, Artificial Sequence
  MKO10010545_A_Cks2
  gRNA
cauuacaugauucaugagcc

SEQ ID NO: 10546 - RNA, 20 nt, Artificial Sequence
  MKO10010546_A_Cks2
  gRNA
cugaguaguagaucugcuug

SEQ ID NO: 10547 - RNA, 20 nt, Artificial Sequence
  MKO10010547_A_Cks2
  gRNA
ucgaugagcacuacgaguac

SEQ ID NO: 10548 - RNA, 20 nt, Artificial Sequence
  MKO10010548_A_Clasp1
  gRNA
ugccgauuugcgccuugaac

SEQ ID NO: 10549 - RNA, 20 nt, Artificial Sequence
  MKO10010549_A_Clasp1
  gRNA
ucuaugguaacgcccagcgc

SEQ ID NO: 10550 - RNA, 20 nt, Artificial Sequence
  MKO10010550_A_Clasp1
  gRNA
cgcugggcguuaccauagag

SEQ ID NO: 10551 - RNA, 20 nt, Artificial Sequence
  MKO10010551_A_Clasp2
  gRNA
aacuuaccgcauuggcacgc

SEQ ID NO: 10552 - RNA, 20 nt, Artificial Sequence
  MKO10010552_A_Clasp2
  gRNA
ucagcagguggcccuaaggu

SEQ ID NO: 10553 - RNA, 20 nt, Artificial Sequence
  MKO10010553_A_Clasp2
  gRNA
ugaggcggcugauuugcaaa

SEQ ID NO: 10554 - RNA, 20 nt, Artificial Sequence
  MKO10010554_A_Clasrp
  gRNA
cuggugcagaacgacuucgc

SEQ ID NO: 10555 - RNA, 20 nt, Artificial Sequence
  MKO10010555_A_Clasrp
  gRNA
ccgagccugcaagguucacc

SEQ ID NO: 10556 - RNA, 20 nt, Artificial Sequence
  MKO10010556_A_Clasrp
  gRNA
cgcucgucugacuccuguuc

SEQ ID NO: 10557 - RNA, 20 nt, Artificial Sequence
  MKO10010557_A_Clca1
  gRNA
uuugucauagguguuccacc

SEQ ID NO: 10558 - RNA, 20 nt, Artificial Sequence
  MKO10010558_A_Clca1
  gRNA
acugugucacaagggcgugc

SEQ ID NO: 10559 - RNA, 20 nt, Artificial Sequence
  MKO10010559_A_Clca1
  gRNA
uugucauacgauucucguuu

SEQ ID NO: 10560 - RNA, 20 nt, Artificial Sequence
  MKO10010560_A_Clca2
  gRNA
aggugcuccgccagcaucac

SEQ ID NO: 10561 - RNA, 20 nt, Artificial Sequence
  MKO10010561_A_Clca2
  gRNA
gcugugugacaagggcgugc

SEQ ID NO: 10562 - RNA, 20 nt, Artificial Sequence
  MKO10010562_A_Clca2
  gRNA
uugucguacgauucucguuu

SEQ ID NO: 10563 - RNA, 20 nt, Artificial Sequence
  MKO10010563_A_Clca3
  gRNA
aaaucaaguucgucggugcc

SEQ ID NO: 10564 - RNA, 20 nt, Artificial Sequence
  MKO10010564_A_Clca3
  gRNA
gagcccuacaccgaacauau

SEQ ID NO: 10565 - RNA, 20 nt, Artificial Sequence
  MKO10010565_A_Clca3
  gRNA
ugauggaagccuucucguuu

SEQ ID NO: 10566 - RNA, 20 nt, Artificial Sequence
  MKO10010566_A_Clca4
  gRNA
ugucgucgagaugcaaagac

SEQ ID NO: 10567 - RNA, 20 nt, Artificial Sequence
  MKO10010567_A_Clca4
  gRNA
agguguuccaccgacaucac

SEQ ID NO: 10568 - RNA, 20 nt, Artificial Sequence
  MKO10010568_A_Clca4
  gRNA
ccccacacuguccguacuga

SEQ ID NO: 10569 - RNA, 20 nt, Artificial Sequence
  MKO10010569_A_Clca5
  gRNA
guaauuaugauccguccaag

SEQ ID NO: 10570 - RNA, 20 nt, Artificial Sequence
  MKO10010570_A_Clca5
  gRNA
cucaacgaugaguuagccgc

SEQ ID NO: 10571 - RNA, 20 nt, Artificial Sequence
  MKO10010571_A_Clca5
  gRNA
uuccguccauucacguagaa

SEQ ID NO: 10572 - RNA, 20 nt, Artificial Sequence
  MKO10010572_A_Clca6
  gRNA
ucaucgcacagcugcccccu

SEQ ID NO: 10573 - RNA, 20 nt, Artificial Sequence
  MKO10010573_A_Clca6
  gRNA
auucguccccgugauaccug

SEQ ID NO: 10574 - RNA, 20 nt, Artificial Sequence
  MKO10010574_A_Clca6
  gRNA
aagacaguccccaguacagg

SEQ ID NO: 10575 - RNA, 20 nt, Artificial Sequence
  MKO10010575_A_Clcc1
  gRNA
ugucacuuagugcgucgucc

SEQ ID NO: 10576 - RNA, 20 nt, Artificial Sequence
  MKO10010576_A_Clcc1
  gRNA
cccugacucgucagaagccg

SEQ ID NO: 10577 - RNA, 20 nt, Artificial Sequence
  MKO10010577_A_Clcc1
  gRNA
guuaugcucaugaugacgac

SEQ ID NO: 10578 - RNA, 20 nt, Artificial Sequence
  MKO10010578_A_Clcf1
  gRNA
ucuccugugcgauuaagagc

SEQ ID NO: 10579 - RNA, 20 nt, Artificial Sequence
  MKO10010579_A_Clcf1
  gRNA
ugacuucaauccuccucgac

SEQ ID NO: 10580 - RNA, 20 nt, Artificial Sequence
  MKO10010580_A_Clcf1
  gRNA
cuuggcugaacgccauagcc

SEQ ID NO: 10581 - RNA, 20 nt, Artificial Sequence
  MKO10010581_A_Clcn1
  gRNA
gaaccuacccugaaggcucu

SEQ ID NO: 10582 - RNA, 20 nt, Artificial Sequence
  MKO10010582_A_Clcn1
  gRNA
gcuaggcuucaucugggcau

SEQ ID NO: 10583 - RNA, 20 nt, Artificial Sequence
  MKO10010583_A_Clcn1
  gRNA
aaggugguagcuuugacagc

SEQ ID NO: 10584 - RNA, 20 nt, Artificial Sequence
  MKO10010584_A_Clcn2
  gRNA
gcugcucguauucgccuggg

SEQ ID NO: 10585 - RNA, 20 nt, Artificial Sequence
  MKO10010585_A_Clcn2
  gRNA
gauccagucuucaccgaccc

SEQ ID NO: 10586 - RNA, 20 nt, Artificial Sequence
  MKO10010586_A_Clcn2
  gRNA
cccaaugaccuuagcuacaa

SEQ ID NO: 10587 - RNA, 20 nt, Artificial Sequence
  MKO10010587_A_Clcn3
  gRNA
cucgcacccagucaauagua

SEQ ID NO: 10588 - RNA, 20 nt, Artificial Sequence
  MKO10010588_A_Clcn3
  gRNA
auucuuacaggggcacuagc

SEQ ID NO: 10589 - RNA, 20 nt, Artificial Sequence
  MKO10010589_A_Clcn3
  gRNA
ucaucguagguaccgacacc

SEQ ID NO: 10590 - RNA, 20 nt, Artificial Sequence
  MKO10010590_A_Clcn4-2
  gRNA
cucgugcucgucguauccuc

SEQ ID NO: 10591 - RNA, 20 nt, Artificial Sequence
  MKO10010591_A_Clcn4-2
  gRNA
aucccgaccacgcguccagc

SEQ ID NO: 10592 - RNA, 20 nt, Artificial Sequence
  MKO10010592_A_Clcn4-2
  gRNA
acggugcgaacacacguacc

SEQ ID NO: 10593 - RNA, 20 nt, Artificial Sequence
  MKO10010593_A_Clcn5
  gRNA
auuacuucauguacguccuc

SEQ ID NO: 10594 - RNA, 20 nt, Artificial Sequence
  MKO10010594_A_Clcn5
  gRNA
uuaccucucggugccuaucu

SEQ ID NO: 10595 - RNA, 20 nt, Artificial Sequence
  MKO10010595_A_Clcn5
  gRNA
aggagccaaucccuggugua

SEQ ID NO: 10596 - RNA, 20 nt, Artificial Sequence
  MKO10010596_A_Clcn6
  gRNA
cagccccguacagacgccaa

SEQ ID NO: 10597 - RNA, 20 nt, Artificial Sequence
  MKO10010597_A_Clcn6
  gRNA
uggauggugguguucgccau

SEQ ID NO: 10598 - RNA, 20 nt, Artificial Sequence
  MKO10010598_A_Clcn6
  gRNA
gaaccacuccgaacuucagu

SEQ ID NO: 10599 - RNA, 20 nt, Artificial Sequence
  MKO10010599_A_Clcn7
  gRNA
cguuguucaucuguccgauu

SEQ ID NO: 10600 - RNA, 20 nt, Artificial Sequence
  MKO10010600_A_Clcn7
  gRNA
ccucaaguaccgcgucauca

SEQ ID NO: 10601 - RNA, 20 nt, Artificial Sequence
  MKO10010601_A_Clcn7
  gRNA
uaucuaggcuuuccggacag

SEQ ID NO: 10602 - RNA, 20 nt, Artificial Sequence
  MKO10010602_A_Clcnka
  gRNA
cgcgugcgcgccaaagccgu

SEQ ID NO: 10603 - RNA, 20 nt, Artificial Sequence
  MKO10010603_A_Clcnka
  gRNA
aguaccaguccucacgcgca

SEQ ID NO: 10604 - RNA, 20 nt, Artificial Sequence
  MKO10010604_A_Clcnka
  gRNA
gcggcuguuccgugcgcgug

SEQ ID NO: 10605 - RNA, 20 nt, Artificial Sequence
  MKO10010605_A_Clcnkb
  gRNA
cgcgugcgcaccaagaccgu

SEQ ID NO: 10606 - RNA, 20 nt, Artificial Sequence
  MKO10010606_A_Clcnkb
  gRNA
cgugaugaucgcugcuuacc

SEQ ID NO: 10607 - RNA, 20 nt, Artificial Sequence
  MKO10010607_A_Clcnkb
  gRNA
caggaccacuccggucaaga

SEQ ID NO: 10608 - RNA, 20 nt, Artificial Sequence
  MKO10010608_A_Cldn10
  gRNA
uacgaaggcgacgauuucca

SEQ ID NO: 10609 - RNA, 20 nt, Artificial Sequence
  MKO10010609_A_Cldn10
  gRNA
aucugcguuaccgauuccac

SEQ ID NO: 10610 - RNA, 20 nt, Artificial Sequence
  MKO10010610_A_Cldn10
  gRNA
uagaggacuaaugaucgcug

SEQ ID NO: 10611 - RNA, 20 nt, Artificial Sequence
  MKO10010611_A_Cldn11
  gRNA
ucgcuguacgcagguuggau

SEQ ID NO: 10612 - RNA, 20 nt, Artificial Sequence
  MKO10010612_A_Cldn11
  gRNA
ggguuucgucacgagcuucg

SEQ ID NO: 10613 - RNA, 20 nt, Artificial Sequence
  MKO10010613_A_Cldn11
  gRNA
gagaucaccaucgugagcuu

SEQ ID NO: 10614 - RNA, 20 nt, Artificial Sequence
  MKO10010614_A_Cldn12
  gRNA
gccugauguacgaccguacg

SEQ ID NO: 10615 - RNA, 20 nt, Artificial Sequence
  MKO10010615_A_Cldn12
  gRNA
caaccgacagguaccacgua

SEQ ID NO: 10616 - RNA, 20 nt, Artificial Sequence
  MKO10010616_A_Cldn12
  gRNA
cgguggcugcguggacaucu

SEQ ID NO: 10617 - RNA, 20 nt, Artificial Sequence
  MKO10010617_A_Cldn13
  gRNA
cuuaccuaagguaucguugu

SEQ ID NO: 10618 - RNA, 20 nt, Artificial Sequence
  MKO10010618_A_Cldn13
  gRNA
cucuuguuugcugacgacca

SEQ ID NO: 10619 - RNA, 20 nt, Artificial Sequence
  MKO10010619_A_Cldn13
  gRNA
cggggaaagucucugcauac

SEQ ID NO: 10620 - RNA, 20 nt, Artificial Sequence
  MKO10010620_A_Cldn14
  gRNA
ugggccguccuccgccagug

SEQ ID NO: 10621 - RNA, 20 nt, Artificial Sequence
  MKO10010621_A_Cldn14
  gRNA
ugaccucagccgcgcacagu

SEQ ID NO: 10622 - RNA, 20 nt, Artificial Sequence
  MKO10010622_A_Cldn14
  gRNA
cgcaggccaugcccgacaac

SEQ ID NO: 10623 - RNA, 20 nt, Artificial Sequence
  MKO10010623_A_Cldn15
  gRNA
gggacuccgcugcaccaacg

SEQ ID NO: 10624 - RNA, 20 nt, Artificial Sequence
  MKO10010624_A_Cldn15
  gRNA
gacaucagcuucgguaaaua

SEQ ID NO: 10625 - RNA, 20 nt, Artificial Sequence
  MKO10010625_A_Cldn15
  gRNA
cgggguaucacaaccguaga

SEQ ID NO: 10626 - RNA, 20 nt, Artificial Sequence
  MKO10010626_A_Cldn16
  gRNA
gcauaaggguaguuccucuc

SEQ ID NO: 10627 - RNA, 20 nt, Artificial Sequence
  MKO10010627_A_Cldn16
  gRNA
cacacagaaccgaugauucc

SEQ ID NO: 10628 - RNA, 20 nt, Artificial Sequence
  MKO10010628_A_Cldn16
  gRNA
aggaagcccuauucaacugc

SEQ ID NO: 10629 - RNA, 20 nt, Artificial Sequence
  MKO10010629_A_Cldn17
  gRNA
gcacgcgcugcuuccaguac

SEQ ID NO: 10630 - RNA, 20 nt, Artificial Sequence
  MKO10010630_A_Cldn17
  gRNA
aacuaguccagcgaucugua

SEQ ID NO: 10631 - RNA, 20 nt, Artificial Sequence
  MKO10010631_A_Cldn17
  gRNA
guaggcuuugacccucucgc

SEQ ID NO: 10632 - RNA, 20 nt, Artificial Sequence
  MKO10010632_A_Cldn18
  gRNA
uaccaaugcgaaugcacuuc

SEQ ID NO: 10633 - RNA, 20 nt, Artificial Sequence
  MKO10010633_A_Cldn18
  gRNA
accgccguguuccaguauga

SEQ ID NO: 10634 - RNA, 20 nt, Artificial Sequence
  MKO10010634_A_Cldn18
  gRNA
gaacaaugcccacgaucauc

SEQ ID NO: 10635 - RNA, 20 nt, Artificial Sequence
  MKO10010635_A_Cldn19
  gRNA
acauccacagcccuucguag

SEQ ID NO: 10636 - RNA, 20 nt, Artificial Sequence
  MKO10010636_A_Cldn19
  gRNA
gcccagccgacgaacagagc

SEQ ID NO: 10637 - RNA, 20 nt, Artificial Sequence
  MKO10010637_A_Cldn19
  gRNA
cccagcucuguucgucggcu

SEQ ID NO: 10638 - RNA, 20 nt, Artificial Sequence
  MKO10010638_A_Cldn1
  gRNA
uccugcguuucgcaaagcac

SEQ ID NO: 10639 - RNA, 20 nt, Artificial Sequence
  MKO10010639_A_Cldn1
  gRNA
uguaggucuggcgacauuag

SEQ ID NO: 10640 - RNA, 20 nt, Artificial Sequence
  MKO10010640_A_Cldn1
  gRNA
guuggcuugggauaaggccg

SEQ ID NO: 10641 - RNA, 20 nt, Artificial Sequence
  MKO10010641_A_Cldn20
  gRNA
gggauuuguacuucgauagc

SEQ ID NO: 10642 - RNA, 20 nt, Artificial Sequence
  MKO10010642_A_Cldn20
  gRNA
aaaguucgcuaugaucuccu

SEQ ID NO: 10643 - RNA, 20 nt, Artificial Sequence
  MKO10010643_A_Cldn20
  gRNA
caggcgagcacauaacuuga

SEQ ID NO: 10644 - RNA, 20 nt, Artificial Sequence
  MKO10010644_A_Cldn22
  gRNA
cagccgccugcguugccguu

SEQ ID NO: 10645 - RNA, 20 nt, Artificial Sequence
  MKO10010645_A_Cldn22
  gRNA
ugagcccgggcuuagauuuc

SEQ ID NO: 10646 - RNA, 20 nt, Artificial Sequence
  MKO10010646_A_Cldn22
  gRNA
aaugggcuuagucuuccgaa

SEQ ID NO: 10647 - RNA, 20 nt, Artificial Sequence
  MKO10010647_A_Cldn23
  gRNA
aguaguuccacucgucgggc

SEQ ID NO: 10648 - RNA, 20 nt, Artificial Sequence
  MKO10010648_A_Cldn23
  gRNA
cgccccgagcucgccgguca

SEQ ID NO: 10649 - RNA, 20 nt, Artificial Sequence
  MKO10010649_A_Cldn23
  gRNA
cagcaucagcaccgucuacg

SEQ ID NO: 10650 - RNA, 20 nt, Artificial Sequence
  MKO10010650_A_Cldn24
  gRNA
gcagccucgagucacuaugc

SEQ ID NO: 10651 - RNA, 20 nt, Artificial Sequence
  MKO10010651_A_Cldn24
  gRNA
agguaugaaccaugaucucg

SEQ ID NO: 10652 - RNA, 20 nt, Artificial Sequence
  MKO10010652_A_Cldn24
  gRNA
agaaagcccuacugauugca

SEQ ID NO: 10653 - RNA, 20 nt, Artificial Sequence
  MKO10010653_A_Cldn25
  gRNA
uggcggccgcucucuucauc

SEQ ID NO: 10654 - RNA, 20 nt, Artificial Sequence
  MKO10010654_A_Cldn25
  gRNA
gaccccggcaaccacaauag

SEQ ID NO: 10655 - RNA, 20 nt, Artificial Sequence
  MKO10010655_A_Cldn25
  gRNA
gugacucgaauaaaaucgcc

SEQ ID NO: 10656 - RNA, 20 nt, Artificial Sequence
  MKO10010656_A_Cldn26
  gRNA
cgccguugaugaacccuuuc

SEQ ID NO: 10657 - RNA, 20 nt, Artificial Sequence
  MKO10010657_A_Cldn26
  gRNA
gaucagguggauauacgcuu

SEQ ID NO: 10658 - RNA, 20 nt, Artificial Sequence
  MKO10010658_A_Cldn26
  gRNA
auacaaagcuaauccagccg

SEQ ID NO: 10659 - RNA, 20 nt, Artificial Sequence
  MKO10010659_A_Cldn2
  gRNA
auaggaacucguucgccagu

SEQ ID NO: 10660 - RNA, 20 nt, Artificial Sequence
  MKO10010660_A_Cldn2
  gRNA
gcggcgaguagaagucccga

SEQ ID NO: 10661 - RNA, 20 nt, Artificial Sequence
  MKO10010661_A_Cldn2
  gRNA
gccaaccgccgucacaaugc

SEQ ID NO: 10662 - RNA, 20 nt, Artificial Sequence
  MKO10010662_A_Cldn3
  gRNA
uauucugcgccgcgauccac

SEQ ID NO: 10663 - RNA, 20 nt, Artificial Sequence
  MKO10010663_A_Cldn3
  gRNA
uggaucgcggcgcagaauag

SEQ ID NO: 10664 - RNA, 20 nt, Artificial Sequence
  MKO10010664_A_Cldn3
  gRNA
gugggugcauacuugucgcg

SEQ ID NO: 10665 - RNA, 20 nt, Artificial Sequence
  MKO10010665_A_Cldn4
  gRNA
gggccucgcuuuacgucggc

SEQ ID NO: 10666 - RNA, 20 nt, Artificial Sequence
  MKO10010666_A_Cldn4
  gRNA
gcaggccgcccgagcccuua

SEQ ID NO: 10667 - RNA, 20 nt, Artificial Sequence
  MKO10010667_A_Cldn4
  gRNA
cgcccagccgacguaaagcg

SEQ ID NO: 10668 - RNA, 20 nt, Artificial Sequence
  MKO10010668_A_Cldn5
  gRNA
ccgucggaucauagaacucg

SEQ ID NO: 10669 - RNA, 20 nt, Artificial Sequence
  MKO10010669_A_Cldn5
  gRNA
ucaaguacucugcgccgcgg

SEQ ID NO: 10670 - RNA, 20 nt, Artificial Sequence
  MKO10010670_A_Cldn5
  gRNA
cccaggcgccgcaacacacg

SEQ ID NO: 10671 - RNA, 20 nt, Artificial Sequence
  MKO10010671_A_Cldn6
  gRNA
gaugagcaccagacgagacu

SEQ ID NO: 10672 - RNA, 20 nt, Artificial Sequence
  MKO10010672_A_Cldn6
  gRNA
auagcaggccauguaauguc

SEQ ID NO: 10673 - RNA, 20 nt, Artificial Sequence
  MKO10010673_A_Cldn6
  gRNA
cuccagccagguacacgagc

SEQ ID NO: 10674 - RNA, 20 nt, Artificial Sequence
  MKO10010674_A_Cldn7
  gRNA
gcaugaagugcacacgcugu

SEQ ID NO: 10675 - RNA, 20 nt, Artificial Sequence
  MKO10010675_A_Cldn7
  gRNA
ucucccuacagguacgaguu

SEQ ID NO: 10676 - RNA, 20 nt, Artificial Sequence
  MKO10010676_A_Cldn7
  gRNA
gaugauguugucgcccgcau

SEQ ID NO: 10677 - RNA, 20 nt, Artificial Sequence
  MKO10010677_A_Cldn8
  gRNA
uguggcccuaaagcgcgagc

SEQ ID NO: 10678 - RNA, 20 nt, Artificial Sequence
  MKO10010678_A_Cldn8
  gRNA
gaugugugcugcguccgucu

SEQ ID NO: 10679 - RNA, 20 nt, Artificial Sequence
  MKO10010679_A_Cldn8
  gRNA
acagcgcuggugcugaucgc

SEQ ID NO: 10680 - RNA, 20 nt, Artificial Sequence
  MKO10010680_A_Cldn9
  gRNA
gcccguaucguacucaccgc

SEQ ID NO: 10681 - RNA, 20 nt, Artificial Sequence
  MKO10010681_A_Cldn9
  gRNA
ccccugcggugaguacgaua

SEQ ID NO: 10682 - RNA, 20 nt, Artificial Sequence
  MKO10010682_A_Cldn9
  gRNA
cgcccagugcaccacgugug

SEQ ID NO: 10683 - RNA, 20 nt, Artificial Sequence
  MKO10010683_A_Cldnd2
  gRNA
cuuugaaguguauacggcca

SEQ ID NO: 10684 - RNA, 20 nt, Artificial Sequence
  MKO10010684_A_Cldnd2
  gRNA
agccaaccauccgaaaaagu

SEQ ID NO: 10685 - RNA, 20 nt, Artificial Sequence
  MKO10010685_A_Cldnd2
  gRNA
ggccgcauucauaggcauac

SEQ ID NO: 10686 - RNA, 20 nt, Artificial Sequence
  MKO10010686_A_Clec10a
  gRNA
ucuccucgauccuugaguuc

SEQ ID NO: 10687 - RNA, 20 nt, Artificial Sequence
  MKO10010687_A_Clec10a
  gRNA
agacgaccaccaacagcagg

SEQ ID NO: 10688 - RNA, 20 nt, Artificial Sequence
  MKO10010688_A_Clec10a
  gRNA
uguugucuaaaguggcucuc

SEQ ID NO: 10689 - RNA, 20 nt, Artificial Sequence
  MKO10010689_A_Clec11a
  gRNA
ucagcccaauggcggcgucc

SEQ ID NO: 10690 - RNA, 20 nt, Artificial Sequence
  MKO10010690_A_Clec11a
  gRNA
auugguguaggccugcaucg

SEQ ID NO: 10691 - RNA, 20 nt, Artificial Sequence
  MKO10010691_A_Clec11a
  gRNA
ccaccaagaaccgucgucug

SEQ ID NO: 10692 - RNA, 20 nt, Artificial Sequence
  MKO10010692_A_Clec12a
  gRNA
gagcuguauagcaaagaacc

SEQ ID NO: 10693 - RNA, 20 nt, Artificial Sequence
  MKO10010693_A_Clec12a
  gRNA
caaauguaaaccauguccaa

SEQ ID NO: 10694 - RNA, 20 nt, Artificial Sequence
  MKO10010694_A_Clec12a
  gRNA
uaaaaucgaaucaauugcaa

SEQ ID NO: 10695 - RNA, 20 nt, Artificial Sequence
  MKO10010695_A_Clec12b
  gRNA
ggcagcgccucgccaaagug

SEQ ID NO: 10696 - RNA, 20 nt, Artificial Sequence
  MKO10010696_A_Clec12b
  gRNA
aauuaccagaagcguggaug

SEQ ID NO: 10697 - RNA, 20 nt, Artificial Sequence
  MKO10010697_A_Clec12b
  gRNA
gaguuugaugacccucuguu

SEQ ID NO: 10698 - RNA, 20 nt, Artificial Sequence
  MKO10010698_A_Clec14a
  gRNA
acaagcugcgcgaucggccg

SEQ ID NO: 10699 - RNA, 20 nt, Artificial Sequence
  MKO10010699_A_Clec14a
  gRNA
ucgcgcagcuuguucggccu

SEQ ID NO: 10700 - RNA, 20 nt, Artificial Sequence
  MKO10010700_A_Clec14a
  gRNA
ggcuugucauagaccugacc

SEQ ID NO: 10701 - RNA, 20 nt, Artificial Sequence
  MKO10010701_A_Clec16a
  gRNA
aacggauggucuccacgagc

SEQ ID NO: 10702 - RNA, 20 nt, Artificial Sequence
  MKO10010702_A_Clec16a
  gRNA
cggacauguuuggacgcuca

SEQ ID NO: 10703 - RNA, 20 nt, Artificial Sequence
  MKO10010703_A_Clec16a
  gRNA
ccuuacagagcgaugucucg

SEQ ID NO: 10704 - RNA, 20 nt, Artificial Sequence
  MKO10010704_A_Clec18a
  gRNA
acagucgccccuuacaagaa

SEQ ID NO: 10705 - RNA, 20 nt, Artificial Sequence
  MKO10010705_A_Clec18a
  gRNA
gguggacccggcugcgcagu

SEQ ID NO: 10706 - RNA, 20 nt, Artificial Sequence
  MKO10010706_A_Clec18a
  gRNA
gagccccccugcgugauccc

SEQ ID NO: 10707 - RNA, 20 nt, Artificial Sequence
  MKO10010707_A_Clec1a
  gRNA
acucauugaaacucuacagc

SEQ ID NO: 10708 - RNA, 20 nt, Artificial Sequence
  MKO10010708_A_Clec1a
  gRNA
gaguugugaauacuucugcc

SEQ ID NO: 10709 - RNA, 20 nt, Artificial Sequence
  MKO10010709_A_Clec1a
  gRNA
gggcucucccgcaauggcag

SEQ ID NO: 10710 - RNA, 20 nt, Artificial Sequence
  MKO10010710_A_Clec1b
  gRNA
cucagcgacucugcaacaau

SEQ ID NO: 10711 - RNA, 20 nt, Artificial Sequence
  MKO10010711_A_Clec1b
  gRNA
auuacuucaguccguuggau

SEQ ID NO: 10712 - RNA, 20 nt, Artificial Sequence
  MKO10010712_A_Clec1b
  gRNA
caucacacgccaccaagaag

SEQ ID NO: 10713 - RNA, 20 nt, Artificial Sequence
  MKO10010713_A_Clec2d
  gRNA
ugcugaucccguuguuguuc

SEQ ID NO: 10714 - RNA, 20 nt, Artificial Sequence
  MKO10010714_A_Clec2d
  gRNA
cauccgaagugaauagaucc

SEQ ID NO: 10715 - RNA, 20 nt, Artificial Sequence
  MKO10010715_A_Clec2d
  gRNA
ugggcgaauguccaguuacu

SEQ ID NO: 10716 - RNA, 20 nt, Artificial Sequence
  MKO10010716_A_Clec2e
  gRNA
ugcuuuaggguucucacccg

SEQ ID NO: 10717 - RNA, 20 nt, Artificial Sequence
  MKO10010717_A_Clec2e
  gRNA
gcgcuguaagguguaguugu

SEQ ID NO: 10718 - RNA, 20 nt, Artificial Sequence
  MKO10010718_A_Clec2e
  gRNA
agcugucaaauagagcuaga

SEQ ID NO: 10719 - RNA, 20 nt, Artificial Sequence
  MKO10010719_A_Clec2f
  gRNA
gaaacgccgacaaugagacu

SEQ ID NO: 10720 - RNA, 20 nt, Artificial Sequence
  MKO10010720_A_Clec2f
  gRNA
gcacuguaacauauaguugc

SEQ ID NO: 10721 - RNA, 20 nt, Artificial Sequence
  MKO10010721_A_Clec2f
  gRNA
guagcagggacuacauaccu

SEQ ID NO: 10722 - RNA, 20 nt, Artificial Sequence
  MKO10010722_A_Clec2g
  gRNA
gaaagcucccccggaacugg

SEQ ID NO: 10723 - RNA, 20 nt, Artificial Sequence
  MKO10010723_A_Clec2g
  gRNA
cucucugugcaguccaaucc

SEQ ID NO: 10724 - RNA, 20 nt, Artificial Sequence
  MKO10010724_A_Clec2g
  gRNA
cagcauaggucuuguugauu

SEQ ID NO: 10725 - RNA, 20 nt, Artificial Sequence
  MKO10010725_A_Clec2h
  gRNA
ugcuacaccgcaugcccaag

SEQ ID NO: 10726 - RNA, 20 nt, Artificial Sequence
  MKO10010726_A_Clec2h
  gRNA
augggaauuugaugcuacgc

SEQ ID NO: 10727 - RNA, 20 nt, Artificial Sequence
  MKO10010727_A_Clec2h
  gRNA
ugauuuaggguucucacgag

SEQ ID NO: 10728 - RNA, 20 nt, Artificial Sequence
  MKO10010728_A_Clec2i
  gRNA
aaucccccuugaaucucuuu

SEQ ID NO: 10729 - RNA, 20 nt, Artificial Sequence
  MKO10010729_A_Clec2i
  gRNA
acguaacuggacauuugccc

SEQ ID NO: 10730 - RNA, 20 nt, Artificial Sequence
  MKO10010730_A_Clec2i
  gRNA
augcugcuugcucaaaaaac

SEQ ID NO: 10731 - RNA, 20 nt, Artificial Sequence
  MKO10010731_A_Clec2l
  gRNA
uggaucggccugcgcagagu

SEQ ID NO: 10732 - RNA, 20 nt, Artificial Sequence
  MKO10010732_A_Clec2l
  gRNA
ccagcgccgccucgugugua

SEQ ID NO: 10733 - RNA, 20 nt, Artificial Sequence
  MKO10010733_A_Clec2l
  gRNA
agucguccccaacucugcgc

SEQ ID NO: 10734 - RNA, 20 nt, Artificial Sequence
  MKO10010734_A_Clec3a
  gRNA
cauucgagauggguagccgu

SEQ ID NO: 10735 - RNA, 20 nt, Artificial Sequence
  MKO10010735_A_Clec3a
  gRNA
guaucgcuugcuacugcgac

SEQ ID NO: 10736 - RNA, 20 nt, Artificial Sequence
  MKO10010736_A_Clec3a
  gRNA
acccaucucgaaugaaagcc

SEQ ID NO: 10737 - RNA, 20 nt, Artificial Sequence
  MKO10010737_A_Clec3b
  gRNA
cgaguacgcgcgccacagcg

SEQ ID NO: 10738 - RNA, 20 nt, Artificial Sequence
  MKO10010738_A_Clec3b
  gRNA
gagaacugcgccgcccuguc

SEQ ID NO: 10739 - RNA, 20 nt, Artificial Sequence
  MKO10010739_A_Clec3b
  gRNA
ggugagcucaaagauguucg

SEQ ID NO: 10740 - RNA, 20 nt, Artificial Sequence
  MKO10010740_A_Clec4a1
  gRNA
cccucgugcugcuuauuaug

SEQ ID NO: 10741 - RNA, 20 nt, Artificial Sequence
  MKO10010741_A_Clec4a1
  gRNA
cccacauaauaagcagcacg

SEQ ID NO: 10742 - RNA, 20 nt, Artificial Sequence
  MKO10010742_A_Clec4a1
  gRNA
aaaaaccacucgucuguaga

SEQ ID NO: 10743 - RNA, 20 nt, Artificial Sequence
  MKO10010743_A_Clec4a2
  gRNA
cacaaaaaguguuucaccca

SEQ ID NO: 10744 - RNA, 20 nt, Artificial Sequence
  MKO10010744_A_Clec4a2
  gRNA
cggcauauaccugcucuucc

SEQ ID NO: 10745 - RNA, 20 nt, Artificial Sequence
  MKO10010745_A_Clec4a2
  gRNA
accugcaggagauucugagu

SEQ ID NO: 10746 - RNA, 20 nt, Artificial Sequence
  MKO10010746_A_Clec4a3
  gRNA
cacgugguauuaucaucgua

SEQ ID NO: 10747 - RNA, 20 nt, Artificial Sequence
  MKO10010747_A_Clec4a3
  gRNA
caaauccaggugaucaacaa

SEQ ID NO: 10748 - RNA, 20 nt, Artificial Sequence
  MKO10010748_A_Clec4a3
  gRNA
uacaaaaugggcuucacucu

SEQ ID NO: 10749 - RNA, 20 nt, Artificial Sequence
  MKO10010749_A_Clec4a4
  gRNA
cacguagcacucuuauugua

SEQ ID NO: 10750 - RNA, 20 nt, Artificial Sequence
  MKO10010750_A_Clec4a4
  gRNA
aauaaccagcacuuguguuc

SEQ ID NO: 10751 - RNA, 20 nt, Artificial Sequence
  MKO10010751_A_Clec4a4
  gRNA
cauaaaaaaugguucacuca

SEQ ID NO: 10752 - RNA, 20 nt, Artificial Sequence
  MKO10010752_A_Clec4b1
  gRNA
ucuaguggugauccauagcc

SEQ ID NO: 10753 - RNA, 20 nt, Artificial Sequence
  MKO10010753_A_Clec4b1
  gRNA
caguauguaccugcuccucc

SEQ ID NO: 10754 - RNA, 20 nt, Artificial Sequence
  MKO10010754_A_Clec4b1
  gRNA
ugacagggaaggcagucucc

SEQ ID NO: 10755 - RNA, 20 nt, Artificial Sequence
  MKO10010755_A_Clec4b2
  gRNA
agcagcagugucuagcauuc

SEQ ID NO: 10756 - RNA, 20 nt, Artificial Sequence
  MKO10010756_A_Clec4b2
  gRNA
cacguggcucuaucauugua

SEQ ID NO: 10757 - RNA, 20 nt, Artificial Sequence
  MKO10010757_A_Clec4b2
  gRNA
gaguucagauagucuucuau

SEQ ID NO: 10758 - RNA, 20 nt, Artificial Sequence
  MKO10010758_A_Clec4d
  gRNA
ggaugcacguuacucucgug

SEQ ID NO: 10759 - RNA, 20 nt, Artificial Sequence
  MKO10010759_A_Clec4d
  gRNA
aauauacucacaccgugugu

SEQ ID NO: 10760 - RNA, 20 nt, Artificial Sequence
  MKO10010760_A_Clec4d
  gRNA
gagaguaacgugcauccgag

SEQ ID NO: 10761 - RNA, 20 nt, Artificial Sequence
  MKO10010761_A_Clec4e
  gRNA
ccuggugguuaucgacacac

SEQ ID NO: 10762 - RNA, 20 nt, Artificial Sequence
  MKO10010762_A_Clec4e
  gRNA
ggaggccccggcuaucgucc

SEQ ID NO: 10763 - RNA, 20 nt, Artificial Sequence
  MKO10010763_A_Clec4e
  gRNA
ccugugugucgauaaccacc

SEQ ID NO: 10764 - RNA, 20 nt, Artificial Sequence
  MKO10010764_A_Clec4f
  gRNA
uccaguucugcgcgaucagc

SEQ ID NO: 10765 - RNA, 20 nt, Artificial Sequence
  MKO10010765_A_Clec4f
  gRNA
caggacccugcggcacgucc

SEQ ID NO: 10766 - RNA, 20 nt, Artificial Sequence
  MKO10010766_A_Clec4f
  gRNA
ugagaaguucuguacguccc

SEQ ID NO: 10767 - RNA, 20 nt, Artificial Sequence
  MKO10010767_A_Clec4g
  gRNA
uacuagggcaauugggacgu

SEQ ID NO: 10768 - RNA, 20 nt, Artificial Sequence
  MKO10010768_A_Clec4g
  gRNA
guccuuaaacuccgccagug

SEQ ID NO: 10769 - RNA, 20 nt, Artificial Sequence
  MKO10010769_A_Clec4g
  gRNA
acgcaccauuuguccucagc

SEQ ID NO: 10770 - RNA, 20 nt, Artificial Sequence
  MKO10010770_A_Clec4n
  gRNA
ucauuccagccccauuucga

SEQ ID NO: 10771 - RNA, 20 nt, Artificial Sequence
  MKO10010771_A_Clec4n
  gRNA
gguggugaucaauacugaag

SEQ ID NO: 10772 - RNA, 20 nt, Artificial Sequence
  MKO10010772_A_Clec4n
  gRNA
uuuacuggaauccuucgaaa

SEQ ID NO: 10773 - RNA, 20 nt, Artificial Sequence
  MKO10010773_A_Clec5a
  gRNA
guaguagugaucaaaguugu

SEQ ID NO: 10774 - RNA, 20 nt, Artificial Sequence
  MKO10010774_A_Clec5a
  gRNA
ucuccuucuccgaaucaccu

SEQ ID NO: 10775 - RNA, 20 nt, Artificial Sequence
  MKO10010775_A_Clec5a
  gRNA
acgaaaguaccaugccuaca

SEQ ID NO: 10776 - RNA, 20 nt, Artificial Sequence
  MKO10010776_A_Clec7a
  gRNA
auuccuaaacccacugcaau

SEQ ID NO: 10777 - RNA, 20 nt, Artificial Sequence
  MKO10010777_A_Clec7a
  gRNA
cucaccguauuaaugcauuu

SEQ ID NO: 10778 - RNA, 20 nt, Artificial Sequence
  MKO10010778_A_Clec7a
  gRNA
cuucacucugauugcgggaa

SEQ ID NO: 10779 - RNA, 20 nt, Artificial Sequence
  MKO10010779_A_Clec9a
  gRNA
guuacuaugucuuugaacgc

SEQ ID NO: 10780 - RNA, 20 nt, Artificial Sequence
  MKO10010780_A_Clec9a
  gRNA
cauuggugaaccuuacacag

SEQ ID NO: 10781 - RNA, 20 nt, Artificial Sequence
  MKO10010781_A_Clec9a
  gRNA
gcagcccuuguccacacaac

SEQ ID NO: 10782 - RNA, 20 nt, Artificial Sequence
  MKO10010782_A_Clgn
  gRNA
agcggcuauugcguggugcu

SEQ ID NO: 10783 - RNA, 20 nt, Artificial Sequence
  MKO10010783_A_Clgn
  gRNA
uauaagacaccucaaccuau

SEQ ID NO: 10784 - RNA, 20 nt, Artificial Sequence
  MKO10010784_A_Clgn
  gRNA
auuaaacugcuagcagacac

SEQ ID NO: 10785 - RNA, 20 nt, Artificial Sequence
  MKO10010785_A_Clhc1
  gRNA
cccgauuacccucagagucc

SEQ ID NO: 10786 - RNA, 20 nt, Artificial Sequence
  MKO10010786_A_Clhc1
  gRNA
cugaggguaaucggguuauc

SEQ ID NO: 10787 - RNA, 20 nt, Artificial Sequence
  MKO10010787_A_Clhc1
  gRNA
uggacgcggcggcgcugaag

SEQ ID NO: 10788 - RNA, 20 nt, Artificial Sequence
  MKO10010788_A_Clic1
  gRNA
ugcaaauauguccagucccg

SEQ ID NO: 10789 - RNA, 20 nt, Artificial Sequence
  MKO10010789_A_Clic1
  gRNA
caggaauuccucgaucuugu

SEQ ID NO: 10790 - RNA, 20 nt, Artificial Sequence
  MKO10010790_A_Clic1
  gRNA
gaacccugaguccaacaccu

SEQ ID NO: 10791 - RNA, 20 nt, Artificial Sequence
  MKO10010791_A_Clic3
  gRNA
uacgcucucgccauccucac

SEQ ID NO: 10792 - RNA, 20 nt, Artificial Sequence
  MKO10010792_A_Clic3
  gRNA
caccaucgagaaagcggcgg

SEQ ID NO: 10793 - RNA, 20 nt, Artificial Sequence
  MKO10010793_A_Clic3
  gRNA
ucccaccgccgcuuucucga

SEQ ID NO: 10794 - RNA, 20 nt, Artificial Sequence
  MKO10010794_A_Clic4
  gRNA
gccguccagaaaccgacgug

SEQ ID NO: 10795 - RNA, 20 nt, Artificial Sequence
  MKO10010795_A_Clic4
  gRNA
cgucuugacuucgcuguuga

SEQ ID NO: 10796 - RNA, 20 nt, Artificial Sequence
  MKO10010796_A_Clic4
  gRNA
ucacaaccguugaccugaaa

SEQ ID NO: 10797 - RNA, 20 nt, Artificial Sequence
  MKO10010797_A_Clic5
  gRNA
acaccgggaaucuaacaccg

SEQ ID NO: 10798 - RNA, 20 nt, Artificial Sequence
  MKO10010798_A_Clic5
  gRNA
gccagccgaucuacacaacc

SEQ ID NO: 10799 - RNA, 20 nt, Artificial Sequence
  MKO10010799_A_Clic5
  gRNA
gccagguuguguagaucggc

SEQ ID NO: 10800 - RNA, 20 nt, Artificial Sequence
  MKO10010800_A_Clic6
  gRNA
aggagaaguuaguucccccg

SEQ ID NO: 10801 - RNA, 20 nt, Artificial Sequence
  MKO10010801_A_Clic6
  gRNA
aacaucauuucccgcugagu

SEQ ID NO: 10802 - RNA, 20 nt, Artificial Sequence
  MKO10010802_A_Clic6
  gRNA
cucuucaagguacccuaagc

SEQ ID NO: 10803 - RNA, 20 nt, Artificial Sequence
  MKO10010803_A_Clint1
  gRNA
cauuuaugauuugcgauccc

SEQ ID NO: 10804 - RNA, 20 nt, Artificial Sequence
  MKO10010804_A_Clint1
  gRNA
gucucuucagacagcguugg

SEQ ID NO: 10805 - RNA, 20 nt, Artificial Sequence
  MKO10010805_A_Clint1
  gRNA
aguuugcacaggaugaugac

SEQ ID NO: 10806 - RNA, 20 nt, Artificial Sequence
  MKO10010806_A_Clip1
  gRNA
ccgcuacgcccgcaagaucu

SEQ ID NO: 10807 - RNA, 20 nt, Artificial Sequence
  MKO10010807_A_Clip1
  gRNA
ggggaaacucaguucgcacc

SEQ ID NO: 10808 - RNA, 20 nt, Artificial Sequence
  MKO10010808_A_Clip1
  gRNA
agucggucucgccaagaaag

SEQ ID NO: 10809 - RNA, 20 nt, Artificial Sequence
  MKO10010809_A_Clip2
  gRNA
cucgggcagugauacgcacu

SEQ ID NO: 10810 - RNA, 20 nt, Artificial Sequence
  MKO10010810_A_Clip2
  gRNA
ccgccccgucguucuucccg

SEQ ID NO: 10811 - RNA, 20 nt, Artificial Sequence
  MKO10010811_A_Clip2
  gRNA
ccagugggccggcguggucu

SEQ ID NO: 10812 - RNA, 20 nt, Artificial Sequence
  MKO10010812_A_Clip3
  gRNA
ugccacgugaaugaucguga

SEQ ID NO: 10813 - RNA, 20 nt, Artificial Sequence
  MKO10010813_A_Clip3
  gRNA
uguugguccagcggcugcgc

SEQ ID NO: 10814 - RNA, 20 nt, Artificial Sequence
  MKO10010814_A_Clip3
  gRNA
gcccaucacgaucauucacg

SEQ ID NO: 10815 - RNA, 20 nt, Artificial Sequence
  MKO10010815_A_Clip4
  gRNA
acgcgaguuugcggagucgc

SEQ ID NO: 10816 - RNA, 20 nt, Artificial Sequence
  MKO10010816_A_Clip4
  gRNA
cuacauuacacuugcaaguc

SEQ ID NO: 10817 - RNA, 20 nt, Artificial Sequence
  MKO10010817_A_Clip4
  gRNA
uugaugucccagagcuuauc

SEQ ID NO: 10818 - RNA, 20 nt, Artificial Sequence
  MKO10010818_A_Clk1
  gRNA
gacuacaugggcuacgagcc

SEQ ID NO: 10819 - RNA, 20 nt, Artificial Sequence
  MKO10010819_A_Clk1
  gRNA
ugaaggugcuuucggaaaag

SEQ ID NO: 10820 - RNA, 20 nt, Artificial Sequence
  MKO10010820_A_Clk1
  gRNA
gcacucauaccccgugugaa

SEQ ID NO: 10821 - RNA, 20 nt, Artificial Sequence
  MKO10010821_A_Clk2
  gRNA
cuguacgaucggcgguacug

SEQ ID NO: 10822 - RNA, 20 nt, Artificial Sequence
  MKO10010822_A_Clk2
  gRNA
ccgaucguacagccgccgau

SEQ ID NO: 10823 - RNA, 20 nt, Artificial Sequence
  MKO10010823_A_Clk2
  gRNA
cuuguagccaguccccgacg

SEQ ID NO: 10824 - RNA, 20 nt, Artificial Sequence
  MKO10010824_A_Clk3
  gRNA
uggugugccggaucggcgau

SEQ ID NO: 10825 - RNA, 20 nt, Artificial Sequence
  MKO10010825_A_Clk3
  gRNA
gacuacgauacccaucccga

SEQ ID NO: 10826 - RNA, 20 nt, Artificial Sequence
  MKO10010826_A_Clk3
  gRNA
gcaugcuugcggguacggua

SEQ ID NO: 10827 - RNA, 20 nt, Artificial Sequence
  MKO10010827_A_Clk4
  gRNA
ccuuacuuuagaugaaaucg

SEQ ID NO: 10828 - RNA, 20 nt, Artificial Sequence
  MKO10010828_A_Clk4
  gRNA
augcgacugaugacuugcac

SEQ ID NO: 10829 - RNA, 20 nt, Artificial Sequence
  MKO10010829_A_Clk4
  gRNA
cguuccagaagagccaccga

SEQ ID NO: 10830 - RNA, 20 nt, Artificial Sequence
  MKO10010830_A_Clmn
  gRNA
gcccgaugagcuccucgcgc

SEQ ID NO: 10831 - RNA, 20 nt, Artificial Sequence
  MKO10010831_A_Clmn
  gRNA
gugggacugguuccagcgcg

SEQ ID NO: 10832 - RNA, 20 nt, Artificial Sequence
  MKO10010832_A_Clmn
  gRNA
auaccagauuucgcccagag

SEQ ID NO: 10833 - RNA, 20 nt, Artificial Sequence
  MKO10010833_A_Clmp
  gRNA
uggcugcucaccgauaauga

SEQ ID NO: 10834 - RNA, 20 nt, Artificial Sequence
  MKO10010834_A_Clmp
  gRNA
ugacuuaccaauucuggauu

SEQ ID NO: 10835 - RNA, 20 nt, Artificial Sequence
  MKO10010835_A_Clmp
  gRNA
cuagcacuuucaagaugaca

SEQ ID NO: 10836 - RNA, 20 nt, Artificial Sequence
  MKO10010836_A_Cln3
  gRNA
acacuccgacuauccaaccg

SEQ ID NO: 10837 - RNA, 20 nt, Artificial Sequence
  MKO10010837_A_Cln3
  gRNA
gcgccaggaguuugaugaca

SEQ ID NO: 10838 - RNA, 20 nt, Artificial Sequence
  MKO10010838_A_Cln3
  gRNA
uggauagucggaguguccuu

SEQ ID NO: 10839 - RNA, 20 nt, Artificial Sequence
  MKO10010839_A_Cln5
  gRNA
auguggagcgcacuggcgcc

SEQ ID NO: 10840 - RNA, 20 nt, Artificial Sequence
  MKO10010840_A_Cln5
  gRNA
gagcgcucuugucaggccgg

SEQ ID NO: 10841 - RNA, 20 nt, Artificial Sequence
  MKO10010841_A_Cln5
  gRNA
gggagccgcggaugcugcgc

SEQ ID NO: 10842 - RNA, 20 nt, Artificial Sequence
  MKO10010842_A_Cln6
  gRNA
guacuacuaugacgaguacc

SEQ ID NO: 10843 - RNA, 20 nt, Artificial Sequence
  MKO10010843_A_Cln6
  gRNA
cugacauagacuauagaccg

SEQ ID NO: 10844 - RNA, 20 nt, Artificial Sequence
  MKO10010844_A_Cln6
  gRNA
cuuuggccgccccauugcca

SEQ ID NO: 10845 - RNA, 20 nt, Artificial Sequence
  MKO10010845_A_Cln8
  gRNA
acuacgcuucguggaagauu

SEQ ID NO: 10846 - RNA, 20 nt, Artificial Sequence
  MKO10010846_A_Cln8
  gRNA
gcggcgacgcgugcugucuu

SEQ ID NO: 10847 - RNA, 20 nt, Artificial Sequence
  MKO10010847_A_Cln8
  gRNA
guuaaugacggccgugagca

SEQ ID NO: 10848 - RNA, 20 nt, Artificial Sequence
  MKO10010848_A_Clnk
  gRNA
acacuuacgugauccggaag

SEQ ID NO: 10849 - RNA, 20 nt, Artificial Sequence
  MKO10010849_A_Clnk
  gRNA
uaccugcguauuccgauucc

SEQ ID NO: 10850 - RNA, 20 nt, Artificial Sequence
  MKO10010850_A_Clnk
  gRNA
ucuugcagggcggugucgag

SEQ ID NO: 10851 - RNA, 20 nt, Artificial Sequence
  MKO10010851_A_Clns1a
  gRNA
uucgggauuaggauucucac

SEQ ID NO: 10852 - RNA, 20 nt, Artificial Sequence
  MKO10010852_A_Clns1a
  gRNA
ccccaccauuaguuuacaug

SEQ ID NO: 10853 - RNA, 20 nt, Artificial Sequence
  MKO10010853_A_Clns1a
  gRNA
ucguccgagucuucauccuc

SEQ ID NO: 10854 - RNA, 20 nt, Artificial Sequence
  MKO10010854_A_Clock
  gRNA
agaugcuagugagauucgac

SEQ ID NO: 10855 - RNA, 20 nt, Artificial Sequence
  MKO10010855_A_Clock
  gRNA
uccugguaacgcgagaaaga

SEQ ID NO: 10856 - RNA, 20 nt, Artificial Sequence
  MKO10010856_A_Clock
  gRNA
uccaucuuucucgcguuacc

SEQ ID NO: 10857 - RNA, 20 nt, Artificial Sequence
  MKO10010857_A_Clp1
  gRNA
acaucuaacuccacguaagu

SEQ ID NO: 10858 - RNA, 20 nt, Artificial Sequence
  MKO10010858_A_Clp1
  gRNA
ggccucucaaucgguucagu

SEQ ID NO: 10859 - RNA, 20 nt, Artificial Sequence
  MKO10010859_A_Clp1
  gRNA
gcacgcagcgucggccuuug

SEQ ID NO: 10860 - RNA, 20 nt, Artificial Sequence
  MKO10010860_A_Clpb
  gRNA
cuugacgaugcuguagucau

SEQ ID NO: 10861 - RNA, 20 nt, Artificial Sequence
  MKO10010861_A_Clpb
  gRNA
gcgagucuuaccucucauug

SEQ ID NO: 10862 - RNA, 20 nt, Artificial Sequence
  MKO10010862_A_Clpb
  gRNA
cacugcugaacucaucccca

SEQ ID NO: 10863 - RNA, 20 nt, Artificial Sequence
  MKO10010863_A_Clpp
  gRNA
gcagugaauggcgcaugccc

SEQ ID NO: 10864 - RNA, 20 nt, Artificial Sequence
  MKO10010864_A_Clpp
  gRNA
ggaacgcaucgugugcguca

SEQ ID NO: 10865 - RNA, 20 nt, Artificial Sequence
  MKO10010865_A_Clpp
  gRNA
gcgcuuaugacauauacucg

SEQ ID NO: 10866 - RNA, 20 nt, Artificial Sequence
  MKO10010866_A_Clpsl2
  gRNA
aucaugugucccugucgauc

SEQ ID NO: 10867 - RNA, 20 nt, Artificial Sequence
  MKO10010867_A_Clpsl2
  gRNA
acaauucaagccagaucgac

SEQ ID NO: 10868 - RNA, 20 nt, Artificial Sequence
  MKO10010868_A_Clpsl2
  gRNA
ugcacccccaagucccgcau

SEQ ID NO: 10869 - RNA, 20 nt, Artificial Sequence
  MKO10010869_A_Clps
  gRNA
acuaccggugucccugugag

SEQ ID NO: 10870 - RNA, 20 nt, Artificial Sequence
  MKO10010870_A_Clps
  gRNA
gugugcaacgggcaaugccc

SEQ ID NO: 10871 - RNA, 20 nt, Artificial Sequence
  MKO10010871_A_Clps
  gRNA
aucucacugcuuggagcgcc

SEQ ID NO: 10872 - RNA, 20 nt, Artificial Sequence
  MKO10010872_A_Clptm1l
  gRNA
ccgucucucacuggcgacca

SEQ ID NO: 10873 - RNA, 20 nt, Artificial Sequence
  MKO10010873_A_Clptm1l
  gRNA
auguaccgaugcacaucugc

SEQ ID NO: 10874 - RNA, 20 nt, Artificial Sequence
  MKO10010874_A_Clptm1l
  gRNA
ucauugaccagcugagcaac

SEQ ID NO: 10875 - RNA, 20 nt, Artificial Sequence
  MKO10010875_A_Clptm1
  gRNA
agguuucggcuggcgacacg

SEQ ID NO: 10876 - RNA, 20 nt, Artificial Sequence
  MKO10010876_A_Clptm1
  gRNA
aucagcagcugguuccgccg

SEQ ID NO: 10877 - RNA, 20 nt, Artificial Sequence
  MKO10010877_A_Clptm1
  gRNA
caguggcaagccggcgguac

SEQ ID NO: 10878 - RNA, 20 nt, Artificial Sequence
  MKO10010878_A_Clpx
  gRNA
uacuucguuaccucucugcg

SEQ ID NO: 10879 - RNA, 20 nt, Artificial Sequence
  MKO10010879_A_Clpx
  gRNA
ggggacgaccuuggacgcuc

SEQ ID NO: 10880 - RNA, 20 nt, Artificial Sequence
  MKO10010880_A_Clpx
  gRNA
uucacacuuaacaaaacgcg

SEQ ID NO: 10881 - RNA, 20 nt, Artificial Sequence
  MKO10010881_A_Clrn1
  gRNA
gcucugcuugucaacgcguc

SEQ ID NO: 10882 - RNA, 20 nt, Artificial Sequence
  MKO10010882_A_Clrn1
  gRNA
gaaauccagcaagucguauc

SEQ ID NO: 10883 - RNA, 20 nt, Artificial Sequence
  MKO10010883_A_Clrn1
  gRNA
auugccuuacgccuucuccg

SEQ ID NO: 10884 - RNA, 20 nt, Artificial Sequence
  MKO10010884_A_Clrn2
  gRNA
acaaagcgacgaugaucaga

SEQ ID NO: 10885 - RNA, 20 nt, Artificial Sequence
  MKO10010885_A_Clrn2
  gRNA
ugccuuuggaauguccucgc

SEQ ID NO: 10886 - RNA, 20 nt, Artificial Sequence
  MKO10010886_A_Clrn2
  gRNA
aguuggcgauccuuucuguc

SEQ ID NO: 10887 - RNA, 20 nt, Artificial Sequence
  MKO10010887_A_Clrn3
  gRNA
aaaacgaguauccguaagug

SEQ ID NO: 10888 - RNA, 20 nt, Artificial Sequence
  MKO10010888_A_Clrn3
  gRNA
ccaugccugagucgcaagaa

SEQ ID NO: 10889 - RNA, 20 nt, Artificial Sequence
  MKO10010889_A_Clrn3
  gRNA
acucuugagcacucguacca

SEQ ID NO: 10890 - RNA, 20 nt, Artificial Sequence
  MKO10010890_A_Clspn
  gRNA
caccuacgacgacagcgcag

SEQ ID NO: 10891 - RNA, 20 nt, Artificial Sequence
  MKO10010891_A_Clspn
  gRNA
guccucugcgcugucgucgu

SEQ ID NO: 10892 - RNA, 20 nt, Artificial Sequence
  MKO10010892_A_Clspn
  gRNA
aagagucguuagagucaaua

SEQ ID NO: 10893 - RNA, 20 nt, Artificial Sequence
  MKO10010893_A_Clstn1
  gRNA
cgaguacgcccccguguuca

SEQ ID NO: 10894 - RNA, 20 nt, Artificial Sequence
  MKO10010894_A_Clstn1
  gRNA
gaagucguacaaggcggccg

SEQ ID NO: 10895 - RNA, 20 nt, Artificial Sequence
  MKO10010895_A_Clstn1
  gRNA
ggggcccuucccgcagucgu

SEQ ID NO: 10896 - RNA, 20 nt, Artificial Sequence
  MKO10010896_A_Clstn2
  gRNA
gaucuugcccuccgugacga

SEQ ID NO: 10897 - RNA, 20 nt, Artificial Sequence
  MKO10010897_A_Clstn2
  gRNA
ugauacgaugucucgaucca

SEQ ID NO: 10898 - RNA, 20 nt, Artificial Sequence
  MKO10010898_A_Clstn2
  gRNA
uggacagaaacccgccgcuc

SEQ ID NO: 10899 - RNA, 20 nt, Artificial Sequence
  MKO10010899_A_Clstn3
  gRNA
guaugaucggaucuuacgug

SEQ ID NO: 10900 - RNA, 20 nt, Artificial Sequence
  MKO10010900_A_Clstn3
  gRNA
caguuaccugcauagcgcag

SEQ ID NO: 10901 - RNA, 20 nt, Artificial Sequence
  MKO10010901_A_Clstn3
  gRNA
gcagggcaaccgugcauguu

SEQ ID NO: 10902 - RNA, 20 nt, Artificial Sequence
  MKO10010902_A_Clua
  gRNA
uggccccgcucuaggaaacg

SEQ ID NO: 10903 - RNA, 20 nt, Artificial Sequence
  MKO10010903_A_Clua
  gRNA
cgcggccgggucuucuucgc

SEQ ID NO: 10904 - RNA, 20 nt, Artificial Sequence
  MKO10010904_A_Clua
  gRNA
agccugaaaguauccguaag

SEQ ID NO: 10905 - RNA, 20 nt, Artificial Sequence
  MKO10010905_A_Cltb
  gRNA
aucgcagcguagccaucggc

SEQ ID NO: 10906 - RNA, 20 nt, Artificial Sequence
  MKO10010906_A_Cltb
  gRNA
agaugugucccgccugcgcu

SEQ ID NO: 10907 - RNA, 20 nt, Artificial Sequence
  MKO10010907_A_Cltb
  gRNA
uggcuacgcugcgauugccc

SEQ ID NO: 10908 - RNA, 20 nt, Artificial Sequence
  MKO10010908_A_Cluc
  gRNA
gaucgucauucuagccucgc

SEQ ID NO: 10909 - RNA, 20 nt, Artificial Sequence
  MKO10010909_A_Cluc
  gRNA
ucauaucaaugauuaccacc

SEQ ID NO: 10910 - RNA, 20 nt, Artificial Sequence
  MKO10010910_A_Cluc
  gRNA
ugaugaucuggcauccugcg

SEQ ID NO: 10911 - RNA, 20 nt, Artificial Sequence
  MKO10010911_A_Cluap1
  gRNA
guacccacgccauauuucua

SEQ ID NO: 10912 - RNA, 20 nt, Artificial Sequence
  MKO10010912_A_Cluap1
  gRNA
aauuuccgcacacccaacuu

SEQ ID NO: 10913 - RNA, 20 nt, Artificial Sequence
  MKO10010913_A_Cluap1
  gRNA
aagaagcucuaucaagcuga

SEQ ID NO: 10914 - RNA, 20 nt, Artificial Sequence
  MKO10010914_A_Cluh
  gRNA
cgggccucacgcaccgugua

SEQ ID NO: 10915 - RNA, 20 nt, Artificial Sequence
  MKO10010915_A_Cluh
  gRNA
gggcucggugcuccgaguug

SEQ ID NO: 10916 - RNA, 20 nt, Artificial Sequence
  MKO10010916_A_Cluh
  gRNA
cuccccggcaggauauacuc

SEQ ID NO: 10917 - RNA, 20 nt, Artificial Sequence
  MKO10010917_A_Clu
  gRNA
ggagauucagaacgccgucc

SEQ ID NO: 10918 - RNA, 20 nt, Artificial Sequence
  MKO10010918_A_Clu
  gRNA
cugcggaccaagcgggacuu

SEQ ID NO: 10919 - RNA, 20 nt, Artificial Sequence
  MKO10010919_A_Clu
  gRNA
ccucuuaagaaauccacguc

SEQ ID NO: 10920 - RNA, 20 nt, Artificial Sequence
  MKO10010920_A_Clvs1
  gRNA
ggaacucgggguguauuagc

SEQ ID NO: 10921 - RNA, 20 nt, Artificial Sequence
  MKO10010921_A_Clvs1
  gRNA
ggcacggaggauguccguga

SEQ ID NO: 10922 - RNA, 20 nt, Artificial Sequence
  MKO10010922_A_Clvs1
  gRNA
gcccaaguccccaugucgua

SEQ ID NO: 10923 - RNA, 20 nt, Artificial Sequence
  MKO10010923_A_Clvs2
  gRNA
auugcaagucgcagcauguu

SEQ ID NO: 10924 - RNA, 20 nt, Artificial Sequence
  MKO10010924_A_Clvs2
  gRNA
cccuacagcacugaaacgaa

SEQ ID NO: 10925 - RNA, 20 nt, Artificial Sequence
  MKO10010925_A_Clvs2
  gRNA
augcugcgacuugcaauuga

SEQ ID NO: 10926 - RNA, 20 nt, Artificial Sequence
  MKO10010926_A_Clybl
  gRNA
uggucuggcugaagucgacc

SEQ ID NO: 10927 - RNA, 20 nt, Artificial Sequence
  MKO10010927_A_Clybl
  gRNA
gaaaguagauugugccgugc

SEQ ID NO: 10928 - RNA, 20 nt, Artificial Sequence
  MKO10010928_A_Clybl
  gRNA
cuuacccaucggauuucuuc

SEQ ID NO: 10929 - RNA, 20 nt, Artificial Sequence
  MKO10010929_A_Cma1
  gRNA
cuuugcauuccgauguacau

SEQ ID NO: 10930 - RNA, 20 nt, Artificial Sequence
  MKO10010930_A_Cma1
  gRNA
ccacgacaucaugcuacuga

SEQ ID NO: 10931 - RNA, 20 nt, Artificial Sequence
  MKO10010931_A_Cma1
  gRNA
aggucuauaacaguccuccu

SEQ ID NO: 10932 - RNA, 20 nt, Artificial Sequence
  MKO10010932_A_Cma2
  gRNA
ccuaugugaauaccuucaga

SEQ ID NO: 10933 - RNA, 20 nt, Artificial Sequence
  MKO10010933_A_Cma2
  gRNA
uaucucacguacccugagag

SEQ ID NO: 10934 - RNA, 20 nt, Artificial Sequence
  MKO10010934_A_Cma2
  gRNA
cacauaaccuuuccuucuga

SEQ ID NO: 10935 - RNA, 20 nt, Artificial Sequence
  MKO10010935_A_Cmah
  gRNA
ccucgaugucuuucaugaac

SEQ ID NO: 10936 - RNA, 20 nt, Artificial Sequence
  MKO10010936_A_Cmah
  gRNA
uacaugagccuccaucugac

SEQ ID NO: 10937 - RNA, 20 nt, Artificial Sequence
  MKO10010937_A_Cmah
  gRNA
ucgucuugacagaagcuccc

SEQ ID NO: 10938 - RNA, 20 nt, Artificial Sequence
  MKO10010938_A_Cmas
  gRNA
ccaucccagucuugucgacg

SEQ ID NO: 10939 - RNA, 20 nt, Artificial Sequence
  MKO10010939_A_Cmas
  gRNA
auaucgacguggacaucgau

SEQ ID NO: 10940 - RNA, 20 nt, Artificial Sequence
  MKO10010940_A_Cmas
  gRNA
uucuacaauggcgucuagug

SEQ ID NO: 10941 - RNA, 20 nt, Artificial Sequence
  MKO10010941_A_Cmbl
  gRNA
ugcugacaagcccuacaucg

SEQ ID NO: 10942 - RNA, 20 nt, Artificial Sequence
  MKO10010942_A_Cmbl
  gRNA
gacacccccgcccugauguc

SEQ ID NO: 10943 - RNA, 20 nt, Artificial Sequence
  MKO10010943_A_Cmbl
  gRNA
acugguccaccuuccccgcg

SEQ ID NO: 10944 - RNA, 20 nt, Artificial Sequence
  MKO10010944_A_Cmc1
  gRNA
gagauggcgcuggaccccgc

SEQ ID NO: 10945 - RNA, 20 nt, Artificial Sequence
  MKO10010945_A_Cmc1
  gRNA
aggugcuccgaacaaguuga

SEQ ID NO: 10946 - RNA, 20 nt, Artificial Sequence
  MKO10010946_A_Cmc1
  gRNA
cccagaguccuugcaacauc

SEQ ID NO: 10947 - RNA, 20 nt, Artificial Sequence
  MKO10010947_A_Cmc2
  gRNA
ccauugcaacgaccucgacc

SEQ ID NO: 10948 - RNA, 20 nt, Artificial Sequence
  MKO10010948_A_Cmc2
  gRNA
gucagaaagccuccgucgca

SEQ ID NO: 10949 - RNA, 20 nt, Artificial Sequence
  MKO10010949_A_Cmc2
  gRNA
cguccugauuaaccugcuaa

SEQ ID NO: 10950 - RNA, 20 nt, Artificial Sequence
  MKO10010950_A_Cmip
  gRNA
cagcggcugaacgucuucaa

SEQ ID NO: 10951 - RNA, 20 nt, Artificial Sequence
  MKO10010951_A_Cmip
  gRNA
uguuuacagcucacgauccc

SEQ ID NO: 10952 - RNA, 20 nt, Artificial Sequence
  MKO10010952_A_Cmip
  gRNA
uucuaucaaccaggcuccgc

SEQ ID NO: 10953 - RNA, 20 nt, Artificial Sequence
  MKO10010953_A_Cmklr1
  gRNA
uacgacgcuuacaacgacuc

SEQ ID NO: 10954 - RNA, 20 nt, Artificial Sequence
  MKO10010954_A_Cmklr1
  gRNA
gccgaugcacaucaccuacg

SEQ ID NO: 10955 - RNA, 20 nt, Artificial Sequence
  MKO10010955_A_Cmklr1
  gRNA
acaugaccugcucggccguc

SEQ ID NO: 10956 - RNA, 20 nt, Artificial Sequence
  MKO10010956_A_Cml1
  gRNA
cagcauaagcaugugccgaa

SEQ ID NO: 10957 - RNA, 20 nt, Artificial Sequence
  MKO10010957_A_Cml1
  gRNA
aguacuucaugaguauauuc

SEQ ID NO: 10958 - RNA, 20 nt, Artificial Sequence
  MKO10010958_A_Cml1
  gRNA
aauguacuccuccaugcccu

SEQ ID NO: 10959 - RNA, 20 nt, Artificial Sequence
  MKO10010959_A_Cml2
  gRNA
ggaggcagacaucaauacua

SEQ ID NO: 10960 - RNA, 20 nt, Artificial Sequence
  MKO10010960_A_Cml2
  gRNA
aacccuggucccgagcaaac

SEQ ID NO: 10961 - RNA, 20 nt, Artificial Sequence
  MKO10010961_A_Cml2
  gRNA
aauaagcuccuucaugccgc

SEQ ID NO: 10962 - RNA, 20 nt, Artificial Sequence
  MKO10010962_A_Cml3
  gRNA
uuaucauauccgaaaauacc

SEQ ID NO: 10963 - RNA, 20 nt, Artificial Sequence
  MKO10010963_A_Cml3
  gRNA
gaucacagguccccuuccca

SEQ ID NO: 10964 - RNA, 20 nt, Artificial Sequence
  MKO10010964_A_Cml3
  gRNA
gguggcugcucggccaguga

SEQ ID NO: 10965 - RNA, 20 nt, Artificial Sequence
  MKO10010965_A_Cml5
  gRNA
cuuccaguuugcacgagacc

SEQ ID NO: 10966 - RNA, 20 nt, Artificial Sequence
  MKO10010966_A_Cml5
  gRNA
aagugcuauaacccucuaug

SEQ ID NO: 10967 - RNA, 20 nt, Artificial Sequence
  MKO10010967_A_Cml5
  gRNA
ccuugccggacagcccuuca

SEQ ID NO: 10968 - RNA, 20 nt, Artificial Sequence
  MKO10010968_A_Cmpk1
  gRNA
guauugaacgaugucuugaa

SEQ ID NO: 10969 - RNA, 20 nt, Artificial Sequence
  MKO10010969_A_Cmpk1
  gRNA
aguucaccauacugugaguc

SEQ ID NO: 10970 - RNA, 20 nt, Artificial Sequence
  MKO10010970_A_Cmpk1
  gRNA
aagaauccagacucacagua

SEQ ID NO: 10971 - RNA, 20 nt, Artificial Sequence
  MKO10010971_A_Cmpk2
  gRNA
ggaaaugacguaccagcgua

SEQ ID NO: 10972 - RNA, 20 nt, Artificial Sequence
  MKO10010972_A_Cmpk2
  gRNA
ucaaguacugcccgggcuuc

SEQ ID NO: 10973 - RNA, 20 nt, Artificial Sequence
  MKO10010973_A_Cmpk2
  gRNA
caccccccuguaucagccag

SEQ ID NO: 10974 - RNA, 20 nt, Artificial Sequence
  MKO10010974_A_Cmss1
  gRNA
ccccuuucagagcaaucagg

SEQ ID NO: 10975 - RNA, 20 nt, Artificial Sequence
  MKO10010975_A_Cmss1
  gRNA
uuagaagaacugcaccuacc

SEQ ID NO: 10976 - RNA, 20 nt, Artificial Sequence
  MKO10010976_A_Cmss1
  gRNA
gagacugugagucaaaucau

SEQ ID NO: 10977 - RNA, 20 nt, Artificial Sequence
  MKO10010977_A_Cmtm1
  gRNA
ugacguguacuaaaggucgc

SEQ ID NO: 10978 - RNA, 20 nt, Artificial Sequence
  MKO10010978_A_Cmtm1
  gRNA
uuauacgugcuauaccaucc

SEQ ID NO: 10979 - RNA, 20 nt, Artificial Sequence
  MKO10010979_A_Cmtm1
  gRNA
acaaaggaucuaugcuacgc

SEQ ID NO: 10980 - RNA, 20 nt, Artificial Sequence
  MKO10010980_A_Cmtm2a
  gRNA
agaucgcagcagcgcccaug

SEQ ID NO: 10981 - RNA, 20 nt, Artificial Sequence
  MKO10010981_A_Cmtm2a
  gRNA
aaagcccuacuuaacugcua

SEQ ID NO: 10982 - RNA, 20 nt, Artificial Sequence
  MKO10010982_A_Cmtm2a
  gRNA
ugaaacaaugcucccacauc

SEQ ID NO: 10983 - RNA, 20 nt, Artificial Sequence
  MKO10010983_A_Cmtm2b
  gRNA
uugccagugcccuacuuaac

SEQ ID NO: 10984 - RNA, 20 nt, Artificial Sequence
  MKO10010984_A_Cmtm2b
  gRNA
ucgcggcgcgggcgcugcca

SEQ ID NO: 10985 - RNA, 20 nt, Artificial Sequence
  MKO10010985_A_Cmtm2b
  gRNA
cuagauccucauggguguua

SEQ ID NO: 10986 - RNA, 20 nt, Artificial Sequence
  MKO10010986_A_Cmtm3
  gRNA
gcugucgccaaauacucaga

SEQ ID NO: 10987 - RNA, 20 nt, Artificial Sequence
  MKO10010987_A_Cmtm3
  gRNA
gucaauugcgaacacaauug

SEQ ID NO: 10988 - RNA, 20 nt, Artificial Sequence
  MKO10010988_A_Cmtm3
  gRNA
ggacaccacguagcagauga

SEQ ID NO: 10989 - RNA, 20 nt, Artificial Sequence
  MKO10010989_A_Cmtm4
  gRNA
cuuuaucgccucaaucgugu

SEQ ID NO: 10990 - RNA, 20 nt, Artificial Sequence
  MKO10010990_A_Cmtm4
  gRNA
agcgcgccgcgcagguaguc

SEQ ID NO: 10991 - RNA, 20 nt, Artificial Sequence
  MKO10010991_A_Cmtm4
  gRNA
ugcgacccggacuaccugcg

SEQ ID NO: 10992 - RNA, 20 nt, Artificial Sequence
  MKO10010992_A_Cmtm5
  gRNA
aguugagccuaucgaagcgc

SEQ ID NO: 10993 - RNA, 20 nt, Artificial Sequence
  MKO10010993_A_Cmtm5
  gRNA
aguacuaccagcgcuucgau

SEQ ID NO: 10994 - RNA, 20 nt, Artificial Sequence
  MKO10010994_A_Cmtm5
  gRNA
guagaucuugaaugcaucau

SEQ ID NO: 10995 - RNA, 20 nt, Artificial Sequence
  MKO10010995_A_Cmtm6
  gRNA
ccuggccgccuacuucgucc

SEQ ID NO: 10996 - RNA, 20 nt, Artificial Sequence
  MKO10010996_A_Cmtm6
  gRNA
aaagcccgagaacaacgcaa

SEQ ID NO: 10997 - RNA, 20 nt, Artificial Sequence
  MKO10010997_A_Cmtm6
  gRNA
acuggcaggggugcgcgcag

SEQ ID NO: 10998 - RNA, 20 nt, Artificial Sequence
  MKO10010998_A_Cmtm7
  gRNA
cggguguacccgcucaccca

SEQ ID NO: 10999 - RNA, 20 nt, Artificial Sequence
  MKO10010999_A_Cmtm7
  gRNA
ucgcgcgaugucucauggau

SEQ ID NO: 11000 - RNA, 20 nt, Artificial Sequence
  MKO10011000_A_Cmtm7
  gRNA
agcuccguuccgaucgacua

SEQ ID NO: 11001 - RNA, 20 nt, Artificial Sequence
  MKO10011001_A_Cmtm8
  gRNA
uuacgaucucggcuacgauc

SEQ ID NO: 11002 - RNA, 20 nt, Artificial Sequence
  MKO10011002_A_Cmtm8
  gRNA
agaguuccuccguaccccgc

SEQ ID NO: 11003 - RNA, 20 nt, Artificial Sequence
  MKO10011003_A_Cmtm8
  gRNA
gacagaagaugcguccacua

SEQ ID NO: 11004 - RNA, 20 nt, Artificial Sequence
  MKO10011004_A_Cmtr1
  gRNA
accacgucgaccuuucugau

SEQ ID NO: 11005 - RNA, 20 nt, Artificial Sequence
  MKO10011005_A_Cmtr1
  gRNA
augagugacuggauggucgu

SEQ ID NO: 11006 - RNA, 20 nt, Artificial Sequence
  MKO10011006_A_Cmtr1
  gRNA
ugguuugggucugacgcugc

SEQ ID NO: 11007 - RNA, 20 nt, Artificial Sequence
  MKO10011007_A_Cmtr2
  gRNA
aacacucuucgugucgcuca

SEQ ID NO: 11008 - RNA, 20 nt, Artificial Sequence
  MKO10011008_A_Cmtr2
  gRNA
ucuccagaugcccgcgccac

SEQ ID NO: 11009 - RNA, 20 nt, Artificial Sequence
  MKO10011009_A_Cmtr2
  gRNA
cuucuaagacuugccacgac

SEQ ID NO: 11010 - RNA, 20 nt, Artificial Sequence
  MKO10011010_A_Cmya5
  gRNA
agccagacgaauuacuaccu

SEQ ID NO: 11011 - RNA, 20 nt, Artificial Sequence
  MKO10011011_A_Cmya5
  gRNA
ugaacguaucacuuuguccg

SEQ ID NO: 11012 - RNA, 20 nt, Artificial Sequence
  MKO10011012_A_Cmya5
  gRNA
ccuagagacuauugugagag

SEQ ID NO: 11013 - RNA, 20 nt, Artificial Sequence
  MKO10011013_A_Cnbd2
  gRNA
guguguaagauguuccguca

SEQ ID NO: 11014 - RNA, 20 nt, Artificial Sequence
  MKO10011014_A_Cnbd2
  gRNA
ugaugaugucuaugacgagc

SEQ ID NO: 11015 - RNA, 20 nt, Artificial Sequence
  MKO10011015_A_Cnbd2
  gRNA
ccuuucaaagcguaugaccu

SEQ ID NO: 11016 - RNA, 20 nt, Artificial Sequence
  MKO10011016_A_Cnbp
  gRNA
agcacuucugcucauccgcg

SEQ ID NO: 11017 - RNA, 20 nt, Artificial Sequence
  MKO10011017_A_Cnbp
  gRNA
gacaaaaauaccucuauccg

SEQ ID NO: 11018 - RNA, 20 nt, Artificial Sequence
  MKO10011018_A_Cnbp
  gRNA
uauucaaaaagacugcacca

SEQ ID NO: 11019 - RNA, 20 nt, Artificial Sequence
  MKO10011019_A_Cndp1
  gRNA
agaagccgguuccaucgccc

SEQ ID NO: 11020 - RNA, 20 nt, Artificial Sequence
  MKO10011020_A_Cndp1
  gRNA
cacccgucguccuucugagc

SEQ ID NO: 11021 - RNA, 20 nt, Artificial Sequence
  MKO10011021_A_Cndp1
  gRNA
ccgggggaacugcuacuuca

SEQ ID NO: 11022 - RNA, 20 nt, Artificial Sequence
  MKO10011022_A_Cndp2
  gRNA
cacuggccccuuaucguccg

SEQ ID NO: 11023 - RNA, 20 nt, Artificial Sequence
  MKO10011023_A_Cndp2
  gRNA
gagaggcuccacggacgaua

SEQ ID NO: 11024 - RNA, 20 nt, Artificial Sequence
  MKO10011024_A_Cndp2
  gRNA
aauaagccguguaucacgua

SEQ ID NO: 11025 - RNA, 20 nt, Artificial Sequence
  MKO10011025_A_Cnep1r1
  gRNA
uauagcugcucgaugucgaa

SEQ ID NO: 11026 - RNA, 20 nt, Artificial Sequence
  MKO10011026_A_Cnep1r1
  gRNA
auuagcuguauaacucuaau

SEQ ID NO: 11027 - RNA, 20 nt, Artificial Sequence
  MKO10011027_A_Cnep1r1
  gRNA
cuuacuucuccaacguccag

SEQ ID NO: 11028 - RNA, 20 nt, Artificial Sequence
  MKO10011028_A_Cnfn
  gRNA
cacuuucgccccgcugugcc

SEQ ID NO: 11029 - RNA, 20 nt, Artificial Sequence
  MKO10011029_A_Cnfn
  gRNA
guucccgcgccaucugacag

SEQ ID NO: 11030 - RNA, 20 nt, Artificial Sequence
  MKO10011030_A_Cnfn
  gRNA
gcccugcgcccucugucaga

SEQ ID NO: 11031 - RNA, 20 nt, Artificial Sequence
  MKO10011031_A_Cnga1
  gRNA
uuagaagcaacucguacaaa

SEQ ID NO: 11032 - RNA, 20 nt, Artificial Sequence
  MKO10011032_A_Cnga1
  gRNA
gccauugucaucgucagaaa

SEQ ID NO: 11033 - RNA, 20 nt, Artificial Sequence
  MKO10011033_A_Cnga1
  gRNA
uugaaaagagccauaguacc

SEQ ID NO: 11034 - RNA, 20 nt, Artificial Sequence
  MKO10011034_A_Cnga2
  gRNA
cuggagacugguauuaccgu

SEQ ID NO: 11035 - RNA, 20 nt, Artificial Sequence
  MKO10011035_A_Cnga2
  gRNA
uccuuccuagagcguuuccg

SEQ ID NO: 11036 - RNA, 20 nt, Artificial Sequence
  MKO10011036_A_Cnga2
  gRNA
cugugcgcagccgaaugaug

SEQ ID NO: 11037 - RNA, 20 nt, Artificial Sequence
  MKO10011037_A_Cnga3
  gRNA
gagucgugcauacuccggcu

SEQ ID NO: 11038 - RNA, 20 nt, Artificial Sequence
  MKO10011038_A_Cnga3
  gRNA
ucaucaucucgauucgugcg

SEQ ID NO: 11039 - RNA, 20 nt, Artificial Sequence
  MKO10011039_A_Cnga3
  gRNA
uaucuacccuggccgcgacu

SEQ ID NO: 11040 - RNA, 20 nt, Artificial Sequence
  MKO10011040_A_Cnga4
  gRNA
uugcggcauacguauucgcc

SEQ ID NO: 11041 - RNA, 20 nt, Artificial Sequence
  MKO10011041_A_Cnga4
  gRNA
ccagucgcuauguacgcacc

SEQ ID NO: 11042 - RNA, 20 nt, Artificial Sequence
  MKO10011042_A_Cnga4
  gRNA
uggagcggcgcguuauugac

SEQ ID NO: 11043 - RNA, 20 nt, Artificial Sequence
  MKO10011043_A_Cngb1
  gRNA
cggagagcgagacccagauc

SEQ ID NO: 11044 - RNA, 20 nt, Artificial Sequence
  MKO10011044_A_Cngb1
  gRNA
ccagaaccagcucaacaucc

SEQ ID NO: 11045 - RNA, 20 nt, Artificial Sequence
  MKO10011045_A_Cngb1
  gRNA
gaugugguaccuguucaccu

SEQ ID NO: 11046 - RNA, 20 nt, Artificial Sequence
  MKO10011046_A_Cngb3
  gRNA
ugaguucugcucgacauuca

SEQ ID NO: 11047 - RNA, 20 nt, Artificial Sequence
  MKO10011047_A_Cngb3
  gRNA
ugcccaccuacacaaccuag

SEQ ID NO: 11048 - RNA, 20 nt, Artificial Sequence
  MKO10011048_A_Cngb3
  gRNA
uuucacgcauucuuuccacu

SEQ ID NO: 11049 - RNA, 20 nt, Artificial Sequence
  MKO10011049_A_Cnih1
  gRNA
acaugacacagaagaacgcg

SEQ ID NO: 11050 - RNA, 20 nt, Artificial Sequence
  MKO10011050_A_Cnih1
  gRNA
ucgucgggucauagaggcca

SEQ ID NO: 11051 - RNA, 20 nt, Artificial Sequence
  MKO10011051_A_Cnih1
  gRNA
gguaguaaaaaaacgcuaga

SEQ ID NO: 11052 - RNA, 20 nt, Artificial Sequence
  MKO10011052_A_Cnih2
  gRNA
guaucacuuacugcccgcgc

SEQ ID NO: 11053 - RNA, 20 nt, Artificial Sequence
  MKO10011053_A_Cnih2
  gRNA
cuucaagaaccccaucgacc

SEQ ID NO: 11054 - RNA, 20 nt, Artificial Sequence
  MKO10011054_A_Cnih2
  gRNA
guagaaggcgaguuugcacc

SEQ ID NO: 11055 - RNA, 20 nt, Artificial Sequence
  MKO10011055_A_Cnih3
  gRNA
cugccacuuaccgcaugaac

SEQ ID NO: 11056 - RNA, 20 nt, Artificial Sequence
  MKO10011056_A_Cnih3
  gRNA
auccguucuuagcucgucaa

SEQ ID NO: 11057 - RNA, 20 nt, Artificial Sequence
  MKO10011057_A_Cnih3
  gRNA
ugagccacuccugagcgcac

SEQ ID NO: 11058 - RNA, 20 nt, Artificial Sequence
  MKO10011058_A_Cnih4
  gRNA
ucaacuuaccugucgccacg

SEQ ID NO: 11059 - RNA, 20 nt, Artificial Sequence
  MKO10011059_A_Cnih4
  gRNA
uuaccuauauauauuccacg

SEQ ID NO: 11060 - RNA, 20 nt, Artificial Sequence
  MKO10011060_A_Cnih4
  gRNA
aauacucccauguugccacu

SEQ ID NO: 11061 - RNA, 20 nt, Artificial Sequence
  MKO10011061_A_Cnksr1
  gRNA
aguacccguugagccaagag

SEQ ID NO: 11062 - RNA, 20 nt, Artificial Sequence
  MKO10011062_A_Cnksr1
  gRNA
gacaccggcugacguccuca

SEQ ID NO: 11063 - RNA, 20 nt, Artificial Sequence
  MKO10011063_A_Cnksr1
  gRNA
aggccuugaugaugcccuac

SEQ ID NO: 11064 - RNA, 20 nt, Artificial Sequence
  MKO10011064_A_Cnksr2
  gRNA
gauguguaaugcguagcagc

SEQ ID NO: 11065 - RNA, 20 nt, Artificial Sequence
  MKO10011065_A_Cnksr2
  gRNA
gcugcuacgcauuacacauc

SEQ ID NO: 11066 - RNA, 20 nt, Artificial Sequence
  MKO10011066_A_Cnksr2
  gRNA
auuaacaacaauugugcaac

SEQ ID NO: 11067 - RNA, 20 nt, Artificial Sequence
  MKO10011067_A_Cnksr3
  gRNA
acgggacguauucccaucgu

SEQ ID NO: 11068 - RNA, 20 nt, Artificial Sequence
  MKO10011068_A_Cnksr3
  gRNA
agaauuacaucaguagccgc

SEQ ID NO: 11069 - RNA, 20 nt, Artificial Sequence
  MKO10011069_A_Cnksr3
  gRNA
accgaccuucuggacugcug

SEQ ID NO: 11070 - RNA, 20 nt, Artificial Sequence
  MKO10011070_A_Cnn1
  gRNA
cccagaaauacgaccaucag

SEQ ID NO: 11071 - RNA, 20 nt, Artificial Sequence
  MKO10011071_A_Cnn1
  gRNA
ugaaguuguucccgaugcgc

SEQ ID NO: 11072 - RNA, 20 nt, Artificial Sequence
  MKO10011072_A_Cnn1
  gRNA
uccauucaggccaagacaaa

SEQ ID NO: 11073 - RNA, 20 nt, Artificial Sequence
  MKO10011073_A_Cnn2
  gRNA
ccagugcgucaucgggcugc

SEQ ID NO: 11074 - RNA, 20 nt, Artificial Sequence
  MKO10011074_A_Cnn2
  gRNA
ucauguucccgcucucgaac

SEQ ID NO: 11075 - RNA, 20 nt, Artificial Sequence
  MKO10011075_A_Cnn2
  gRNA
agaacuccgaagcuggauag

SEQ ID NO: 11076 - RNA, 20 nt, Artificial Sequence
  MKO10011076_A_Cnn3
  gRNA
ccgaggaagaucugcgcaac

SEQ ID NO: 11077 - RNA, 20 nt, Artificial Sequence
  MKO10011077_A_Cnn3
  gRNA
ucugucuaggcgaaaacaaa

SEQ ID NO: 11078 - RNA, 20 nt, Artificial Sequence
  MKO10011078_A_Cnn3
  gRNA
uaccuggggccaauuuagug

SEQ ID NO: 11079 - RNA, 20 nt, Artificial Sequence
  MKO10011079_A_Cnnm1
  gRNA
ccucuaccagcgcaaccgcc

SEQ ID NO: 11080 - RNA, 20 nt, Artificial Sequence
  MKO10011080_A_Cnnm1
  gRNA
uguagaggucaguuucgucg

SEQ ID NO: 11081 - RNA, 20 nt, Artificial Sequence
  MKO10011081_A_Cnnm1
  gRNA
uagaauaccugagcaagcgc

SEQ ID NO: 11082 - RNA, 20 nt, Artificial Sequence
  MKO10011082_A_Cnnm2
  gRNA
ccccuauaacgaccucguua

SEQ ID NO: 11083 - RNA, 20 nt, Artificial Sequence
  MKO10011083_A_Cnnm2
  gRNA
uacgaacgacgugucguuca

SEQ ID NO: 11084 - RNA, 20 nt, Artificial Sequence
  MKO10011084_A_Cnnm2
  gRNA
agucuacgggcuuguuccgc

SEQ ID NO: 11085 - RNA, 20 nt, Artificial Sequence
  MKO10011085_A_Cnnm3
  gRNA
agugcugcgcucccggaccg

SEQ ID NO: 11086 - RNA, 20 nt, Artificial Sequence
  MKO10011086_A_Cnnm3
  gRNA
cggcugaggcccaacgcgcg

SEQ ID NO: 11087 - RNA, 20 nt, Artificial Sequence
  MKO10011087_A_Cnnm3
  gRNA
agcuccucucaagcgaaagg

SEQ ID NO: 11088 - RNA, 20 nt, Artificial Sequence
  MKO10011088_A_Cnnm4
  gRNA
agcaaucggccggcuuguuc

SEQ ID NO: 11089 - RNA, 20 nt, Artificial Sequence
  MKO10011089_A_Cnnm4
  gRNA
caaguaccccgacgucauuc

SEQ ID NO: 11090 - RNA, 20 nt, Artificial Sequence
  MKO10011090_A_Cnnm4
  gRNA
uuacagcugauaaucggacc

SEQ ID NO: 11091 - RNA, 20 nt, Artificial Sequence
  MKO10011091_A_Cnot10
  gRNA
gagcuucucgccgacagaua

SEQ ID NO: 11092 - RNA, 20 nt, Artificial Sequence
  MKO10011092_A_Cnot10
  gRNA
ccaucucuucaacagccgag

SEQ ID NO: 11093 - RNA, 20 nt, Artificial Sequence
  MKO10011093_A_Cnot10
  gRNA
cgagcaaaaagcacaccgcu

SEQ ID NO: 11094 - RNA, 20 nt, Artificial Sequence
  MKO10011094_A_Cnot11
  gRNA
accucgccagauugccuuga

SEQ ID NO: 11095 - RNA, 20 nt, Artificial Sequence
  MKO10011095_A_Cnot11
  gRNA
agcauuucuauagcgacuaa

SEQ ID NO: 11096 - RNA, 20 nt, Artificial Sequence
  MKO10011096_A_Cnot11
  gRNA
acuagaucuggaaguuucgc

SEQ ID NO: 11097 - RNA, 20 nt, Artificial Sequence
  MKO10011097_A_Cnot1
  gRNA
gcuugagaacuuuacucagc

SEQ ID NO: 11098 - RNA, 20 nt, Artificial Sequence
  MKO10011098_A_Cnot1
  gRNA
cuaaccuucugguagugcaa

SEQ ID NO: 11099 - RNA, 20 nt, Artificial Sequence
  MKO10011099_A_Cnot1
  gRNA
ucucaagcuaaguaaaguac

SEQ ID NO: 11100 - RNA, 20 nt, Artificial Sequence
  MKO10011100_A_Cnot2
  gRNA
cuggcaucgccaucuacguc

SEQ ID NO: 11101 - RNA, 20 nt, Artificial Sequence
  MKO10011101_A_Cnot2
  gRNA
acaucuuucucugaccgaug

SEQ ID NO: 11102 - RNA, 20 nt, Artificial Sequence
  MKO10011102_A_Cnot2
  gRNA
caauuuggggcaaguuuaua

SEQ ID NO: 11103 - RNA, 20 nt, Artificial Sequence
  MKO10011103_A_Cnot3
  gRNA
acccuccuugcuauacgcuu

SEQ ID NO: 11104 - RNA, 20 nt, Artificial Sequence
  MKO10011104_A_Cnot3
  gRNA
gauugaucgcugccucaaga

SEQ ID NO: 11105 - RNA, 20 nt, Artificial Sequence
  MKO10011105_A_Cnot3
  gRNA
uaaccgucucaaugagcuug

SEQ ID NO: 11106 - RNA, 20 nt, Artificial Sequence
  MKO10011106_A_Cnot4
  gRNA
gugcuuauguaacguauauc

SEQ ID NO: 11107 - RNA, 20 nt, Artificial Sequence
  MKO10011107_A_Cnot4
  gRNA
cgaauucgcacugaugagaa

SEQ ID NO: 11108 - RNA, 20 nt, Artificial Sequence
  MKO10011108_A_Cnot4
  gRNA
gucucgcaguccugaugcaa

SEQ ID NO: 11109 - RNA, 20 nt, Artificial Sequence
  MKO10011109_A_Cnot6l
  gRNA
uuacaccaucauguccgcag

SEQ ID NO: 11110 - RNA, 20 nt, Artificial Sequence
  MKO10011110_A_Cnot6l
  gRNA
ggagcuuaaguacaucacuc

SEQ ID NO: 11111 - RNA, 20 nt, Artificial Sequence
  MKO10011111_A_Cnot6l
  gRNA
uucaugcuugacaaucuugc

SEQ ID NO: 11112 - RNA, 20 nt, Artificial Sequence
  MKO10011112_A_Cnot6
  gRNA
uacuugcucgauaauuuguc

SEQ ID NO: 11113 - RNA, 20 nt, Artificial Sequence
  MKO10011113_A_Cnot6
  gRNA
gacagagguucaauauaucc

SEQ ID NO: 11114 - RNA, 20 nt, Artificial Sequence
  MKO10011114_A_Cnot6
  gRNA
uguaacaugauccaagaucu

SEQ ID NO: 11115 - RNA, 20 nt, Artificial Sequence
  MKO10011115_A_Cnot7
  gRNA
cuacauuacaccgcaacagu

SEQ ID NO: 11116 - RNA, 20 nt, Artificial Sequence
  MKO10011116_A_Cnot7
  gRNA
acccuccaggaacgucaacu

SEQ ID NO: 11117 - RNA, 20 nt, Artificial Sequence
  MKO10011117_A_Cnot7
  gRNA
uucuuugugaaggggucaaa

SEQ ID NO: 11118 - RNA, 20 nt, Artificial Sequence
  MKO10011118_A_Cnot8
  gRNA
gcuaacagacucucgccugc

SEQ ID NO: 11119 - RNA, 20 nt, Artificial Sequence
  MKO10011119_A_Cnot8
  gRNA
agacucucugcugacgggga

SEQ ID NO: 11120 - RNA, 20 nt, Artificial Sequence
  MKO10011120_A_Cnot8
  gRNA
ugucccuuagggaggccuuc

SEQ ID NO: 11121 - RNA, 20 nt, Artificial Sequence
  MKO10011121_A_Cnppd1
  gRNA
gacacgugcugcagauaauc

SEQ ID NO: 11122 - RNA, 20 nt, Artificial Sequence
  MKO10011122_A_Cnppd1
  gRNA
aggaggucuucaaugacgaa

SEQ ID NO: 11123 - RNA, 20 nt, Artificial Sequence
  MKO10011123_A_Cnppd1
  gRNA
ggcagcugggggagucgccg

SEQ ID NO: 11124 - RNA, 20 nt, Artificial Sequence
  MKO10011124_A_Cnpy1
  gRNA
gggcuuaccgcgaauuucaa

SEQ ID NO: 11125 - RNA, 20 nt, Artificial Sequence
  MKO10011125_A_Cnpy1
  gRNA
gcgaaugaacgauuaccagc

SEQ ID NO: 11126 - RNA, 20 nt, Artificial Sequence
  MKO10011126_A_Cnpy1
  gRNA
gauauucgaacuuauugccc

SEQ ID NO: 11127 - RNA, 20 nt, Artificial Sequence
  MKO10011127_A_Cnpy2
  gRNA
cgacgcguacguaguucuug

SEQ ID NO: 11128 - RNA, 20 nt, Artificial Sequence
  MKO10011128_A_Cnpy2
  gRNA
acuacguacgcgucgugagc

SEQ ID NO: 11129 - RNA, 20 nt, Artificial Sequence
  MKO10011129_A_Cnpy2
  gRNA
agagugggaaauugcccgcg

SEQ ID NO: 11130 - RNA, 20 nt, Artificial Sequence
  MKO10011130_A_Cnpy3
  gRNA
uggauauccccuaugagcug

SEQ ID NO: 11131 - RNA, 20 nt, Artificial Sequence
  MKO10011131_A_Cnpy3
  gRNA
uagguugugcagcgucucaa

SEQ ID NO: 11132 - RNA, 20 nt, Artificial Sequence
  MKO10011132_A_Cnpy3
  gRNA
cugugccaaccacgugcuga

SEQ ID NO: 11133 - RNA, 20 nt, Artificial Sequence
  MKO10011133_A_Cnpy4
  gRNA
caguucgacucaacgcuucc

SEQ ID NO: 11134 - RNA, 20 nt, Artificial Sequence
  MKO10011134_A_Cnpy4
  gRNA
caggaagcguugagucgaac

SEQ ID NO: 11135 - RNA, 20 nt, Artificial Sequence
  MKO10011135_A_Cnpy4
  gRNA
cuuuggagaauuugugcgag

SEQ ID NO: 11136 - RNA, 20 nt, Artificial Sequence
  MKO10011136_A_Cnp
  gRNA
ugccgucgugguacuucucc

SEQ ID NO: 11137 - RNA, 20 nt, Artificial Sequence
  MKO10011137_A_Cnp
  gRNA
ugaauagcgucuugcacucg

SEQ ID NO: 11138 - RNA, 20 nt, Artificial Sequence
  MKO10011138_A_Cnp
  gRNA
cccauaguaccccgugaaga

SEQ ID NO: 11139 - RNA, 20 nt, Artificial Sequence
  MKO10011139_A_Cnr1
  gRNA
ccuauaagaggaucgucacc

SEQ ID NO: 11140 - RNA, 20 nt, Artificial Sequence
  MKO10011140_A_Cnr1
  gRNA
guuaugaagucgaucuuaga

SEQ ID NO: 11141 - RNA, 20 nt, Artificial Sequence
  MKO10011141_A_Cnr1
  gRNA
uaucuuugcgguggaacacg

SEQ ID NO: 11142 - RNA, 20 nt, Artificial Sequence
  MKO10011142_A_Cnr2
  gRNA
uagcguuggagucgaccccg

SEQ ID NO: 11143 - RNA, 20 nt, Artificial Sequence
  MKO10011143_A_Cnr2
  gRNA
gaucccuaacgacuaccuac

SEQ ID NO: 11144 - RNA, 20 nt, Artificial Sequence
  MKO10011144_A_Cnr2
  gRNA
gauuucuuaccugccgcuca

SEQ ID NO: 11145 - RNA, 20 nt, Artificial Sequence
  MKO10011145_A_Cnrip1
  gRNA
aaaggcgcacgaguccgggu

SEQ ID NO: 11146 - RNA, 20 nt, Artificial Sequence
  MKO10011146_A_Cnrip1
  gRNA
cugcgcauccagcccaacga

SEQ ID NO: 11147 - RNA, 20 nt, Artificial Sequence
  MKO10011147_A_Cnrip1
  gRNA
acuggcaauggucucgcuug

SEQ ID NO: 11148 - RNA, 20 nt, Artificial Sequence
  MKO10011148_A_Cnst
  gRNA
gacgcagaaugcaacgucgc

SEQ ID NO: 11149 - RNA, 20 nt, Artificial Sequence
  MKO10011149_A_Cnst
  gRNA
ccacucuucucgcugauccg

SEQ ID NO: 11150 - RNA, 20 nt, Artificial Sequence
  MKO10011150_A_Cnst
  gRNA
ugcaaaucuuucugccauuc

SEQ ID NO: 11151 - RNA, 20 nt, Artificial Sequence
  MKO10011151_A_Cntd1
  gRNA
caacaaguucauccuccgau

SEQ ID NO: 11152 - RNA, 20 nt, Artificial Sequence
  MKO10011152_A_Cntd1
  gRNA
gcugaacacacgacaccaau

SEQ ID NO: 11153 - RNA, 20 nt, Artificial Sequence
  MKO10011153_A_Cntd1
  gRNA
uugucugacccuccucgacc

SEQ ID NO: 11154 - RNA, 20 nt, Artificial Sequence
  MKO10011154_A_Cntfr
  gRNA
accccccucagugccgccgc

SEQ ID NO: 11155 - RNA, 20 nt, Artificial Sequence
  MKO10011155_A_Cntfr
  gRNA
ccgcuccaacacuuacccca

SEQ ID NO: 11156 - RNA, 20 nt, Artificial Sequence
  MKO10011156_A_Cntfr
  gRNA
ccagacgcucauacugcacg

SEQ ID NO: 11157 - RNA, 20 nt, Artificial Sequence
  MKO10011157_A_Cntf
  gRNA
gugcauuucaccccgacuga

SEQ ID NO: 11158 - RNA, 20 nt, Artificial Sequence
  MKO10011158_A_Cntf
  gRNA
ucggggugaaaugcacucuc

SEQ ID NO: 11159 - RNA, 20 nt, Artificial Sequence
  MKO10011159_A_Cntf
  gRNA
accucuguagccgcucuauc

SEQ ID NO: 11160 - RNA, 20 nt, Artificial Sequence
  MKO10011160_A_Cntln
  gRNA
agccggcggucccugcgcgu

SEQ ID NO: 11161 - RNA, 20 nt, Artificial Sequence
  MKO10011161_A_Cntln
  gRNA
uccugucgccagcgcgcccg

SEQ ID NO: 11162 - RNA, 20 nt, Artificial Sequence
  MKO10011162_A_Cntln
  gRNA
gacugaaucuguacuaaaac

SEQ ID NO: 11163 - RNA, 20 nt, Artificial Sequence
  MKO10011163_A_Cntn1
  gRNA
uacuguaccgaucguuuguc

SEQ ID NO: 11164 - RNA, 20 nt, Artificial Sequence
  MKO10011164_A_Cntn1
  gRNA
acguggaccugacaaacgau

SEQ ID NO: 11165 - RNA, 20 nt, Artificial Sequence
  MKO10011165_A_Cntn1
  gRNA
gcguccggaagugaagguga

SEQ ID NO: 11166 - RNA, 20 nt, Artificial Sequence
  MKO10011166_A_Cntn2
  gRNA
caaauucgcgcagcucaacc

SEQ ID NO: 11167 - RNA, 20 nt, Artificial Sequence
  MKO10011167_A_Cntn2
  gRNA
cauuggugcgggcgauguac

SEQ ID NO: 11168 - RNA, 20 nt, Artificial Sequence
  MKO10011168_A_Cntn2
  gRNA
agaccccgugaaaacccacg

SEQ ID NO: 11169 - RNA, 20 nt, Artificial Sequence
  MKO10011169_A_Cntn3
  gRNA
agcacugugucgguccguga

SEQ ID NO: 11170 - RNA, 20 nt, Artificial Sequence
  MKO10011170_A_Cntn3
  gRNA
ccaucagagcguagcaccaa

SEQ ID NO: 11171 - RNA, 20 nt, Artificial Sequence
  MKO10011171_A_Cntn3
  gRNA
gguuggggagcccaauacuc

SEQ ID NO: 11172 - RNA, 20 nt, Artificial Sequence
  MKO10011172_A_Cntn4
  gRNA
agcacugugucaguccgucg

SEQ ID NO: 11173 - RNA, 20 nt, Artificial Sequence
  MKO10011173_A_Cntn4
  gRNA
ggaccauucccugaccucga

SEQ ID NO: 11174 - RNA, 20 nt, Artificial Sequence
  MKO10011174_A_Cntn4
  gRNA
ugccgucaacaacacuguag

SEQ ID NO: 11175 - RNA, 20 nt, Artificial Sequence
  MKO10011175_A_Cntn5
  gRNA
ccacucacgcugcgaaauga

SEQ ID NO: 11176 - RNA, 20 nt, Artificial Sequence
  MKO10011176_A_Cntn5
  gRNA
gcccgguuccaacaauuacu

SEQ ID NO: 11177 - RNA, 20 nt, Artificial Sequence
  MKO10011177_A_Cntn5
  gRNA
ucucuugggauaugaaccgc

SEQ ID NO: 11178 - RNA, 20 nt, Artificial Sequence
  MKO10011178_A_Cntn6
  gRNA
ucggcaugacuuaucacuau

SEQ ID NO: 11179 - RNA, 20 nt, Artificial Sequence
  MKO10011179_A_Cntn6
  gRNA
agcacaguaucuguccgaga

SEQ ID NO: 11180 - RNA, 20 nt, Artificial Sequence
  MKO10011180_A_Cntn6
  gRNA
ccaucagugcgcagcacuaa

SEQ ID NO: 11181 - RNA, 20 nt, Artificial Sequence
  MKO10011181_A_Cntnap1
  gRNA
uggaacccacgcggcaagau

SEQ ID NO: 11182 - RNA, 20 nt, Artificial Sequence
  MKO10011182_A_Cntnap1
  gRNA
caucgucgccgucaaaauac

SEQ ID NO: 11183 - RNA, 20 nt, Artificial Sequence
  MKO10011183_A_Cntnap1
  gRNA
ggauguagcgagccguaaag

SEQ ID NO: 11184 - RNA, 20 nt, Artificial Sequence
  MKO10011184_A_Cntnap2
  gRNA
ccgguacauguuccgucaca

SEQ ID NO: 11185 - RNA, 20 nt, Artificial Sequence
  MKO10011185_A_Cntnap2
  gRNA
gaccauugacgagagcaaaa

SEQ ID NO: 11186 - RNA, 20 nt, Artificial Sequence
  MKO10011186_A_Cntnap2
  gRNA
caccuagaucacuuggauuc

SEQ ID NO: 11187 - RNA, 20 nt, Artificial Sequence
  MKO10011187_A_Cntnap3
  gRNA
agacaauugugaugcuccgu

SEQ ID NO: 11188 - RNA, 20 nt, Artificial Sequence
  MKO10011188_A_Cntnap3
  gRNA
cagaacucccguauccaccc

SEQ ID NO: 11189 - RNA, 20 nt, Artificial Sequence
  MKO10011189_A_Cntnap3
  gRNA
gauugaccuuggagaacgaa

SEQ ID NO: 11190 - RNA, 20 nt, Artificial Sequence
  MKO10011190_A_Cntnap4
  gRNA
cgauucagccuugcgaaucc

SEQ ID NO: 11191 - RNA, 20 nt, Artificial Sequence
  MKO10011191_A_Cntnap4
  gRNA
gcgcaucccgauucugcccu

SEQ ID NO: 11192 - RNA, 20 nt, Artificial Sequence
  MKO10011192_A_Cntnap4
  gRNA
cagaaucgggaugcgcauug

SEQ ID NO: 11193 - RNA, 20 nt, Artificial Sequence
  MKO10011193_A_Cntnap5a
  gRNA
cuuacuauaggagcauccau

SEQ ID NO: 11194 - RNA, 20 nt, Artificial Sequence
  MKO10011194_A_Cntnap5a
  gRNA
acguggagaccacaucacuc

SEQ ID NO: 11195 - RNA, 20 nt, Artificial Sequence
  MKO10011195_A_Cntnap5a
  gRNA
gauuacagcuguagccacac

SEQ ID NO: 11196 - RNA, 20 nt, Artificial Sequence
  MKO10011196_A_Cntnap5b
  gRNA
ugccugauauucagcgacac

SEQ ID NO: 11197 - RNA, 20 nt, Artificial Sequence
  MKO10011197_A_Cntnap5b
  gRNA
cccauucaguugagcugagc

SEQ ID NO: 11198 - RNA, 20 nt, Artificial Sequence
  MKO10011198_A_Cntnap5b
  gRNA
gcccugugucgcugaauauc

SEQ ID NO: 11199 - RNA, 20 nt, Artificial Sequence
  MKO10011199_A_Cntnap5c
  gRNA
caacuggcaacaguacacgc

SEQ ID NO: 11200 - RNA, 20 nt, Artificial Sequence
  MKO10011200_A_Cntnap5c
  gRNA
gauuacagcuguggcuaccc

SEQ ID NO: 11201 - RNA, 20 nt, Artificial Sequence
  MKO10011201_A_Cntnap5c
  gRNA
uuaaguucaagagcauacaa

SEQ ID NO: 11202 - RNA, 20 nt, Artificial Sequence
  MKO10011202_A_Cntrob
  gRNA
acuuacgauaggcaguauca

SEQ ID NO: 11203 - RNA, 20 nt, Artificial Sequence
  MKO10011203_A_Cntrob
  gRNA
ugcagagcuuacacgcagaa

SEQ ID NO: 11204 - RNA, 20 nt, Artificial Sequence
  MKO10011204_A_Cntrob
  gRNA
uuccccgcuacacuagccuu

SEQ ID NO: 11205 - RNA, 20 nt, Artificial Sequence
  MKO10011205_A_Coa3
  gRNA
cucagcgcaucgacccgucg

SEQ ID NO: 11206 - RNA, 20 nt, Artificial Sequence
  MKO10011206_A_Coa3
  gRNA
cgcauaaacugcaacugcgc

SEQ ID NO: 11207 - RNA, 20 nt, Artificial Sequence
  MKO10011207_A_Coa3
  gRNA
cucuugggccaccgaguaga

SEQ ID NO: 11208 - RNA, 20 nt, Artificial Sequence
  MKO10011208_A_Coa4
  gRNA
cuggacucgcccggugaaga

SEQ ID NO: 11209 - RNA, 20 nt, Artificial Sequence
  MKO10011209_A_Coa4
  gRNA
cgaguccaguuauggccuug

SEQ ID NO: 11210 - RNA, 20 nt, Artificial Sequence
  MKO10011210_A_Coa4
  gRNA
ccagugccagccgcaagugc

SEQ ID NO: 11211 - RNA, 20 nt, Artificial Sequence
  MKO10011211_A_Coa5
  gRNA
guccucauaauaccggggca

SEQ ID NO: 11212 - RNA, 20 nt, Artificial Sequence
  MKO10011212_A_Coa5
  gRNA
auccgcuaccuggagcacac

SEQ ID NO: 11213 - RNA, 20 nt, Artificial Sequence
  MKO10011213_A_Coa5
  gRNA
cacaggaaggaaaaucccca

SEQ ID NO: 11214 - RNA, 20 nt, Artificial Sequence
  MKO10011214_A_Coa6
  gRNA
cugccuggacgacaacgcgg

SEQ ID NO: 11215 - RNA, 20 nt, Artificial Sequence
  MKO10011215_A_Coa6
  gRNA
ggggugcgcgcgaccuguac

SEQ ID NO: 11216 - RNA, 20 nt, Artificial Sequence
  MKO10011216_A_Coa6
  gRNA
acagucgacugaaaauuccu

SEQ ID NO: 11217 - RNA, 20 nt, Artificial Sequence
  MKO10011217_A_Coasy
  gRNA
caucaucgacagcgaccauc

SEQ ID NO: 11218 - RNA, 20 nt, Artificial Sequence
  MKO10011218_A_Coasy
  gRNA
gucagcgaggagaccuaccg

SEQ ID NO: 11219 - RNA, 20 nt, Artificial Sequence
  MKO10011219_A_Coasy
  gRNA
ccagccguaugcagagcgcg

SEQ ID NO: 11220 - RNA, 20 nt, Artificial Sequence
  MKO10011220_A_Cobll1
  gRNA
ucuuccuccggccgagacga

SEQ ID NO: 11221 - RNA, 20 nt, Artificial Sequence
  MKO10011221_A_Cobll1
  gRNA
uacuuacccugcggagcccg

SEQ ID NO: 11222 - RNA, 20 nt, Artificial Sequence
  MKO10011222_A_Cobll1
  gRNA
cgcgauggaccgcagcgucc

SEQ ID NO: 11223 - RNA, 20 nt, Artificial Sequence
  MKO10011223_A_Cobl
  gRNA
cuugcagaaaucuguacgac

SEQ ID NO: 11224 - RNA, 20 nt, Artificial Sequence
  MKO10011224_A_Cobl
  gRNA
uuuaagccaaauacguugau

SEQ ID NO: 11225 - RNA, 20 nt, Artificial Sequence
  MKO10011225_A_Cobl
  gRNA
cucaccacguccuagagauc

SEQ ID NO: 11226 - RNA, 20 nt, Artificial Sequence
  MKO10011226_A_Coch
  gRNA
uucgcgcgcgccgagggagc

SEQ ID NO: 11227 - RNA, 20 nt, Artificial Sequence
  MKO10011227_A_Coch
  gRNA
gaggaguaguucucucgacc

SEQ ID NO: 11228 - RNA, 20 nt, Artificial Sequence
  MKO10011228_A_Coch
  gRNA
accuaacucacccgcucccu

SEQ ID NO: 11229 - RNA, 20 nt, Artificial Sequence
  MKO10011229_A_Cog1
  gRNA
cgucugaauagucgccuuuc

SEQ ID NO: 11230 - RNA, 20 nt, Artificial Sequence
  MKO10011230_A_Cog1
  gRNA
auuuccaauccucauccgcc

SEQ ID NO: 11231 - RNA, 20 nt, Artificial Sequence
  MKO10011231_A_Cog1
  gRNA
ugugggcuggaacucgauaa

SEQ ID NO: 11232 - RNA, 20 nt, Artificial Sequence
  MKO10011232_A_Cog2
  gRNA
acuuauacaaguuauucgau

SEQ ID NO: 11233 - RNA, 20 nt, Artificial Sequence
  MKO10011233_A_Cog2
  gRNA
acaguuacgagaagagguuc

SEQ ID NO: 11234 - RNA, 20 nt, Artificial Sequence
  MKO10011234_A_Cog2
  gRNA
ugucaaccucucaacaaacc

SEQ ID NO: 11235 - RNA, 20 nt, Artificial Sequence
  MKO10011235_A_Cog3
  gRNA
cagaugagggauuacuuguc

SEQ ID NO: 11236 - RNA, 20 nt, Artificial Sequence
  MKO10011236_A_Cog3
  gRNA
aagcugcauacaucuucaau

SEQ ID NO: 11237 - RNA, 20 nt, Artificial Sequence
  MKO10011237_A_Cog3
  gRNA
augaagaguuccugucuuau

SEQ ID NO: 11238 - RNA, 20 nt, Artificial Sequence
  MKO10011238_A_Cog4
  gRNA
cuuguagaaccgccucuauc

SEQ ID NO: 11239 - RNA, 20 nt, Artificial Sequence
  MKO10011239_A_Cog4
  gRNA
uuugcuaucgcuaccaaaga

SEQ ID NO: 11240 - RNA, 20 nt, Artificial Sequence
  MKO10011240_A_Cog4
  gRNA
gucauugagcucagccgaca

SEQ ID NO: 11241 - RNA, 20 nt, Artificial Sequence
  MKO10011241_A_Cog5
  gRNA
aguagcccguacugcacaac

SEQ ID NO: 11242 - RNA, 20 nt, Artificial Sequence
  MKO10011242_A_Cog5
  gRNA
cagaugaugcagacgagaau

SEQ ID NO: 11243 - RNA, 20 nt, Artificial Sequence
  MKO10011243_A_Cog5
  gRNA
caacuagcaaaacuugccca

SEQ ID NO: 11244 - RNA, 20 nt, Artificial Sequence
  MKO10011244_A_Cog6
  gRNA
ggauaugacaagucgcuuac

SEQ ID NO: 11245 - RNA, 20 nt, Artificial Sequence
  MKO10011245_A_Cog6
  gRNA
agucuccuccgcgguacaag

SEQ ID NO: 11246 - RNA, 20 nt, Artificial Sequence
  MKO10011246_A_Cog6
  gRNA
ucauuucauccgaagucagc

SEQ ID NO: 11247 - RNA, 20 nt, Artificial Sequence
  MKO10011247_A_Cog7
  gRNA
ugaacgaugcuacgaucugg

SEQ ID NO: 11248 - RNA, 20 nt, Artificial Sequence
  MKO10011248_A_Cog7
  gRNA
cgcggcagaaacaagucucc

SEQ ID NO: 11249 - RNA, 20 nt, Artificial Sequence
  MKO10011249_A_Cog7
  gRNA
gcccaaagugcuccgugaug

SEQ ID NO: 11250 - RNA, 20 nt, Artificial Sequence
  MKO10011250_A_Cog8
  gRNA
ccuuuccagucgccguacau

SEQ ID NO: 11251 - RNA, 20 nt, Artificial Sequence
  MKO10011251_A_Cog8
  gRNA
gccgaagauagccuaugaca

SEQ ID NO: 11252 - RNA, 20 nt, Artificial Sequence
  MKO10011252_A_Cog8
  gRNA
ggcugauuuccgcggccagu

SEQ ID NO: 11253 - RNA, 20 nt, Artificial Sequence
  MKO10011253_A_Coil
  gRNA
uuuguccgccccgucucauc

SEQ ID NO: 11254 - RNA, 20 nt, Artificial Sequence
  MKO10011254_A_Coil
  gRNA
gaagccucgguaaagcccga

SEQ ID NO: 11255 - RNA, 20 nt, Artificial Sequence
  MKO10011255_A_Coil
  gRNA
agagguccucuccucgcuac

SEQ ID NO: 11256 - RNA, 20 nt, Artificial Sequence
  MKO10011256_A_Col10a1
  gRNA
ucaucauacguguacaucgu

SEQ ID NO: 11257 - RNA, 20 nt, Artificial Sequence
  MKO10011257_A_Col10a1
  gRNA
ccuaucucaccuuuagcgcc

SEQ ID NO: 11258 - RNA, 20 nt, Artificial Sequence
  MKO10011258_A_Col10a1
  gRNA
aagugggcccuuuaugccug

SEQ ID NO: 11259 - RNA, 20 nt, Artificial Sequence
  MKO10011259_A_Col11a1
  gRNA
ucgaucucucacuucuaucg

SEQ ID NO: 11260 - RNA, 20 nt, Artificial Sequence
  MKO10011260_A_Col11a1
  gRNA
gcaccgggucgcaaucagug

SEQ ID NO: 11261 - RNA, 20 nt, Artificial Sequence
  MKO10011261_A_Col11a1
  gRNA
acaguagucguaugcugccu

SEQ ID NO: 11262 - RNA, 20 nt, Artificial Sequence
  MKO10011262_A_Col11a2
  gRNA
cuucaaagacuucaucgucg

SEQ ID NO: 11263 - RNA, 20 nt, Artificial Sequence
  MKO10011263_A_Col11a2
  gRNA
cacgauuagauggcaccacg

SEQ ID NO: 11264 - RNA, 20 nt, Artificial Sequence
  MKO10011264_A_Col11a2
  gRNA
cuugacucuauacagcgccc

SEQ ID NO: 11265 - RNA, 20 nt, Artificial Sequence
  MKO10011265_A_Col12a1
  gRNA
gagaccaguugauccaauug

SEQ ID NO: 11266 - RNA, 20 nt, Artificial Sequence
  MKO10011266_A_Col12a1
  gRNA
cuuguuaguugaccuauuac

SEQ ID NO: 11267 - RNA, 20 nt, Artificial Sequence
  MKO10011267_A_Col12a1
  gRNA
uccccgagcgcuggccgccc

SEQ ID NO: 11268 - RNA, 20 nt, Artificial Sequence
  MKO10011268_A_Col13a1
  gRNA
aauggaaguucuacucgcgu

SEQ ID NO: 11269 - RNA, 20 nt, Artificial Sequence
  MKO10011269_A_Col13a1
  gRNA
agccaacucaccacacgucc

SEQ ID NO: 11270 - RNA, 20 nt, Artificial Sequence
  MKO10011270_A_Col13a1
  gRNA
gaagccccgaagaugucucc

SEQ ID NO: 11271 - RNA, 20 nt, Artificial Sequence
  MKO10011271_A_Col14a1
  gRNA
ccacguugaacgcugugacc

SEQ ID NO: 11272 - RNA, 20 nt, Artificial Sequence
  MKO10011272_A_Col14a1
  gRNA
uacuccacgacccauccacc

SEQ ID NO: 11273 - RNA, 20 nt, Artificial Sequence
  MKO10011273_A_Col14a1
  gRNA
aucugaccuucuggugaagu

SEQ ID NO: 11274 - RNA, 20 nt, Artificial Sequence
  MKO10011274_A_Col15a1
  gRNA
uccguuuccagcgaucgucc

SEQ ID NO: 11275 - RNA, 20 nt, Artificial Sequence
  MKO10011275_A_Col15a1
  gRNA
gugaagcccaauagcgccca

SEQ ID NO: 11276 - RNA, 20 nt, Artificial Sequence
  MKO10011276_A_Col15a1
  gRNA
cugcagacccgcgcugcgac

SEQ ID NO: 11277 - RNA, 20 nt, Artificial Sequence
  MKO10011277_A_Col16a1
  gRNA
gacccaucaaccaacgugac

SEQ ID NO: 11278 - RNA, 20 nt, Artificial Sequence
  MKO10011278_A_Col16a1
  gRNA
gccaacgcagaucgaagagc

SEQ ID NO: 11279 - RNA, 20 nt, Artificial Sequence
  MKO10011279_A_Col16a1
  gRNA
gaguccuuuaccgaguuggu

SEQ ID NO: 11280 - RNA, 20 nt, Artificial Sequence
  MKO10011280_A_Col17a1
  gRNA
gagccacuuacuuggcggua

SEQ ID NO: 11281 - RNA, 20 nt, Artificial Sequence
  MKO10011281_A_Col17a1
  gRNA
aaagcucacaugacccgcca

SEQ ID NO: 11282 - RNA, 20 nt, Artificial Sequence
  MKO10011282_A_Col17a1
  gRNA
ugagugcguucuccuguaac

SEQ ID NO: 11283 - RNA, 20 nt, Artificial Sequence
  MKO10011283_A_Col18a1
  gRNA
gacgccgcgguagauucuau

SEQ ID NO: 11284 - RNA, 20 nt, Artificial Sequence
  MKO10011284_A_Col18a1
  gRNA
auguaggccggcccgacgug

SEQ ID NO: 11285 - RNA, 20 nt, Artificial Sequence
  MKO10011285_A_Col18a1
  gRNA
cacuucgcgcucagcgucga

SEQ ID NO: 11286 - RNA, 20 nt, Artificial Sequence
  MKO10011286_A_Col19a1
  gRNA
gugguagaauuuauguuccg

SEQ ID NO: 11287 - RNA, 20 nt, Artificial Sequence
  MKO10011287_A_Col19a1
  gRNA
guccacucuuugaucgucaa

SEQ ID NO: 11288 - RNA, 20 nt, Artificial Sequence
  MKO10011288_A_Col19a1
  gRNA
cacacuucccaacuugaaac

SEQ ID NO: 11289 - RNA, 20 nt, Artificial Sequence
  MKO10011289_A_Col1a1
  gRNA
agaaccguaccguauucuuc

SEQ ID NO: 11290 - RNA, 20 nt, Artificial Sequence
  MKO10011290_A_Col1a1
  gRNA
agcacucgcccucccgucuu

SEQ ID NO: 11291 - RNA, 20 nt, Artificial Sequence
  MKO10011291_A_Col1a1
  gRNA
aucucguccaggggggccaa

SEQ ID NO: 11292 - RNA, 20 nt, Artificial Sequence
  MKO10011292_A_Col1a2
  gRNA
uuccuagggaucaguacgaa

SEQ ID NO: 11293 - RNA, 20 nt, Artificial Sequence
  MKO10011293_A_Col1a2
  gRNA
agaugguguugaugguccca

SEQ ID NO: 11294 - RNA, 20 nt, Artificial Sequence
  MKO10011294_A_Col1a2
  gRNA
ucacauacccuuuguccacg

SEQ ID NO: 11295 - RNA, 20 nt, Artificial Sequence
  MKO10011295_A_Col20a1
  gRNA
uuacaguaaguagccgccug

SEQ ID NO: 11296 - RNA, 20 nt, Artificial Sequence
  MKO10011296_A_Col20a1
  gRNA
ggccuauccugcuggcacga

SEQ ID NO: 11297 - RNA, 20 nt, Artificial Sequence
  MKO10011297_A_Col20a1
  gRNA
caaacucccuucgugccagc

SEQ ID NO: 11298 - RNA, 20 nt, Artificial Sequence
  MKO10011298_A_Col22a1
  gRNA
ccguguucguguuaccgcca

SEQ ID NO: 11299 - RNA, 20 nt, Artificial Sequence
  MKO10011299_A_Col22a1
  gRNA
gcgcggcgcaucaccuacca

SEQ ID NO: 11300 - RNA, 20 nt, Artificial Sequence
  MKO10011300_A_Col22a1
  gRNA
uaaaccgaucuccuucuacc

SEQ ID NO: 11301 - RNA, 20 nt, Artificial Sequence
  MKO10011301_A_Col23a1
  gRNA
uggauggagucgccaagcuc

SEQ ID NO: 11302 - RNA, 20 nt, Artificial Sequence
  MKO10011302_A_Col23a1
  gRNA
ccagggucgccucuucgucc

SEQ ID NO: 11303 - RNA, 20 nt, Artificial Sequence
  MKO10011303_A_Col23a1
  gRNA
cguggcaagccuggacgaag

SEQ ID NO: 11304 - RNA, 20 nt, Artificial Sequence
  MKO10011304_A_Col24a1
  gRNA
ccaucagcgaacgucucccg

SEQ ID NO: 11305 - RNA, 20 nt, Artificial Sequence
  MKO10011305_A_Col24a1
  gRNA
ccacgggagacguucgcuga

SEQ ID NO: 11306 - RNA, 20 nt, Artificial Sequence
  MKO10011306_A_Col24a1
  gRNA
uaagggucccccugguccga

SEQ ID NO: 11307 - RNA, 20 nt, Artificial Sequence
  MKO10011307_A_Col25a1
  gRNA
ccauccgcugucugacaccg

SEQ ID NO: 11308 - RNA, 20 nt, Artificial Sequence
  MKO10011308_A_Col25a1
  gRNA
cggcaccaugcccucgugca

SEQ ID NO: 11309 - RNA, 20 nt, Artificial Sequence
  MKO10011309_A_Col25a1
  gRNA
uaaaauaagaacggccaggg

SEQ ID NO: 11310 - RNA, 20 nt, Artificial Sequence
  MKO10011310_A_Col26a1
  gRNA
gagugaacggcugaccacgc

SEQ ID NO: 11311 - RNA, 20 nt, Artificial Sequence
  MKO10011311_A_Col26a1
  gRNA
cuaccgcacggugacugcgc

SEQ ID NO: 11312 - RNA, 20 nt, Artificial Sequence
  MKO10011312_A_Col26a1
  gRNA
gcagaauggcuccgagacgg

SEQ ID NO: 11313 - RNA, 20 nt, Artificial Sequence
  MKO10011313_A_Col27a1
  gRNA
uugugagcgaccugcgccac

SEQ ID NO: 11314 - RNA, 20 nt, Artificial Sequence
  MKO10011314_A_Col27a1
  gRNA
ggaugaucguccugccgggg

SEQ ID NO: 11315 - RNA, 20 nt, Artificial Sequence
  MKO10011315_A_Col27a1
  gRNA
acccgaggaccucgugcgcc

SEQ ID NO: 11316 - RNA, 20 nt, Artificial Sequence
  MKO10011316_A_Col28a1
  gRNA
ugacccgcugcuuaaauguc

SEQ ID NO: 11317 - RNA, 20 nt, Artificial Sequence
  MKO10011317_A_Col28a1
  gRNA
cccagauaucaaacgaaguu

SEQ ID NO: 11318 - RNA, 20 nt, Artificial Sequence
  MKO10011318_A_Col28a1
  gRNA
uaauuuaccggguuuccuuu

SEQ ID NO: 11319 - RNA, 20 nt, Artificial Sequence
  MKO10011319_A_Col2a1
  gRNA
gcugacgcugcucaucgccg

SEQ ID NO: 11320 - RNA, 20 nt, Artificial Sequence
  MKO10011320_A_Col2a1
  gRNA
cggugagccaugauccgccu

SEQ ID NO: 11321 - RNA, 20 nt, Artificial Sequence
  MKO10011321_A_Col2a1
  gRNA
ugcaggaaaauuagggccaa

SEQ ID NO: 11322 - RNA, 20 nt, Artificial Sequence
  MKO10011322_A_Col3a1
  gRNA
guuacuuaccggaucucccu

SEQ ID NO: 11323 - RNA, 20 nt, Artificial Sequence
  MKO10011323_A_Col3a1
  gRNA
aucugugaaucauguccaac

SEQ ID NO: 11324 - RNA, 20 nt, Artificial Sequence
  MKO10011324_A_Col3a1
  gRNA
ugacaucauaugagucgaau

SEQ ID NO: 11325 - RNA, 20 nt, Artificial Sequence
  MKO10011325_A_Col4a1
  gRNA
uucuuucagggcgauugugg

SEQ ID NO: 11326 - RNA, 20 nt, Artificial Sequence
  MKO10011326_A_Col4a1
  gRNA
ccaaugacaccuugcaaccc

SEQ ID NO: 11327 - RNA, 20 nt, Artificial Sequence
  MKO10011327_A_Col4a1
  gRNA
ccccucagguccuugcaucc

SEQ ID NO: 11328 - RNA, 20 nt, Artificial Sequence
  MKO10011328_A_Col4a2
  gRNA
ugccagugcuacccggagaa

SEQ ID NO: 11329 - RNA, 20 nt, Artificial Sequence
  MKO10011329_A_Col4a2
  gRNA
acuccuggcucagagcgucu

SEQ ID NO: 11330 - RNA, 20 nt, Artificial Sequence
  MKO10011330_A_Col4a2
  gRNA
gugggcccccagggguacaa

SEQ ID NO: 11331 - RNA, 20 nt, Artificial Sequence
  MKO10011331_A_Col4a3bp
  gRNA
gaguccagcuugcguagaca

SEQ ID NO: 11332 - RNA, 20 nt, Artificial Sequence
  MKO10011332_A_Col4a3bp
  gRNA
ugagccaugucuacgcaagc

SEQ ID NO: 11333 - RNA, 20 nt, Artificial Sequence
  MKO10011333_A_Col4a3bp
  gRNA
gacggaguccgggccgccug

SEQ ID NO: 11334 - RNA, 20 nt, Artificial Sequence
  MKO10011334_A_Col4a3
  gRNA
caaaggacaaugccucugcg

SEQ ID NO: 11335 - RNA, 20 nt, Artificial Sequence
  MKO10011335_A_Col4a3
  gRNA
ccagugagucccggaagucc

SEQ ID NO: 11336 - RNA, 20 nt, Artificial Sequence
  MKO10011336_A_Col4a3
  gRNA
uagggaauaacuggauuacc

SEQ ID NO: 11337 - RNA, 20 nt, Artificial Sequence
  MKO10011337_A_Col4a4
  gRNA
agagcaguuucuuccuccgc

SEQ ID NO: 11338 - RNA, 20 nt, Artificial Sequence
  MKO10011338_A_Col4a4
  gRNA
acagggaccaauagggcccu

SEQ ID NO: 11339 - RNA, 20 nt, Artificial Sequence
  MKO10011339_A_Col4a4
  gRNA
uaggguccaacugguguccc

SEQ ID NO: 11340 - RNA, 20 nt, Artificial Sequence
  MKO10011340_A_Col4a5
  gRNA
ccuggaugaccuucuaaacc

SEQ ID NO: 11341 - RNA, 20 nt, Artificial Sequence
  MKO10011341_A_Col4a5
  gRNA
auuuccuauaggccugccau

SEQ ID NO: 11342 - RNA, 20 nt, Artificial Sequence
  MKO10011342_A_Col4a5
  gRNA
uuuaauugcagggagaacgg

SEQ ID NO: 11343 - RNA, 20 nt, Artificial Sequence
  MKO10011343_A_Col4a6
  gRNA
accaguaaacccuuccggac

SEQ ID NO: 11344 - RNA, 20 nt, Artificial Sequence
  MKO10011344_A_Col4a6
  gRNA
uaggggcacccuggaccaau

SEQ ID NO: 11345 - RNA, 20 nt, Artificial Sequence
  MKO10011345_A_Col4a6
  gRNA
ugugggagccgagauugcca

SEQ ID NO: 11346 - RNA, 20 nt, Artificial Sequence
  MKO10011346_A_Col5a1
  gRNA
ccaucggacaaguugaugcc

SEQ ID NO: 11347 - RNA, 20 nt, Artificial Sequence
  MKO10011347_A_Col5a1
  gRNA
cauguuuggcucccggauuc

SEQ ID NO: 11348 - RNA, 20 nt, Artificial Sequence
  MKO10011348_A_Col5a1
  gRNA
aagcggauacucuucaggcc

SEQ ID NO: 11349 - RNA, 20 nt, Artificial Sequence
  MKO10011349_A_Col5a2
  gRNA
uguccggugugcccacaaac

SEQ ID NO: 11350 - RNA, 20 nt, Artificial Sequence
  MKO10011350_A_Col5a2
  gRNA
aaaauacuuacugcaggucc

SEQ ID NO: 11351 - RNA, 20 nt, Artificial Sequence
  MKO10011351_A_Col5a2
  gRNA
guuuagguaacagguauacg

SEQ ID NO: 11352 - RNA, 20 nt, Artificial Sequence
  MKO10011352_A_Col5a3
  gRNA
acccucgauuccacaaccac

SEQ ID NO: 11353 - RNA, 20 nt, Artificial Sequence
  MKO10011353_A_Col5a3
  gRNA
ccucgguuuauaaguacagc

SEQ ID NO: 11354 - RNA, 20 nt, Artificial Sequence
  MKO10011354_A_Col5a3
  gRNA
ccagcuguacuuauaaaccg

SEQ ID NO: 11355 - RNA, 20 nt, Artificial Sequence
  MKO10011355_A_Col6a1
  gRNA
auucuucgugcucgacaccu

SEQ ID NO: 11356 - RNA, 20 nt, Artificial Sequence
  MKO10011356_A_Col6a1
  gRNA
caccgacugcgccauuaaga

SEQ ID NO: 11357 - RNA, 20 nt, Artificial Sequence
  MKO10011357_A_Col6a1
  gRNA
agcacgaagaauagauccac

SEQ ID NO: 11358 - RNA, 20 nt, Artificial Sequence
  MKO10011358_A_Col6a2
  gRNA
agucaacguguauuucgugu

SEQ ID NO: 11359 - RNA, 20 nt, Artificial Sequence
  MKO10011359_A_Col6a2
  gRNA
ggggguggucaacuucgccg

SEQ ID NO: 11360 - RNA, 20 nt, Artificial Sequence
  MKO10011360_A_Col6a2
  gRNA
ugguucacccauguugcccu

SEQ ID NO: 11361 - RNA, 20 nt, Artificial Sequence
  MKO10011361_A_Col6a3
  gRNA
ggauaacgugcagcaguucc

SEQ ID NO: 11362 - RNA, 20 nt, Artificial Sequence
  MKO10011362_A_Col6a3
  gRNA
gaacccccucagcggcccua

SEQ ID NO: 11363 - RNA, 20 nt, Artificial Sequence
  MKO10011363_A_Col6a3
  gRNA
gcugcacguuauccucgaug

SEQ ID NO: 11364 - RNA, 20 nt, Artificial Sequence
  MKO10011364_A_Col6a4
  gRNA
ggaccacauucgcgaaccug

SEQ ID NO: 11365 - RNA, 20 nt, Artificial Sequence
  MKO10011365_A_Col6a4
  gRNA
cuaucugcuguacgccccga

SEQ ID NO: 11366 - RNA, 20 nt, Artificial Sequence
  MKO10011366_A_Col6a4
  gRNA
cacaaguaccggaagcgccc

SEQ ID NO: 11367 - RNA, 20 nt, Artificial Sequence
  MKO10011367_A_Col6a5
  gRNA
ccauccguguagcgagagac

SEQ ID NO: 11368 - RNA, 20 nt, Artificial Sequence
  MKO10011368_A_Col6a5
  gRNA
guuugccucgccaaucccga

SEQ ID NO: 11369 - RNA, 20 nt, Artificial Sequence
  MKO10011369_A_Col6a5
  gRNA
gccaaccacguugauaagac

SEQ ID NO: 11370 - RNA, 20 nt, Artificial Sequence
  MKO10011370_A_Col6a6
  gRNA
agcugucaaccuccggcggg

SEQ ID NO: 11371 - RNA, 20 nt, Artificial Sequence
  MKO10011371_A_Col6a6
  gRNA
ccgugcaguacgccgacacc

SEQ ID NO: 11372 - RNA, 20 nt, Artificial Sequence
  MKO10011372_A_Col6a6
  gRNA
gcgaucuucuccagcucguc

SEQ ID NO: 11373 - RNA, 20 nt, Artificial Sequence
  MKO10011373_A_Col7a1
  gRNA
agcaacuuucgagaagugcg

SEQ ID NO: 11374 - RNA, 20 nt, Artificial Sequence
  MKO10011374_A_Col7a1
  gRNA
gacaucguguucuuacucga

SEQ ID NO: 11375 - RNA, 20 nt, Artificial Sequence
  MKO10011375_A_Col7a1
  gRNA
aaucaagaaugccgacccug

SEQ ID NO: 11376 - RNA, 20 nt, Artificial Sequence
  MKO10011376_A_Col8a1
  gRNA
ccacuagguccuacgauccc

SEQ ID NO: 11377 - RNA, 20 nt, Artificial Sequence
  MKO10011377_A_Col8a1
  gRNA
auaccgggcuuuccaauucc

SEQ ID NO: 11378 - RNA, 20 nt, Artificial Sequence
  MKO10011378_A_Col8a1
  gRNA
acaccuaccccaauauauga

SEQ ID NO: 11379 - RNA, 20 nt, Artificial Sequence
  MKO10011379_A_Col8a2
  gRNA
cuuguauucgucguacgugu

SEQ ID NO: 11380 - RNA, 20 nt, Artificial Sequence
  MKO10011380_A_Col8a2
  gRNA
cgugggaccgccuuuccgag

SEQ ID NO: 11381 - RNA, 20 nt, Artificial Sequence
  MKO10011381_A_Col8a2
  gRNA
cauggacccccuggaccgac

SEQ ID NO: 11382 - RNA, 20 nt, Artificial Sequence
  MKO10011382_A_Col9a1
  gRNA
gcauaagcucaugauuggcg

SEQ ID NO: 11383 - RNA, 20 nt, Artificial Sequence
  MKO10011383_A_Col9a1
  gRNA
ugcacgacgcuuaagaguug

SEQ ID NO: 11384 - RNA, 20 nt, Artificial Sequence
  MKO10011384_A_Col9a1
  gRNA
caucucgaaggacuauccag

SEQ ID NO: 11385 - RNA, 20 nt, Artificial Sequence
  MKO10011385_A_Col9a2
  gRNA
acgucgaugccaucugaacc

SEQ ID NO: 11386 - RNA, 20 nt, Artificial Sequence
  MKO10011386_A_Col9a2
  gRNA
accggaggaccaacuuuacc

SEQ ID NO: 11387 - RNA, 20 nt, Artificial Sequence
  MKO10011387_A_Col9a2
  gRNA
uccagguaaaguugguccuc

SEQ ID NO: 11388 - RNA, 20 nt, Artificial Sequence
  MKO10011388_A_Col9a3
  gRNA
uuucagaaagugggaccccg

SEQ ID NO: 11389 - RNA, 20 nt, Artificial Sequence
  MKO10011389_A_Col9a3
  gRNA
uagacacuuacccguucucc

SEQ ID NO: 11390 - RNA, 20 nt, Artificial Sequence
  MKO10011390_A_Col9a3
  gRNA
gggacacuuacuggaaggcc

SEQ ID NO: 11391 - RNA, 20 nt, Artificial Sequence
  MKO10011391_A_Colec10
  gRNA
ccaguuguccaaccacuuuc

SEQ ID NO: 11392 - RNA, 20 nt, Artificial Sequence
  MKO10011392_A_Colec10
  gRNA
augggagcccaggguaauau

SEQ ID NO: 11393 - RNA, 20 nt, Artificial Sequence
  MKO10011393_A_Colec10
  gRNA
gucuggcccuauuggcaaga

SEQ ID NO: 11394 - RNA, 20 nt, Artificial Sequence
  MKO10011394_A_Colec11
  gRNA
ccaggaagagucggcccuac

SEQ ID NO: 11395 - RNA, 20 nt, Artificial Sequence
  MKO10011395_A_Colec11
  gRNA
ccgacucuuccuggccgucc

SEQ ID NO: 11396 - RNA, 20 nt, Artificial Sequence
  MKO10011396_A_Colec11
  gRNA
aucggacccccuggccccag

SEQ ID NO: 11397 - RNA, 20 nt, Artificial Sequence
  MKO10011397_A_Colec12
  gRNA
aucauucuuaauucgcugga

SEQ ID NO: 11398 - RNA, 20 nt, Artificial Sequence
  MKO10011398_A_Colec12
  gRNA
cacacuagucaacauccgcu

SEQ ID NO: 11399 - RNA, 20 nt, Artificial Sequence
  MKO10011399_A_Colec12
  gRNA
accaaaccucuuguaaccga

SEQ ID NO: 11400 - RNA, 20 nt, Artificial Sequence
  MKO10011400_A_Colgalt2
  gRNA
cuccagcaugggcgccacga

SEQ ID NO: 11401 - RNA, 20 nt, Artificial Sequence
  MKO10011401_A_Colgalt2
  gRNA
gcagcguuuguaucacuaug

SEQ ID NO: 11402 - RNA, 20 nt, Artificial Sequence
  MKO10011402_A_Colgalt2
  gRNA
ggggucuauacucuaacuuc

SEQ ID NO: 11403 - RNA, 20 nt, Artificial Sequence
  MKO10011403_A_Colq
  gRNA
uucccaccgccguucuucag

SEQ ID NO: 11404 - RNA, 20 nt, Artificial Sequence
  MKO10011404_A_Colq
  gRNA
gugacgccucaaguuccaga

SEQ ID NO: 11405 - RNA, 20 nt, Artificial Sequence
  MKO10011405_A_Colq
  gRNA
gccgagcgagccuugaaugc

SEQ ID NO: 11406 - RNA, 20 nt, Artificial Sequence
  MKO10011406_A_Commd10
  gRNA
acccauagccgaccaagcac

SEQ ID NO: 11407 - RNA, 20 nt, Artificial Sequence
  MKO10011407_A_Commd10
  gRNA
auggcagcuuaaccugcaaa

SEQ ID NO: 11408 - RNA, 20 nt, Artificial Sequence
  MKO10011408_A_Commd10
  gRNA
ccuguaccuugugagggccc

SEQ ID NO: 11409 - RNA, 20 nt, Artificial Sequence
  MKO10011409_A_Commd1
  gRNA
cuuagccauggcgggcgauc

SEQ ID NO: 11410 - RNA, 20 nt, Artificial Sequence
  MKO10011410_A_Commd1
  gRNA
acccuccagaucgcccgcca

SEQ ID NO: 11411 - RNA, 20 nt, Artificial Sequence
  MKO10011411_A_Commd1
  gRNA
cccgaaggccguugucccag

SEQ ID NO: 11412 - RNA, 20 nt, Artificial Sequence
  MKO10011412_A_Commd2
  gRNA
gcggcgccuucguagaucuu

SEQ ID NO: 11413 - RNA, 20 nt, Artificial Sequence
  MKO10011413_A_Commd2
  gRNA
guugcaguggucgccgaguu

SEQ ID NO: 11414 - RNA, 20 nt, Artificial Sequence
  MKO10011414_A_Commd2
  gRNA
cugaucgaggugcagcuuua

SEQ ID NO: 11415 - RNA, 20 nt, Artificial Sequence
  MKO10011415_A_Commd3
  gRNA
aaaacaguucuauucgcucu

SEQ ID NO: 11416 - RNA, 20 nt, Artificial Sequence
  MKO10011416_A_Commd3
  gRNA
cuugaaacagaucgacccag

SEQ ID NO: 11417 - RNA, 20 nt, Artificial Sequence
  MKO10011417_A_Commd3
  gRNA
gaauucucuagaaacccuac

SEQ ID NO: 11418 - RNA, 20 nt, Artificial Sequence
  MKO10011418_A_Commd4
  gRNA
gaaacucagcaccgcgaccg

SEQ ID NO: 11419 - RNA, 20 nt, Artificial Sequence
  MKO10011419_A_Commd4
  gRNA
cgaucuggacugucccgacu

SEQ ID NO: 11420 - RNA, 20 nt, Artificial Sequence
  MKO10011420_A_Commd4
  gRNA
aucacugucgacacuaugcu

SEQ ID NO: 11421 - RNA, 20 nt, Artificial Sequence
  MKO10011421_A_Commd5
  gRNA
gcugcgcuacagcguggcgu

SEQ ID NO: 11422 - RNA, 20 nt, Artificial Sequence
  MKO10011422_A_Commd5
  gRNA
auucgacacacgaggcagcg

SEQ ID NO: 11423 - RNA, 20 nt, Artificial Sequence
  MKO10011423_A_Commd5
  gRNA
ugccucgugugucgaauuuc

SEQ ID NO: 11424 - RNA, 20 nt, Artificial Sequence
  MKO10011424_A_Commd6
  gRNA
uccguuccaggucacgggcc

SEQ ID NO: 11425 - RNA, 20 nt, Artificial Sequence
  MKO10011425_A_Commd6
  gRNA
gcccgugcuggaugccaagu

SEQ ID NO: 11426 - RNA, 20 nt, Artificial Sequence
  MKO10011426_A_Commd6
  gRNA
gaugacaauuccacaauuuc

SEQ ID NO: 11427 - RNA, 20 nt, Artificial Sequence
  MKO10011427_A_Commd7
  gRNA
cggacugaucuccagacgcu

SEQ ID NO: 11428 - RNA, 20 nt, Artificial Sequence
  MKO10011428_A_Commd7
  gRNA
acgccucgacccuugcacag

SEQ ID NO: 11429 - RNA, 20 nt, Artificial Sequence
  MKO10011429_A_Commd7
  gRNA
uucucuuacaggucuuagcg

SEQ ID NO: 11430 - RNA, 20 nt, Artificial Sequence
  MKO10011430_A_Commd8
  gRNA
uaccuuauuagcggccucca

SEQ ID NO: 11431 - RNA, 20 nt, Artificial Sequence
  MKO10011431_A_Commd8
  gRNA
ccgagcuuauccugcccacc

SEQ ID NO: 11432 - RNA, 20 nt, Artificial Sequence
  MKO10011432_A_Commd8
  gRNA
uauuucuugugcgcagcugc

SEQ ID NO: 11433 - RNA, 20 nt, Artificial Sequence
  MKO10011433_A_Commd9
  gRNA
agcuggagcacgucuuaucu

SEQ ID NO: 11434 - RNA, 20 nt, Artificial Sequence
  MKO10011434_A_Commd9
  gRNA
uucugagucaaggcaugaac

SEQ ID NO: 11435 - RNA, 20 nt, Artificial Sequence
  MKO10011435_A_Commd9
  gRNA
caugcggcugauguugucag

SEQ ID NO: 11436 - RNA, 20 nt, Artificial Sequence
  MKO10011436_A_Comp
  gRNA
cccgcgcaccucauuaacgu

SEQ ID NO: 11437 - RNA, 20 nt, Artificial Sequence
  MKO10011437_A_Comp
  gRNA
guucagcggacccacccacg

SEQ ID NO: 11438 - RNA, 20 nt, Artificial Sequence
  MKO10011438_A_Comp
  gRNA
uauugaugcaccgcacccgc

SEQ ID NO: 11439 - RNA, 20 nt, Artificial Sequence
  MKO10011439_A_Comtd1
  gRNA
gggcucugcgucaaccucgc

SEQ ID NO: 11440 - RNA, 20 nt, Artificial Sequence
  MKO10011440_A_Comtd1
  gRNA
gcuuccggaggcuggccgcg

SEQ ID NO: 11441 - RNA, 20 nt, Artificial Sequence
  MKO10011441_A_Comtd1
  gRNA
cuuaaugagccgcgccaggu

SEQ ID NO: 11442 - RNA, 20 nt, Artificial Sequence
  MKO10011442_A_Comt
  gRNA
augaacgugggugacgcaaa

SEQ ID NO: 11443 - RNA, 20 nt, Artificial Sequence
  MKO10011443_A_Comt
  gRNA
gcaccguccccuugcgcagc

SEQ ID NO: 11444 - RNA, 20 nt, Artificial Sequence
  MKO10011444_A_Comt
  gRNA
ugcucccccucacauacgcc

SEQ ID NO: 11445 - RNA, 20 nt, Artificial Sequence
  MKO10011445_A_Copa
  gRNA
acauccgauagucccauaac

SEQ ID NO: 11446 - RNA, 20 nt, Artificial Sequence
  MKO10011446_A_Copa
  gRNA
caugauggaaaaacguugua

SEQ ID NO: 11447 - RNA, 20 nt, Artificial Sequence
  MKO10011447_A_Copa
  gRNA
ccucagaugaucagaccauu

SEQ ID NO: 11448 - RNA, 20 nt, Artificial Sequence
  MKO10011448_A_Copb1
  gRNA
caccccaaugaguuuauucg

SEQ ID NO: 11449 - RNA, 20 nt, Artificial Sequence
  MKO10011449_A_Copb1
  gRNA
gaugcuaauucacgcagauc

SEQ ID NO: 11450 - RNA, 20 nt, Artificial Sequence
  MKO10011450_A_Copb1
  gRNA
gacgauguuccaagcacgca

SEQ ID NO: 11451 - RNA, 20 nt, Artificial Sequence
  MKO10011451_A_Copb2
  gRNA
uugccagugcaucucucgac

SEQ ID NO: 11452 - RNA, 20 nt, Artificial Sequence
  MKO10011452_A_Copb2
  gRNA
gcaaauccacgcucuuaacu

SEQ ID NO: 11453 - RNA, 20 nt, Artificial Sequence
  MKO10011453_A_Copb2
  gRNA
cucuugaugucaagucgaag

SEQ ID NO: 11454 - RNA, 20 nt, Artificial Sequence
  MKO10011454_A_Cope
  gRNA
accacucaaggccgucgccc

SEQ ID NO: 11455 - RNA, 20 nt, Artificial Sequence
  MKO10011455_A_Cope
  gRNA
accguagaggaaguauggcg

SEQ ID NO: 11456 - RNA, 20 nt, Artificial Sequence
  MKO10011456_A_Cope
  gRNA
auacagagcauaccucgcac

SEQ ID NO: 11457 - RNA, 20 nt, Artificial Sequence
  MKO10011457_A_Copg1
  gRNA
gaagagugccguacuccaag

SEQ ID NO: 11458 - RNA, 20 nt, Artificial Sequence
  MKO10011458_A_Copg1
  gRNA
cuugucgaauuucuucaaca

SEQ ID NO: 11459 - RNA, 20 nt, Artificial Sequence
  MKO10011459_A_Copg1
  gRNA
ggcacuugccucuuggagua

SEQ ID NO: 11460 - RNA, 20 nt, Artificial Sequence
  MKO10011460_A_Copg2
  gRNA
guaacuugcagcaaacgcug

SEQ ID NO: 11461 - RNA, 20 nt, Artificial Sequence
  MKO10011461_A_Copg2
  gRNA
caaucgagucauugcaaaga

SEQ ID NO: 11462 - RNA, 20 nt, Artificial Sequence
  MKO10011462_A_Copg2
  gRNA
gauucuuuacuuacucaacc

SEQ ID NO: 11463 - RNA, 20 nt, Artificial Sequence
  MKO10011463_A_Coprs
  gRNA
gucgcgcucaccuccgcgcu

SEQ ID NO: 11464 - RNA, 20 nt, Artificial Sequence
  MKO10011464_A_Coprs
  gRNA
acaugauauacgaccccagu

SEQ ID NO: 11465 - RNA, 20 nt, Artificial Sequence
  MKO10011465_A_Coprs
  gRNA
uucgcaggaggcccccagcg

SEQ ID NO: 11466 - RNA, 20 nt, Artificial Sequence
  MKO10011466_A_Cops2
  gRNA
ggugacugcacuccgaauau

SEQ ID NO: 11467 - RNA, 20 nt, Artificial Sequence
  MKO10011467_A_Cops2
  gRNA
agcaacuauugaccuauauu

SEQ ID NO: 11468 - RNA, 20 nt, Artificial Sequence
  MKO10011468_A_Cops2
  gRNA
agcauuaagcagcuuccaaa

SEQ ID NO: 11469 - RNA, 20 nt, Artificial Sequence
  MKO10011469_A_Cops3
  gRNA
gagaauaguguuucgaaguc

SEQ ID NO: 11470 - RNA, 20 nt, Artificial Sequence
  MKO10011470_A_Cops3
  gRNA
ugcgaagaacuugucccauc

SEQ ID NO: 11471 - RNA, 20 nt, Artificial Sequence
  MKO10011471_A_Cops3
  gRNA
uaaggaugccaauuccucga

SEQ ID NO: 11472 - RNA, 20 nt, Artificial Sequence
  MKO10011472_A_Cops4
  gRNA
guacaacguagauuauaagc

SEQ ID NO: 11473 - RNA, 20 nt, Artificial Sequence
  MKO10011473_A_Cops4
  gRNA
gcaguugccgugagaucacg

SEQ ID NO: 11474 - RNA, 20 nt, Artificial Sequence
  MKO10011474_A_Cops4
  gRNA
ggaggaugacgaucccgucc

SEQ ID NO: 11475 - RNA, 20 nt, Artificial Sequence
  MKO10011475_A_Cops5
  gRNA
aagugaaucuuggcgccuuu

SEQ ID NO: 11476 - RNA, 20 nt, Artificial Sequence
  MKO10011476_A_Cops5
  gRNA
uugaugcucgggaaagucga

SEQ ID NO: 11477 - RNA, 20 nt, Artificial Sequence
  MKO10011477_A_Cops5
  gRNA
ggccgccuugagaaugcaau

SEQ ID NO: 11478 - RNA, 20 nt, Artificial Sequence
  MKO10011478_A_Cops6
  gRNA
ucuauaccugcuuauggacg

SEQ ID NO: 11479 - RNA, 20 nt, Artificial Sequence
  MKO10011479_A_Cops6
  gRNA
auccgcaugcgcucccagga

SEQ ID NO: 11480 - RNA, 20 nt, Artificial Sequence
  MKO10011480_A_Cops6
  gRNA
uuuaacaguccccagcguga

SEQ ID NO: 11481 - RNA, 20 nt, Artificial Sequence
  MKO10011481_A_Cops7a
  gRNA
ccuucgaaacgugcgccagc

SEQ ID NO: 11482 - RNA, 20 nt, Artificial Sequence
  MKO10011482_A_Cops7a
  gRNA
ccucuagccgcugauugcgc

SEQ ID NO: 11483 - RNA, 20 nt, Artificial Sequence
  MKO10011483_A_Cops7a
  gRNA
gccccuggugucuacguguu

SEQ ID NO: 11484 - RNA, 20 nt, Artificial Sequence
  MKO10011484_A_Cops7b
  gRNA
gcaucuuaccaucgugagcu

SEQ ID NO: 11485 - RNA, 20 nt, Artificial Sequence
  MKO10011485_A_Cops7b
  gRNA
uugucaagaccuugcaugag

SEQ ID NO: 11486 - RNA, 20 nt, Artificial Sequence
  MKO10011486_A_Cops7b
  gRNA
ucuugaugccaagcucacga

SEQ ID NO: 11487 - RNA, 20 nt, Artificial Sequence
  MKO10011487_A_Cops8
  gRNA
gugcuacuuacaugucguuc

SEQ ID NO: 11488 - RNA, 20 nt, Artificial Sequence
  MKO10011488_A_Cops8
  gRNA
gcuagaagcugaccguacac

SEQ ID NO: 11489 - RNA, 20 nt, Artificial Sequence
  MKO10011489_A_Cops8
  gRNA
ggucaguuggacagcgaauc

SEQ ID NO: 11490 - RNA, 20 nt, Artificial Sequence
  MKO10011490_A_Copz1
  gRNA
augaccuacuauccguccga

SEQ ID NO: 11491 - RNA, 20 nt, Artificial Sequence
  MKO10011491_A_Copz1
  gRNA
aucucaccuuggcgaagagu

SEQ ID NO: 11492 - RNA, 20 nt, Artificial Sequence
  MKO10011492_A_Copz1
  gRNA
cccaggugaaaucgcucugu

SEQ ID NO: 11493 - RNA, 20 nt, Artificial Sequence
  MKO10011493_A_Copz2
  gRNA
ggccuuacuuucggugcggc

SEQ ID NO: 11494 - RNA, 20 nt, Artificial Sequence
  MKO10011494_A_Copz2
  gRNA
gggaucuuccuccgagaaug

SEQ ID NO: 11495 - RNA, 20 nt, Artificial Sequence
  MKO10011495_A_Copz2
  gRNA
gucucacuuaccuuaagaug

SEQ ID NO: 11496 - RNA, 20 nt, Artificial Sequence
  MKO10011496_A_Coq10a
  gRNA
aguaccgagaguucgugccg

SEQ ID NO: 11497 - RNA, 20 nt, Artificial Sequence
  MKO10011497_A_Coq10a
  gRNA
cgaguaagccuuucgcuugu

SEQ ID NO: 11498 - RNA, 20 nt, Artificial Sequence
  MKO10011498_A_Coq10a
  gRNA
uuacucggagcguaggauca

SEQ ID NO: 11499 - RNA, 20 nt, Artificial Sequence
  MKO10011499_A_Coq10b
  gRNA
gggggucugcgcgcgacguc

SEQ ID NO: 11500 - RNA, 20 nt, Artificial Sequence
  MKO10011500_A_Coq10b
  gRNA
uucuaggcaucuuguacuga

SEQ ID NO: 11501 - RNA, 20 nt, Artificial Sequence
  MKO10011501_A_Coq10b
  gRNA
ucgcgcgcagacccccgcgc

SEQ ID NO: 11502 - RNA, 20 nt, Artificial Sequence
  MKO10011502_A_Coq2
  gRNA
gcaaaccgcccaaucgcugc

SEQ ID NO: 11503 - RNA, 20 nt, Artificial Sequence
  MKO10011503_A_Coq2
  gRNA
agugauaacauguaccaguc

SEQ ID NO: 11504 - RNA, 20 nt, Artificial Sequence
  MKO10011504_A_Coq2
  gRNA
uccuguguuuaaacuacuac

SEQ ID NO: 11505 - RNA, 20 nt, Artificial Sequence
  MKO10011505_A_Coq3
  gRNA
gggaugaagauucuugacgu

SEQ ID NO: 11506 - RNA, 20 nt, Artificial Sequence
  MKO10011506_A_Coq3
  gRNA
ccguguucaccgaguuccca

SEQ ID NO: 11507 - RNA, 20 nt, Artificial Sequence
  MKO10011507_A_Coq3
  gRNA
accuaaugaauggcacccgu

SEQ ID NO: 11508 - RNA, 20 nt, Artificial Sequence
  MKO10011508_A_Coq4
  gRNA
aaccgucuuaccguggcgau

SEQ ID NO: 11509 - RNA, 20 nt, Artificial Sequence
  MKO10011509_A_Coq4
  gRNA
cgugcacuucacgguaccuc

SEQ ID NO: 11510 - RNA, 20 nt, Artificial Sequence
  MKO10011510_A_Coq4
  gRNA
ucaucguccacaaagcgugu

SEQ ID NO: 11511 - RNA, 20 nt, Artificial Sequence
  MKO10011511_A_Coq5
  gRNA
acguucaggcacaacaucag

SEQ ID NO: 11512 - RNA, 20 nt, Artificial Sequence
  MKO10011512_A_Coq5
  gRNA
guugugccugaacguaacua

SEQ ID NO: 11513 - RNA, 20 nt, Artificial Sequence
  MKO10011513_A_Coq5
  gRNA
cuccagccaugucgagcagc

SEQ ID NO: 11514 - RNA, 20 nt, Artificial Sequence
  MKO10011514_A_Coq6
  gRNA
gucccugucgaacauuauca

SEQ ID NO: 11515 - RNA, 20 nt, Artificial Sequence
  MKO10011515_A_Coq6
  gRNA
uucuccugcagaucgaguga

SEQ ID NO: 11516 - RNA, 20 nt, Artificial Sequence
  MKO10011516_A_Coq6
  gRNA
ugccaucaccuaggguaaua

SEQ ID NO: 11517 - RNA, 20 nt, Artificial Sequence
  MKO10011517_A_Coq7
  gRNA
cacccgaauuauucgaucca

SEQ ID NO: 11518 - RNA, 20 nt, Artificial Sequence
  MKO10011518_A_Coq7
  gRNA
caucaagcaguuucgcgaug

SEQ ID NO: 11519 - RNA, 20 nt, Artificial Sequence
  MKO10011519_A_Coq7
  gRNA
aacacugguccgaccgagca

SEQ ID NO: 11520 - RNA, 20 nt, Artificial Sequence
  MKO10011520_A_Coq9
  gRNA
gugcaaugcucgccucaacc

SEQ ID NO: 11521 - RNA, 20 nt, Artificial Sequence
  MKO10011521_A_Coq9
  gRNA
caccagagcuggucggcagc

SEQ ID NO: 11522 - RNA, 20 nt, Artificial Sequence
  MKO10011522_A_Coq9
  gRNA
gccaucgcucccaaacaugc

SEQ ID NO: 11523 - RNA, 20 nt, Artificial Sequence
  MKO10011523_A_Corin
  gRNA
cacgaugagggcgcagaugc

SEQ ID NO: 11524 - RNA, 20 nt, Artificial Sequence
  MKO10011524_A_Corin
  gRNA
cgaggcuacagccgaagagc

SEQ ID NO: 11525 - RNA, 20 nt, Artificial Sequence
  MKO10011525_A_Corin
  gRNA
uucccugagugcguuguuga

SEQ ID NO: 11526 - RNA, 20 nt, Artificial Sequence
  MKO10011526_A_Coro1a
  gRNA
ugacacgaacucgcuuguca

SEQ ID NO: 11527 - RNA, 20 nt, Artificial Sequence
  MKO10011527_A_Coro1a
  gRNA
cgugucaucgagccucgcaa

SEQ ID NO: 11528 - RNA, 20 nt, Artificial Sequence
  MKO10011528_A_Coro1a
  gRNA
aguagacaagaacgugcccc

SEQ ID NO: 11529 - RNA, 20 nt, Artificial Sequence
  MKO10011529_A_Coro1b
  gRNA
gcguccgaaucaucgauccu

SEQ ID NO: 11530 - RNA, 20 nt, Artificial Sequence
  MKO10011530_A_Coro1b
  gRNA
cgaggggcauaccaagcgcg

SEQ ID NO: 11531 - RNA, 20 nt, Artificial Sequence
  MKO10011531_A_Coro1b
  gRNA
ggugauaaugcccacgcgcu

SEQ ID NO: 11532 - RNA, 20 nt, Artificial Sequence
  MKO10011532_A_Coro1c
  gRNA
ccaacagguuuggcagaucc

SEQ ID NO: 11533 - RNA, 20 nt, Artificial Sequence
  MKO10011533_A_Coro1c
  gRNA
ccccacguuccagaugauaa

SEQ ID NO: 11534 - RNA, 20 nt, Artificial Sequence
  MKO10011534_A_Coro1c
  gRNA
cgccacaaucuccuguuucc

SEQ ID NO: 11535 - RNA, 20 nt, Artificial Sequence
  MKO10011535_A_Coro2a
  gRNA
cggauuguugacccccgacu

SEQ ID NO: 11536 - RNA, 20 nt, Artificial Sequence
  MKO10011536_A_Coro2a
  gRNA
guaccucccgcuggaacaac

SEQ ID NO: 11537 - RNA, 20 nt, Artificial Sequence
  MKO10011537_A_Coro2a
  gRNA
ggucaacaauccgaaucuug

SEQ ID NO: 11538 - RNA, 20 nt, Artificial Sequence
  MKO10011538_A_Coro2b
  gRNA
cgugugauugaaccccgauc

SEQ ID NO: 11539 - RNA, 20 nt, Artificial Sequence
  MKO10011539_A_Coro2b
  gRNA
cggucaucagggcaacgugc

SEQ ID NO: 11540 - RNA, 20 nt, Artificial Sequence
  MKO10011540_A_Coro2b
  gRNA
aguaccgcaguuccaaguuu

SEQ ID NO: 11541 - RNA, 20 nt, Artificial Sequence
  MKO10011541_A_Coro6
  gRNA
acgucauccacagcgugugu

SEQ ID NO: 11542 - RNA, 20 nt, Artificial Sequence
  MKO10011542_A_Coro6
  gRNA
ccaugagccggcguguuguu

SEQ ID NO: 11543 - RNA, 20 nt, Artificial Sequence
  MKO10011543_A_Coro6
  gRNA
cgucaggguguaugucgucc

SEQ ID NO: 11544 - RNA, 20 nt, Artificial Sequence
  MKO10011544_A_Coro7
  gRNA
agcacgaauaucacugaucc

SEQ ID NO: 11545 - RNA, 20 nt, Artificial Sequence
  MKO10011545_A_Coro7
  gRNA
gcuuucaacucugaccgccc

SEQ ID NO: 11546 - RNA, 20 nt, Artificial Sequence
  MKO10011546_A_Coro7
  gRNA
caccagaacaccgucuacag

SEQ ID NO: 11547 - RNA, 20 nt, Artificial Sequence
  MKO10011547_A_Cort
  gRNA
cccggggguacccccuccga

SEQ ID NO: 11548 - RNA, 20 nt, Artificial Sequence
  MKO10011548_A_Cort
  gRNA
agggugggguuacuugcacg

SEQ ID NO: 11549 - RNA, 20 nt, Artificial Sequence
  MKO10011549_A_Cort
  gRNA
ccgaggaugauggguggccg

SEQ ID NO: 11550 - RNA, 20 nt, Artificial Sequence
  MKO10011550_A_Cotl1
  gRNA
acgacggcucggcggucauc

SEQ ID NO: 11551 - RNA, 20 nt, Artificial Sequence
  MKO10011551_A_Cotl1
  gRNA
cucugacugagcgucguagu

SEQ ID NO: 11552 - RNA, 20 nt, Artificial Sequence
  MKO10011552_A_Cotl1
  gRNA
gcgcggcguacaacuuagug

SEQ ID NO: 11553 - RNA, 20 nt, Artificial Sequence
  MKO10011553_A_Cox10
  gRNA
uggcuccaggcccuuucgac

SEQ ID NO: 11554 - RNA, 20 nt, Artificial Sequence
  MKO10011554_A_Cox10
  gRNA
gucgagggaaugguccacua

SEQ ID NO: 11555 - RNA, 20 nt, Artificial Sequence
  MKO10011555_A_Cox10
  gRNA
aggaugcgaggccgguucca

SEQ ID NO: 11556 - RNA, 20 nt, Artificial Sequence
  MKO10011556_A_Cox11
  gRNA
acucguccuccugcgcgcgc

SEQ ID NO: 11557 - RNA, 20 nt, Artificial Sequence
  MKO10011557_A_Cox11
  gRNA
gacauggaagcgcccgugcg

SEQ ID NO: 11558 - RNA, 20 nt, Artificial Sequence
  MKO10011558_A_Cox11
  gRNA
caggcaccauguucucgauc

SEQ ID NO: 11559 - RNA, 20 nt, Artificial Sequence
  MKO10011559_A_Cox14
  gRNA
gaaggucuuguagccgauau

SEQ ID NO: 11560 - RNA, 20 nt, Artificial Sequence
  MKO10011560_A_Cox14
  gRNA
gccaagcagcuagccgauau

SEQ ID NO: 11561 - RNA, 20 nt, Artificial Sequence
  MKO10011561_A_Cox14
  gRNA
gccuggcacugcgcagcugg

SEQ ID NO: 11562 - RNA, 20 nt, Artificial Sequence
  MKO10011562_A_Cox15
  gRNA
auuccgccagcgucauguca

SEQ ID NO: 11563 - RNA, 20 nt, Artificial Sequence
  MKO10011563_A_Cox15
  gRNA
ggacguguucucgcccucug

SEQ ID NO: 11564 - RNA, 20 nt, Artificial Sequence
  MKO10011564_A_Cox15
  gRNA
ccgagcgggcggugggccga

SEQ ID NO: 11565 - RNA, 20 nt, Artificial Sequence
  MKO10011565_A_Cox16
  gRNA
auauucgagguccgaggccu

SEQ ID NO: 11566 - RNA, 20 nt, Artificial Sequence
  MKO10011566_A_Cox16
  gRNA
acgcagagcucgcaacacag

SEQ ID NO: 11567 - RNA, 20 nt, Artificial Sequence
  MKO10011567_A_Cox16
  gRNA
aagaacaagacucuacgcua

SEQ ID NO: 11568 - RNA, 20 nt, Artificial Sequence
  MKO10011568_A_Cox17
  gRNA
gggcuagcggccgccagucc

SEQ ID NO: 11569 - RNA, 20 nt, Artificial Sequence
  MKO10011569_A_Cox17
  gRNA
ccacgcaucacgcgccuucu

SEQ ID NO: 11570 - RNA, 20 nt, Artificial Sequence
  MKO10011570_A_Cox17
  gRNA
gugcccucaugcacuccuug

SEQ ID NO: 11571 - RNA, 20 nt, Artificial Sequence
  MKO10011571_A_Cox18
  gRNA
accgaagcggcugcccauac

SEQ ID NO: 11572 - RNA, 20 nt, Artificial Sequence
  MKO10011572_A_Cox18
  gRNA
cgccuaucagcacuacaucc

SEQ ID NO: 11573 - RNA, 20 nt, Artificial Sequence
  MKO10011573_A_Cox18
  gRNA
ucaccgcaguggauuccacc

SEQ ID NO: 11574 - RNA, 20 nt, Artificial Sequence
  MKO10011574_A_Cox19
  gRNA
gcucggcuuuagagaccuaa

SEQ ID NO: 11575 - RNA, 20 nt, Artificial Sequence
  MKO10011575_A_Cox19
  gRNA
augucgaccgcaaugaacuu

SEQ ID NO: 11576 - RNA, 20 nt, Artificial Sequence
  MKO10011576_A_Cox19
  gRNA
uuuggucccgaaguucauug

SEQ ID NO: 11577 - RNA, 20 nt, Artificial Sequence
  MKO10011577_A_Cox20
  gRNA
gcucgagaaucuauacucua

SEQ ID NO: 11578 - RNA, 20 nt, Artificial Sequence
  MKO10011578_A_Cox20
  gRNA
gccccacgagacggagaaaa

SEQ ID NO: 11579 - RNA, 20 nt, Artificial Sequence
  MKO10011579_A_Cox20
  gRNA
aguauagauucucgagcaca

SEQ ID NO: 11580 - RNA, 20 nt, Artificial Sequence
  MKO10011580_A_Cox4i1
  gRNA
gucacgccgaucagcguaag

SEQ ID NO: 11581 - RNA, 20 nt, Artificial Sequence
  MKO10011581_A_Cox4i1
  gRNA
cggcgaagcucucguuaaac

SEQ ID NO: 11582 - RNA, 20 nt, Artificial Sequence
  MKO10011582_A_Cox4i1
  gRNA
ucacugcgcucguucugauu

SEQ ID NO: 11583 - RNA, 20 nt, Artificial Sequence
  MKO10011583_A_Cox4i2
  gRNA
gcgaugguucaucucugcga

SEQ ID NO: 11584 - RNA, 20 nt, Artificial Sequence
  MKO10011584_A_Cox4i2
  gRNA
gggcuuuccguucuuccguc

SEQ ID NO: 11585 - RNA, 20 nt, Artificial Sequence
  MKO10011585_A_Cox4i2
  gRNA
cguagggggucauccuccuc

SEQ ID NO: 11586 - RNA, 20 nt, Artificial Sequence
  MKO10011586_A_Cox5a
  gRNA
ccgucgcuguaccgcagccg

SEQ ID NO: 11587 - RNA, 20 nt, Artificial Sequence
  MKO10011587_A_Cox5a
  gRNA
gaccuuaccggcggcggggc

SEQ ID NO: 11588 - RNA, 20 nt, Artificial Sequence
  MKO10011588_A_Cox5a
  gRNA
auuaccuuuacgcaauuccc

SEQ ID NO: 11589 - RNA, 20 nt, Artificial Sequence
  MKO10011589_A_Cox5b
  gRNA
aggugguguccccacugaug

SEQ ID NO: 11590 - RNA, 20 nt, Artificial Sequence
  MKO10011590_A_Cox5b
  gRNA
ucacguaccuccagaagcca

SEQ ID NO: 11591 - RNA, 20 nt, Artificial Sequence
  MKO10011591_A_Cox5b
  gRNA
ucucgggcgagauggcuuca

SEQ ID NO: 11592 - RNA, 20 nt, Artificial Sequence
  MKO10011592_A_Cox6a1
  gRNA
cuaccuugguccugaugcgc

SEQ ID NO: 11593 - RNA, 20 nt, Artificial Sequence
  MKO10011593_A_Cox6a1
  gRNA
ugaggguaggcaacgaacgg

SEQ ID NO: 11594 - RNA, 20 nt, Artificial Sequence
  MKO10011594_A_Cox6a1
  gRNA
caugugaacccacuuccgac

SEQ ID NO: 11595 - RNA, 20 nt, Artificial Sequence
  MKO10011595_A_Cox6a2
  gRNA
ggcguaccuugguucggaug

SEQ ID NO: 11596 - RNA, 20 nt, Artificial Sequence
  MKO10011596_A_Cox6a2
  gRNA
cgugugguugccgucccccc

SEQ ID NO: 11597 - RNA, 20 nt, Artificial Sequence
  MKO10011597_A_Cox6a2
  gRNA
ccaccuccgcauccgaacca

SEQ ID NO: 11598 - RNA, 20 nt, Artificial Sequence
  MKO10011598_A_Cox6b1
  gRNA
uucagcuaugcggucauccc

SEQ ID NO: 11599 - RNA, 20 nt, Artificial Sequence
  MKO10011599_A_Cox6b1
  gRNA
agucccucugucccguguca

SEQ ID NO: 11600 - RNA, 20 nt, Artificial Sequence
  MKO10011600_A_Cox6b1
  gRNA
agagggacuuguacacacgc

SEQ ID NO: 11601 - RNA, 20 nt, Artificial Sequence
  MKO10011601_A_Cox6b2
  gRNA
gugaagaccaugaaucgccg

SEQ ID NO: 11602 - RNA, 20 nt, Artificial Sequence
  MKO10011602_A_Cox6b2
  gRNA
uacacggaaauaguacucgc

SEQ ID NO: 11603 - RNA, 20 nt, Artificial Sequence
  MKO10011603_A_Cox6b2
  gRNA
uuagggaagcgcggaucaaa

SEQ ID NO: 11604 - RNA, 20 nt, Artificial Sequence
  MKO10011604_A_Cox6c
  gRNA
gggaguugccgcugccuaua

SEQ ID NO: 11605 - RNA, 20 nt, Artificial Sequence
  MKO10011605_A_Cox6c
  gRNA
caacagcgcaccggaacuca

SEQ ID NO: 11606 - RNA, 20 nt, Artificial Sequence
  MKO10011606_A_Cox6c
  gRNA
cguggcugagccaagaaaga

SEQ ID NO: 11607 - RNA, 20 nt, Artificial Sequence
  MKO10011607_A_Cox7a1
  gRNA
cccccgccuuucaaguguac

SEQ ID NO: 11608 - RNA, 20 nt, Artificial Sequence
  MKO10011608_A_Cox7a1
  gRNA
gaccucccaguacacuugaa

SEQ ID NO: 11609 - RNA, 20 nt, Artificial Sequence
  MKO10011609_A_Cox7a1
  gRNA
ugccuacugcuuauacugcu

SEQ ID NO: 11610 - RNA, 20 nt, Artificial Sequence
  MKO10011610_A_Cox7a2l
  gRNA
uaauaauggaaccuuuguac

SEQ ID NO: 11611 - RNA, 20 nt, Artificial Sequence
  MKO10011611_A_Cox7a2l
  gRNA
aggccauguagagggcgauc

SEQ ID NO: 11612 - RNA, 20 nt, Artificial Sequence
  MKO10011612_A_Cox7a2l
  gRNA
gaugguuuccaccugaaacg

SEQ ID NO: 11613 - RNA, 20 nt, Artificial Sequence
  MKO10011613_A_Cox7a2
  gRNA
gccccgccuuucagaugaac

SEQ ID NO: 11614 - RNA, 20 nt, Artificial Sequence
  MKO10011614_A_Cox7a2
  gRNA
caagauguugcggaaucugc

SEQ ID NO: 11615 - RNA, 20 nt, Artificial Sequence
  MKO10011615_A_Cox7a2
  gRNA
accaagcgucagagccauug

SEQ ID NO: 11616 - RNA, 20 nt, Artificial Sequence
  MKO10011616_A_Cox7b2
  gRNA
gagauaguuuagugcauauc

SEQ ID NO: 11617 - RNA, 20 nt, Artificial Sequence
  MKO10011617_A_Cox7b2
  gRNA
uaacucugccaauaggagac

SEQ ID NO: 11618 - RNA, 20 nt, Artificial Sequence
  MKO10011618_A_Cox7b2
  gRNA
gaguggaaccugucuccuau

SEQ ID NO: 11619 - RNA, 20 nt, Artificial Sequence
  MKO10011619_A_Cox7b
  gRNA
aacgcacuaagccgucucca

SEQ ID NO: 11620 - RNA, 20 nt, Artificial Sequence
  MKO10011620_A_Cox7b
  gRNA
caaggcagagccaccagaag

SEQ ID NO: 11621 - RNA, 20 nt, Artificial Sequence
  MKO10011621_A_Cox7b
  gRNA
uuacagacagccacacaaau

SEQ ID NO: 11622 - RNA, 20 nt, Artificial Sequence
  MKO10011622_A_Cox7c
  gRNA
acauguugggccagaguauc

SEQ ID NO: 11623 - RNA, 20 nt, Artificial Sequence
  MKO10011623_A_Cox7c
  gRNA
uccccggacccuccucauag

SEQ ID NO: 11624 - RNA, 20 nt, Artificial Sequence
  MKO10011624_A_Cox7c
  gRNA
gcuaugaugaccguguacuu

SEQ ID NO: 11625 - RNA, 20 nt, Artificial Sequence
  MKO10011625_A_Cox8a
  gRNA
gccugaccggcucggcccgg

SEQ ID NO: 11626 - RNA, 20 nt, Artificial Sequence
  MKO10011626_A_Cox8a
  gRNA
caugagccgccgggccgagc

SEQ ID NO: 11627 - RNA, 20 nt, Artificial Sequence
  MKO10011627_A_Cox8a
  gRNA
cagaagacaacacacgaagc

SEQ ID NO: 11628 - RNA, 20 nt, Artificial Sequence
  MKO10011628_A_Cox8b
  gRNA
caaaacucccacuuccgccg

SEQ ID NO: 11629 - RNA, 20 nt, Artificial Sequence
  MKO10011629_A_Cox8b
  gRNA
ggaaccacugugaacuucgc

SEQ ID NO: 11630 - RNA, 20 nt, Artificial Sequence
  MKO10011630_A_Cox8b
  gRNA
aggaugggucuuagcccacu

SEQ ID NO: 11631 - RNA, 20 nt, Artificial Sequence
  MKO10011631_A_Cox8c
  gRNA
ucuaccucaccgugggcgac

SEQ ID NO: 11632 - RNA, 20 nt, Artificial Sequence
  MKO10011632_A_Cox8c
  gRNA
ucgagaacaggacugcacgg

SEQ ID NO: 11633 - RNA, 20 nt, Artificial Sequence
  MKO10011633_A_Cox8c
  gRNA
cugcuuagcacauaugcagc

SEQ ID NO: 11634 - RNA, 20 nt, Artificial Sequence
  MKO10011634_A_Cpa1
  gRNA
gaagggcacucgaacaucga

SEQ ID NO: 11635 - RNA, 20 nt, Artificial Sequence
  MKO10011635_A_Cpa1
  gRNA
gcagcagauguccgccuucc

SEQ ID NO: 11636 - RNA, 20 nt, Artificial Sequence
  MKO10011636_A_Cpa1
  gRNA
cucugccaccgacgaagccc

SEQ ID NO: 11637 - RNA, 20 nt, Artificial Sequence
  MKO10011637_A_Cpa2
  gRNA
uagugccacgcucucuuugc

SEQ ID NO: 11638 - RNA, 20 nt, Artificial Sequence
  MKO10011638_A_Cpa2
  gRNA
ccacgagguuauccauuucu

SEQ ID NO: 11639 - RNA, 20 nt, Artificial Sequence
  MKO10011639_A_Cpa2
  gRNA
ucggcccaugaaugugcuca

SEQ ID NO: 11640 - RNA, 20 nt, Artificial Sequence
  MKO10011640_A_Cpa3
  gRNA
uugucuuguagcucgacuuc

SEQ ID NO: 11641 - RNA, 20 nt, Artificial Sequence
  MKO10011641_A_Cpa3
  gRNA
gaugugaaagaugaaaucgc

SEQ ID NO: 11642 - RNA, 20 nt, Artificial Sequence
  MKO10011642_A_Cpa3
  gRNA
gaacuugacccaaagcauug

SEQ ID NO: 11643 - RNA, 20 nt, Artificial Sequence
  MKO10011643_A_Cpa4
  gRNA
auccacgggccgaucaaaag

SEQ ID NO: 11644 - RNA, 20 nt, Artificial Sequence
  MKO10011644_A_Cpa4
  gRNA
agacuacuccgugacaauug

SEQ ID NO: 11645 - RNA, 20 nt, Artificial Sequence
  MKO10011645_A_Cpa4
  gRNA
uggcaauacuguccaucucg

SEQ ID NO: 11646 - RNA, 20 nt, Artificial Sequence
  MKO10011646_A_Cpa5
  gRNA
cuauuccucuuaucacaccc

SEQ ID NO: 11647 - RNA, 20 nt, Artificial Sequence
  MKO10011647_A_Cpa5
  gRNA
agaccagguucuucgagucc

SEQ ID NO: 11648 - RNA, 20 nt, Artificial Sequence
  MKO10011648_A_Cpa5
  gRNA
cucguccagggugugauaag

SEQ ID NO: 11649 - RNA, 20 nt, Artificial Sequence
  MKO10011649_A_Cpa6
  gRNA
cucguucgaguguucucuau

SEQ ID NO: 11650 - RNA, 20 nt, Artificial Sequence
  MKO10011650_A_Cpa6
  gRNA
acucauccccaaauccgaag

SEQ ID NO: 11651 - RNA, 20 nt, Artificial Sequence
  MKO10011651_A_Cpa6
  gRNA
caauagagaacacucgaacg

SEQ ID NO: 11652 - RNA, 20 nt, Artificial Sequence
  MKO10011652_A_Cpb1
  gRNA
cauguuacguccuucaaaug

SEQ ID NO: 11653 - RNA, 20 nt, Artificial Sequence
  MKO10011653_A_Cpb1
  gRNA
gcuacaccaaguacaacaac

SEQ ID NO: 11654 - RNA, 20 nt, Artificial Sequence
  MKO10011654_A_Cpb1
  gRNA
gacagccacacccgugcaag

SEQ ID NO: 11655 - RNA, 20 nt, Artificial Sequence
  MKO10011655_A_Cpb2
  gRNA
gaaucuuacuacaacguaug

SEQ ID NO: 11656 - RNA, 20 nt, Artificial Sequence
  MKO10011656_A_Cpb2
  gRNA
cagcguucugaugaacaacg

SEQ ID NO: 11657 - RNA, 20 nt, Artificial Sequence
  MKO10011657_A_Cpb2
  gRNA
ggaaacuguaggucguucuc

SEQ ID NO: 11658 - RNA, 20 nt, Artificial Sequence
  MKO10011658_A_Cpd
  gRNA
uggcgcgcacugguaugacg

SEQ ID NO: 11659 - RNA, 20 nt, Artificial Sequence
  MKO10011659_A_Cpd
  gRNA
aaucuuacggcgcuuucaac

SEQ ID NO: 11660 - RNA, 20 nt, Artificial Sequence
  MKO10011660_A_Cpd
  gRNA
uuuguuaaagauuccguaac

SEQ ID NO: 11661 - RNA, 20 nt, Artificial Sequence
  MKO10011661_A_Cpeb1
  gRNA
gcaaugccaauaucuuucga

SEQ ID NO: 11662 - RNA, 20 nt, Artificial Sequence
  MKO10011662_A_Cpeb1
  gRNA
caggcgagauccucuaacug

SEQ ID NO: 11663 - RNA, 20 nt, Artificial Sequence
  MKO10011663_A_Cpeb1
  gRNA
acggggagauucuugcgcag

SEQ ID NO: 11664 - RNA, 20 nt, Artificial Sequence
  MKO10011664_A_Cpeb2
  gRNA
gcuauaacauuacccgagaa

SEQ ID NO: 11665 - RNA, 20 nt, Artificial Sequence
  MKO10011665_A_Cpeb2
  gRNA
cgucugagcuauccacaucc

SEQ ID NO: 11666 - RNA, 20 nt, Artificial Sequence
  MKO10011666_A_Cpeb2
  gRNA
ugcacggcagagaucaccgc

SEQ ID NO: 11667 - RNA, 20 nt, Artificial Sequence
  MKO10011667_A_Cpeb3
  gRNA
gugguaccuucaucgauguc

SEQ ID NO: 11668 - RNA, 20 nt, Artificial Sequence
  MKO10011668_A_Cpeb3
  gRNA
ucgucuccgcccauagcucc

SEQ ID NO: 11669 - RNA, 20 nt, Artificial Sequence
  MKO10011669_A_Cpeb3
  gRNA
ugaguuucgcugauauaaug

SEQ ID NO: 11670 - RNA, 20 nt, Artificial Sequence
  MKO10011670_A_Cpeb4
  gRNA
ugagugcaugucaaacgucc

SEQ ID NO: 11671 - RNA, 20 nt, Artificial Sequence
  MKO10011671_A_Cpeb4
  gRNA
auacucucgcaaaguguuug

SEQ ID NO: 11672 - RNA, 20 nt, Artificial Sequence
  MKO10011672_A_Cpeb4
  gRNA
cgucuaaacuauucauaccc

SEQ ID NO: 11673 - RNA, 20 nt, Artificial Sequence
  MKO10011673_A_Cped1
  gRNA
uagucgacacaugugcuccc

SEQ ID NO: 11674 - RNA, 20 nt, Artificial Sequence
  MKO10011674_A_Cped1
  gRNA
uggucuagguccggagcugc

SEQ ID NO: 11675 - RNA, 20 nt, Artificial Sequence
  MKO10011675_A_Cped1
  gRNA
gucgacuaagccuacaucaa

SEQ ID NO: 11676 - RNA, 20 nt, Artificial Sequence
  MKO10011676_A_Cpe
  gRNA
uacgguucagaucuauuccc

SEQ ID NO: 11677 - RNA, 20 nt, Artificial Sequence
  MKO10011677_A_Cpe
  gRNA
ccuuuagcccggcgagcuga

SEQ ID NO: 11678 - RNA, 20 nt, Artificial Sequence
  MKO10011678_A_Cpe
  gRNA
gucaucgucauucuugcgac

SEQ ID NO: 11679 - RNA, 20 nt, Artificial Sequence
  MKO10011679_A_Cphx1
  gRNA
caaucacgcucacuucacac

SEQ ID NO: 11680 - RNA, 20 nt, Artificial Sequence
  MKO10011680_A_Cphx1
  gRNA
agcaaagcaagaaagcgaua

SEQ ID NO: 11681 - RNA, 20 nt, Artificial Sequence
  MKO10011681_A_Cphx1
  gRNA
aagcuuguaccuggguaucc

SEQ ID NO: 11682 - RNA, 20 nt, Artificial Sequence
  MKO10011682_A_Cphx2
  gRNA
caaucacgcucacuucacac

SEQ ID NO: 11683 - RNA, 20 nt, Artificial Sequence
  MKO10011683_A_Cphx2
  gRNA
agcaaagcaagaaagcgaua

SEQ ID NO: 11684 - RNA, 20 nt, Artificial Sequence
  MKO10011684_A_Cphx2
  gRNA
aagcuuguaccuggguaucc

SEQ ID NO: 11685 - RNA, 20 nt, Artificial Sequence
  MKO10011685_A_Cplx1
  gRNA
guucgugaugaaacaagccc

SEQ ID NO: 11686 - RNA, 20 nt, Artificial Sequence
  MKO10011686_A_Cplx1
  gRNA
gcccggugggauagccuucu

SEQ ID NO: 11687 - RNA, 20 nt, Artificial Sequence
  MKO10011687_A_Cplx1
  gRNA
ggaccccgaugcugcuaaga

SEQ ID NO: 11688 - RNA, 20 nt, Artificial Sequence
  MKO10011688_A_Cplx2
  gRNA
caaggcgaaacacgcccgca

SEQ ID NO: 11689 - RNA, 20 nt, Artificial Sequence
  MKO10011689_A_Cplx2
  gRNA
ucucgcgcucggcuuccaug

SEQ ID NO: 11690 - RNA, 20 nt, Artificial Sequence
  MKO10011690_A_Cplx2
  gRNA
uucgucaugaagcaagcccu

SEQ ID NO: 11691 - RNA, 20 nt, Artificial Sequence
  MKO10011691_A_Cplx3
  gRNA
cguauccuccucgaucaucu

SEQ ID NO: 11692 - RNA, 20 nt, Artificial Sequence
  MKO10011692_A_Cplx3
  gRNA
caugagccgagaagaguacg

SEQ ID NO: 11693 - RNA, 20 nt, Artificial Sequence
  MKO10011693_A_Cplx3
  gRNA
gauacuccucguacucuucu

SEQ ID NO: 11694 - RNA, 20 nt, Artificial Sequence
  MKO10011694_A_Cplx4
  gRNA
accagaagaucuccgaaaga

SEQ ID NO: 11695 - RNA, 20 nt, Artificial Sequence
  MKO10011695_A_Cplx4
  gRNA
cgugccuacgaguccaccuc

SEQ ID NO: 11696 - RNA, 20 nt, Artificial Sequence
  MKO10011696_A_Cplx4
  gRNA
ugccgcauuuacgcagaaaa

SEQ ID NO: 11697 - RNA, 20 nt, Artificial Sequence
  MKO10011697_A_Cpm
  gRNA
gcuccaccugaucgacuauc

SEQ ID NO: 11698 - RNA, 20 nt, Artificial Sequence
  MKO10011698_A_Cpm
  gRNA
guugucccgaagcuuaaccc

SEQ ID NO: 11699 - RNA, 20 nt, Artificial Sequence
  MKO10011699_A_Cpm
  gRNA
cuggacggcuucgaauccau

SEQ ID NO: 11700 - RNA, 20 nt, Artificial Sequence
  MKO10011700_A_Cpn1
  gRNA
ggauacgcugguuucgguuc

SEQ ID NO: 11701 - RNA, 20 nt, Artificial Sequence
  MKO10011701_A_Cpn1
  gRNA
augggcguaggaguagaccu

SEQ ID NO: 11702 - RNA, 20 nt, Artificial Sequence
  MKO10011702_A_Cpn1
  gRNA
gcagccaccucguagccguc

SEQ ID NO: 11703 - RNA, 20 nt, Artificial Sequence
  MKO10011703_A_Cpn2
  gRNA
uaacuugacggcccugcacc

SEQ ID NO: 11704 - RNA, 20 nt, Artificial Sequence
  MKO10011704_A_Cpn2
  gRNA
cgcauaccucaagggccagu

SEQ ID NO: 11705 - RNA, 20 nt, Artificial Sequence
  MKO10011705_A_Cpn2
  gRNA
uaugcuugccagacuccccg

SEQ ID NO: 11706 - RNA, 20 nt, Artificial Sequence
  MKO10011706_A_Cpne1
  gRNA
gugaugguuccccgcccugc

SEQ ID NO: 11707 - RNA, 20 nt, Artificial Sequence
  MKO10011707_A_Cpne1
  gRNA
gccacuucccaucgccuugc

SEQ ID NO: 11708 - RNA, 20 nt, Artificial Sequence
  MKO10011708_A_Cpne1
  gRNA
aguugcgaacacguucaguc

SEQ ID NO: 11709 - RNA, 20 nt, Artificial Sequence
  MKO10011709_A_Cpne2
  gRNA
caaguucgcccuguuugacc

SEQ ID NO: 11710 - RNA, 20 nt, Artificial Sequence
  MKO10011710_A_Cpne2
  gRNA
gugauuacgcccuuccccgc

SEQ ID NO: 11711 - RNA, 20 nt, Artificial Sequence
  MKO10011711_A_Cpne2
  gRNA
uggacuuguccuggucaaac

SEQ ID NO: 11712 - RNA, 20 nt, Artificial Sequence
  MKO10011712_A_Cpne3
  gRNA
uaagaagcuaacucgaccac

SEQ ID NO: 11713 - RNA, 20 nt, Artificial Sequence
  MKO10011713_A_Cpne3
  gRNA
gcugaugguucaccgaacag

SEQ ID NO: 11714 - RNA, 20 nt, Artificial Sequence
  MKO10011714_A_Cpne3
  gRNA
uauagguugaacggacagaa

SEQ ID NO: 11715 - RNA, 20 nt, Artificial Sequence
  MKO10011715_A_Cpne4
  gRNA
acagcuugugcaucgaacag

SEQ ID NO: 11716 - RNA, 20 nt, Artificial Sequence
  MKO10011716_A_Cpne4
  gRNA
uugagcuugcauucaaugca

SEQ ID NO: 11717 - RNA, 20 nt, Artificial Sequence
  MKO10011717_A_Cpne4
  gRNA
uugaagagguccaacgucuc

SEQ ID NO: 11718 - RNA, 20 nt, Artificial Sequence
  MKO10011718_A_Cpne5
  gRNA
cucgcaguucggacgcaccg

SEQ ID NO: 11719 - RNA, 20 nt, Artificial Sequence
  MKO10011719_A_Cpne5
  gRNA
cuucgugcgcaaguucauug

SEQ ID NO: 11720 - RNA, 20 nt, Artificial Sequence
  MKO10011720_A_Cpne5
  gRNA
ggacuuacgugggucagacu

SEQ ID NO: 11721 - RNA, 20 nt, Artificial Sequence
  MKO10011721_A_Cpne6
  gRNA
guuccacguguucgaugccg

SEQ ID NO: 11722 - RNA, 20 nt, Artificial Sequence
  MKO10011722_A_Cpne6
  gRNA
gguaaguugcacauagucgu

SEQ ID NO: 11723 - RNA, 20 nt, Artificial Sequence
  MKO10011723_A_Cpne6
  gRNA
gcggcuuugugagcgugucu

SEQ ID NO: 11724 - RNA, 20 nt, Artificial Sequence
  MKO10011724_A_Cpne7
  gRNA
cauugcuguugcgauucggc

SEQ ID NO: 11725 - RNA, 20 nt, Artificial Sequence
  MKO10011725_A_Cpne7
  gRNA
cacugucgacuacuacuucg

SEQ ID NO: 11726 - RNA, 20 nt, Artificial Sequence
  MKO10011726_A_Cpne7
  gRNA
cugccgaaucgcaacagcaa

SEQ ID NO: 11727 - RNA, 20 nt, Artificial Sequence
  MKO10011727_A_Cpne8
  gRNA
cggcuguccaucucgagcug

SEQ ID NO: 11728 - RNA, 20 nt, Artificial Sequence
  MKO10011728_A_Cpne8
  gRNA
cuccguuccucagcucgaga

SEQ ID NO: 11729 - RNA, 20 nt, Artificial Sequence
  MKO10011729_A_Cpne8
  gRNA
cuguucucccaacgauguaa

SEQ ID NO: 11730 - RNA, 20 nt, Artificial Sequence
  MKO10011730_A_Cpne9
  gRNA
ugcccaguucggacgaaccg

SEQ ID NO: 11731 - RNA, 20 nt, Artificial Sequence
  MKO10011731_A_Cpne9
  gRNA
aggagccucacacaucgaag

SEQ ID NO: 11732 - RNA, 20 nt, Artificial Sequence
  MKO10011732_A_Cpne9
  gRNA
cugcuuacugggguccgacu

SEQ ID NO: 11733 - RNA, 20 nt, Artificial Sequence
  MKO10011733_A_Cpox
  gRNA
gcgaugacuccuacaccccc

SEQ ID NO: 11734 - RNA, 20 nt, Artificial Sequence
  MKO10011734_A_Cpox
  gRNA
cagcacacgucuucacgaag

SEQ ID NO: 11735 - RNA, 20 nt, Artificial Sequence
  MKO10011735_A_Cpox
  gRNA
gugagcauuuccgucguuca

SEQ ID NO: 11736 - RNA, 20 nt, Artificial Sequence
  MKO10011736_A_Cpped1
  gRNA
aguacugaaagccgucgacc

SEQ ID NO: 11737 - RNA, 20 nt, Artificial Sequence
  MKO10011737_A_Cpped1
  gRNA
gucgcucgccauguccgcua

SEQ ID NO: 11738 - RNA, 20 nt, Artificial Sequence
  MKO10011738_A_Cpped1
  gRNA
gguccauucuacuucgucca

SEQ ID NO: 11739 - RNA, 20 nt, Artificial Sequence
  MKO10011739_A_Cpq
  gRNA
guuuauaaccagccuuacac

SEQ ID NO: 11740 - RNA, 20 nt, Artificial Sequence
  MKO10011740_A_Cpq
  gRNA
ugcagaaaugaugucucgaa

SEQ ID NO: 11741 - RNA, 20 nt, Artificial Sequence
  MKO10011741_A_Cpq
  gRNA
ucccagggcugcguccaaag

SEQ ID NO: 11742 - RNA, 20 nt, Artificial Sequence
  MKO10011742_A_Cps1
  gRNA
acuuacugaucccgccuaca

SEQ ID NO: 11743 - RNA, 20 nt, Artificial Sequence
  MKO10011743_A_Cps1
  gRNA
guauccacuccauaaauugc

SEQ ID NO: 11744 - RNA, 20 nt, Artificial Sequence
  MKO10011744_A_Cps1
  gRNA
caccacugcccgagacgaac

SEQ ID NO: 11745 - RNA, 20 nt, Artificial Sequence
  MKO10011745_A_Cpsf1
  gRNA
acgugcauacgccucgugug

SEQ ID NO: 11746 - RNA, 20 nt, Artificial Sequence
  MKO10011746_A_Cpsf1
  gRNA
auugcugcacagcgcccguc

SEQ ID NO: 11747 - RNA, 20 nt, Artificial Sequence
  MKO10011747_A_Cpsf1
  gRNA
ugcuggcuuacccgaaguuc

SEQ ID NO: 11748 - RNA, 20 nt, Artificial Sequence
  MKO10011748_A_Cpsf2
  gRNA
cuacuuacgugcagccuaga

SEQ ID NO: 11749 - RNA, 20 nt, Artificial Sequence
  MKO10011749_A_Cpsf2
  gRNA
cccauucgccguggggaagc

SEQ ID NO: 11750 - RNA, 20 nt, Artificial Sequence
  MKO10011750_A_Cpsf2
  gRNA
guucauguacgaccucuauc

SEQ ID NO: 11751 - RNA, 20 nt, Artificial Sequence
  MKO10011751_A_Cpsf3l
  gRNA
agacuaccgcaagauugcag

SEQ ID NO: 11752 - RNA, 20 nt, Artificial Sequence
  MKO10011752_A_Cpsf3l
  gRNA
auacuaugcaggccacgugc

SEQ ID NO: 11753 - RNA, 20 nt, Artificial Sequence
  MKO10011753_A_Cpsf3l
  gRNA
uguaggccgaagcugcaucu

SEQ ID NO: 11754 - RNA, 20 nt, Artificial Sequence
  MKO10011754_A_Cpsf3
  gRNA
uuaccaugccggccacgucc

SEQ ID NO: 11755 - RNA, 20 nt, Artificial Sequence
  MKO10011755_A_Cpsf3
  gRNA
cgaucucagcugggucgaua

SEQ ID NO: 11756 - RNA, 20 nt, Artificial Sequence
  MKO10011756_A_Cpsf3
  gRNA
auguuuaugauagagaucgc

SEQ ID NO: 11757 - RNA, 20 nt, Artificial Sequence
  MKO10011757_A_Cpsf4l
  gRNA
gcaucuugcugacgucauac

SEQ ID NO: 11758 - RNA, 20 nt, Artificial Sequence
  MKO10011758_A_Cpsf4l
  gRNA
acugcccgugguauaaccaa

SEQ ID NO: 11759 - RNA, 20 nt, Artificial Sequence
  MKO10011759_A_Cpsf4l
  gRNA
ccuucaccuaccuaaggugc

SEQ ID NO: 11760 - RNA, 20 nt, Artificial Sequence
  MKO10011760_A_Cpsf4
  gRNA
cccaugggcaguucaaaucg

SEQ ID NO: 11761 - RNA, 20 nt, Artificial Sequence
  MKO10011761_A_Cpsf4
  gRNA
uguccauuccgccacaucag

SEQ ID NO: 11762 - RNA, 20 nt, Artificial Sequence
  MKO10011762_A_Cpsf4
  gRNA
cccucgauuugaacugccca

SEQ ID NO: 11763 - RNA, 20 nt, Artificial Sequence
  MKO10011763_A_Cpsf6
  gRNA
uccauguagucgcgaucuuc

SEQ ID NO: 11764 - RNA, 20 nt, Artificial Sequence
  MKO10011764_A_Cpsf6
  gRNA
guguaaguguacacaacguu

SEQ ID NO: 11765 - RNA, 20 nt, Artificial Sequence
  MKO10011765_A_Cpsf6
  gRNA
gcugcgcgugaaccgccucc

SEQ ID NO: 11766 - RNA, 20 nt, Artificial Sequence
  MKO10011766_A_Cpsf7
  gRNA
cagcugcucgccgacuccgc

SEQ ID NO: 11767 - RNA, 20 nt, Artificial Sequence
  MKO10011767_A_Cpsf7
  gRNA
gagugcguccgagucccaag

SEQ ID NO: 11768 - RNA, 20 nt, Artificial Sequence
  MKO10011768_A_Cpsf7
  gRNA
cggcgagcagcugucuaugu

SEQ ID NO: 11769 - RNA, 20 nt, Artificial Sequence
  MKO10011769_A_Cpt1a
  gRNA
gacuaugcgcuacucgcuga

SEQ ID NO: 11770 - RNA, 20 nt, Artificial Sequence
  MKO10011770_A_Cpt1a
  gRNA
cacucacgauguucuucguc

SEQ ID NO: 11771 - RNA, 20 nt, Artificial Sequence
  MKO10011771_A_Cpt1a
  gRNA
ggguuacucacguggugucu

SEQ ID NO: 11772 - RNA, 20 nt, Artificial Sequence
  MKO10011772_A_Cpt1b
  gRNA
ugaugaagcauauuaccgca

SEQ ID NO: 11773 - RNA, 20 nt, Artificial Sequence
  MKO10011773_A_Cpt1b
  gRNA
gcaucucgaacauccacccg

SEQ ID NO: 11774 - RNA, 20 nt, Artificial Sequence
  MKO10011774_A_Cpt1b
  gRNA
ucaucuucuccaccggaguc

SEQ ID NO: 11775 - RNA, 20 nt, Artificial Sequence
  MKO10011775_A_Cpt1c
  gRNA
uuucgaccgcgcuacagcgc

SEQ ID NO: 11776 - RNA, 20 nt, Artificial Sequence
  MKO10011776_A_Cpt1c
  gRNA
aaagcgucgucuccgagcac

SEQ ID NO: 11777 - RNA, 20 nt, Artificial Sequence
  MKO10011777_A_Cpt1c
  gRNA
gcgcacggucuccugcgccg

SEQ ID NO: 11778 - RNA, 20 nt, Artificial Sequence
  MKO10011778_A_Cpt2
  gRNA
uccggauugaaugccaugaa

SEQ ID NO: 11779 - RNA, 20 nt, Artificial Sequence
  MKO10011779_A_Cpt2
  gRNA
cgugccgucaccgugcagca

SEQ ID NO: 11780 - RNA, 20 nt, Artificial Sequence
  MKO10011780_A_Cpt2
  gRNA
gacauguucgaugcccucga

SEQ ID NO: 11781 - RNA, 20 nt, Artificial Sequence
  MKO10011781_A_Cpvl
  gRNA
cugguucaccgugauguagc

SEQ ID NO: 11782 - RNA, 20 nt, Artificial Sequence
  MKO10011782_A_Cpvl
  gRNA
ccucgcugguggcguauccc

SEQ ID NO: 11783 - RNA, 20 nt, Artificial Sequence
  MKO10011783_A_Cpvl
  gRNA
cagcuucaccgaucauuucc

SEQ ID NO: 11784 - RNA, 20 nt, Artificial Sequence
  MKO10011784_A_Cpxcr1
  gRNA
ggaaacuaaucuauccggca

SEQ ID NO: 11785 - RNA, 20 nt, Artificial Sequence
  MKO10011785_A_Cpxcr1
  gRNA
uuacuacuaaugagauaagu

SEQ ID NO: 11786 - RNA, 20 nt, Artificial Sequence
  MKO10011786_A_Cpxcr1
  gRNA
gacucgccaccuaagaaaac

SEQ ID NO: 11787 - RNA, 20 nt, Artificial Sequence
  MKO10011787_A_Cpxm1
  gRNA
cgcaccaagcgccaucauac

SEQ ID NO: 11788 - RNA, 20 nt, Artificial Sequence
  MKO10011788_A_Cpxm1
  gRNA
aagaaucccguccgcuucgc

SEQ ID NO: 11789 - RNA, 20 nt, Artificial Sequence
  MKO10011789_A_Cpxm1
  gRNA
accccaggaugucccccucu

SEQ ID NO: 11790 - RNA, 20 nt, Artificial Sequence
  MKO10011790_A_Cpxm2
  gRNA
guaggaacgacuugcaucag

SEQ ID NO: 11791 - RNA, 20 nt, Artificial Sequence
  MKO10011791_A_Cpxm2
  gRNA
gccuccacaucgaagcguua

SEQ ID NO: 11792 - RNA, 20 nt, Artificial Sequence
  MKO10011792_A_Cpxm2
  gRNA
caggccauaacgcuucgaug

SEQ ID NO: 11793 - RNA, 20 nt, Artificial Sequence
  MKO10011793_A_Cpz
  gRNA
ggccuuugacgccaucgaca

SEQ ID NO: 11794 - RNA, 20 nt, Artificial Sequence
  MKO10011794_A_Cpz
  gRNA
gcgguguggggaacgaugua

SEQ ID NO: 11795 - RNA, 20 nt, Artificial Sequence
  MKO10011795_A_Cpz
  gRNA
ucgagaacucgaugaccacc

SEQ ID NO: 11796 - RNA, 20 nt, Artificial Sequence
  MKO10011796_A_Cp
  gRNA
aucagcccguugaaaaucag

SEQ ID NO: 11797 - RNA, 20 nt, Artificial Sequence
  MKO10011797_A_Cp
  gRNA
aguccugaugcaauaucuuu

SEQ ID NO: 11798 - RNA, 20 nt, Artificial Sequence
  MKO10011798_A_Cp
  gRNA
gcacuuacccucauacuccu

SEQ ID NO: 11799 - RNA, 20 nt, Artificial Sequence
  MKO10011799_A_Cr1l
  gRNA
guguguagauaccgccucau

SEQ ID NO: 11800 - RNA, 20 nt, Artificial Sequence
  MKO10011800_A_Cr1l
  gRNA
gacuuacccuugaagcagcu

SEQ ID NO: 11801 - RNA, 20 nt, Artificial Sequence
  MKO10011801_A_Cr1l
  gRNA
auaaggagggcucacccacc

SEQ ID NO: 11802 - RNA, 20 nt, Artificial Sequence
  MKO10011802_A_Cr2
  gRNA
ccuuuauucaugaauccccc

SEQ ID NO: 11803 - RNA, 20 nt, Artificial Sequence
  MKO10011803_A_Cr2
  gRNA
ugguguccauuaugaaucgu

SEQ ID NO: 11804 - RNA, 20 nt, Artificial Sequence
  MKO10011804_A_Cr2
  gRNA
cagacaaccccgcaacaaac

SEQ ID NO: 11805 - RNA, 20 nt, Artificial Sequence
  MKO10011805_A_Crabp1
  gRNA
cggcuuagacgcagccgcca

SEQ ID NO: 11806 - RNA, 20 nt, Artificial Sequence
  MKO10011806_A_Crabp1
  gRNA
uguagaacugauccccgucu

SEQ ID NO: 11807 - RNA, 20 nt, Artificial Sequence
  MKO10011807_A_Crabp1
  gRNA
ggccaacgaugagcuaaucc

SEQ ID NO: 11808 - RNA, 20 nt, Artificial Sequence
  MKO10011808_A_Crabp2
  gRNA
ucacucucggacguagaccc

SEQ ID NO: 11809 - RNA, 20 nt, Artificial Sequence
  MKO10011809_A_Crabp2
  gRNA
caacuggaagaucauccgau

SEQ ID NO: 11810 - RNA, 20 nt, Artificial Sequence
  MKO10011810_A_Crabp2
  gRNA
gauuaacuucaagaucgggg

SEQ ID NO: 11811 - RNA, 20 nt, Artificial Sequence
  MKO10011811_A_Cradd
  gRNA
gaccgacaucuaccgcugca

SEQ ID NO: 11812 - RNA, 20 nt, Artificial Sequence
  MKO10011812_A_Cradd
  gRNA
uccccacaacgugcauucgc

SEQ ID NO: 11813 - RNA, 20 nt, Artificial Sequence
  MKO10011813_A_Cradd
  gRNA
ccggaagacaaugcuguugc

SEQ ID NO: 11814 - RNA, 20 nt, Artificial Sequence
  MKO10011814_A_Cramp1l
  gRNA
ggcgagcuacgcaagaagau

SEQ ID NO: 11815 - RNA, 20 nt, Artificial Sequence
  MKO10011815_A_Cramp1l
  gRNA
aggugcgguaguaaaaaugc

SEQ ID NO: 11816 - RNA, 20 nt, Artificial Sequence
  MKO10011816_A_Cramp1l
  gRNA
cucauacagucccucgaaga

SEQ ID NO: 11817 - RNA, 20 nt, Artificial Sequence
  MKO10011817_A_Crau
  gRNA
cguaggggaacgccuacaga

SEQ ID NO: 11818 - RNA, 20 nt, Artificial Sequence
  MKO10011818_A_Crau
  gRNA
accacccacgcauauaaccg

SEQ ID NO: 11819 - RNA, 20 nt, Artificial Sequence
  MKO10011819_A_Crau
  gRNA
gacgcugccaguugaguucc

SEQ ID NO: 11820 - RNA, 20 nt, Artificial Sequence
  MKO10011820_A_Crb1
  gRNA
cguccugacauguggcaccg

SEQ ID NO: 11821 - RNA, 20 nt, Artificial Sequence
  MKO10011821_A_Crb1
  gRNA
caugucgcgucguugugaca

SEQ ID NO: 11822 - RNA, 20 nt, Artificial Sequence
  MKO10011822_A_Crb1
  gRNA
gccacuugugugaaaauccc

SEQ ID NO: 11823 - RNA, 20 nt, Artificial Sequence
  MKO10011823_A_Crb2
  gRNA
caggacgcguugugcgcgca

SEQ ID NO: 11824 - RNA, 20 nt, Artificial Sequence
  MKO10011824_A_Crb2
  gRNA
cagagccagccgugcgcgca

SEQ ID NO: 11825 - RNA, 20 nt, Artificial Sequence
  MKO10011825_A_Crb2
  gRNA
caguuuccggugcgacugcg

SEQ ID NO: 11826 - RNA, 20 nt, Artificial Sequence
  MKO10011826_A_Crb3
  gRNA
ugaugaguccaacgggggcc

SEQ ID NO: 11827 - RNA, 20 nt, Artificial Sequence
  MKO10011827_A_Crb3
  gRNA
ccuaaacucauggcgacccc

SEQ ID NO: 11828 - RNA, 20 nt, Artificial Sequence
  MKO10011828_A_Crb3
  gRNA
uucugcucaugcgaaaacuu

SEQ ID NO: 11829 - RNA, 20 nt, Artificial Sequence
  MKO10011829_A_Crbn
  gRNA
cugacuguguucgaaguucg

SEQ ID NO: 11830 - RNA, 20 nt, Artificial Sequence
  MKO10011830_A_Crbn
  gRNA
cgucaugcaaaguucucccg

SEQ ID NO: 11831 - RNA, 20 nt, Artificial Sequence
  MKO10011831_A_Crbn
  gRNA
gcaggacgcugcgcacaaca

SEQ ID NO: 11832 - RNA, 20 nt, Artificial Sequence
  MKO10011832_A_Crcp
  gRNA
cuuugagauccguuaguaac

SEQ ID NO: 11833 - RNA, 20 nt, Artificial Sequence
  MKO10011833_A_Crcp
  gRNA
uggaucuccaccgcagucau

SEQ ID NO: 11834 - RNA, 20 nt, Artificial Sequence
  MKO10011834_A_Crcp
  gRNA
agcacugcucagcaacuaug

SEQ ID NO: 11835 - RNA, 20 nt, Artificial Sequence
  MKO10011835_A_Crcu1
  gRNA
agacgccgccgacagcgcuc

SEQ ID NO: 11836 - RNA, 20 nt, Artificial Sequence
  MKO10011836_A_Crcu1
  gRNA
cgcagccgccagagcgcugu

SEQ ID NO: 11837 - RNA, 20 nt, Artificial Sequence
  MKO10011837_A_Crcu1
  gRNA
aaacgccgagaugucucaac

SEQ ID NO: 11838 - RNA, 20 nt, Artificial Sequence
  MKO10011838_A_Creb1
  gRNA
uguacugcccacugcuaguu

SEQ ID NO: 11839 - RNA, 20 nt, Artificial Sequence
  MKO10011839_A_Creb1
  gRNA
cccauuuaccaaacuagcag

SEQ ID NO: 11840 - RNA, 20 nt, Artificial Sequence
  MKO10011840_A_Creb1
  gRNA
uacuguagaaugguaguacc

SEQ ID NO: 11841 - RNA, 20 nt, Artificial Sequence
  MKO10011841_A_Creb3l1
  gRNA
gagcgggccaugggccggac

SEQ ID NO: 11842 - RNA, 20 nt, Artificial Sequence
  MKO10011842_A_Creb3l1
  gRNA
guguuggaggcaucuguacg

SEQ ID NO: 11843 - RNA, 20 nt, Artificial Sequence
  MKO10011843_A_Creb3l1
  gRNA
ccagcacuucccggagcacc

SEQ ID NO: 11844 - RNA, 20 nt, Artificial Sequence
  MKO10011844_A_Creb3l2
  gRNA
gcuuauuccuaagauuaagc

SEQ ID NO: 11845 - RNA, 20 nt, Artificial Sequence
  MKO10011845_A_Creb3l2
  gRNA
gaugagcucaccuucuuucg

SEQ ID NO: 11846 - RNA, 20 nt, Artificial Sequence
  MKO10011846_A_Creb3l2
  gRNA
accgucauugaagcugucgc

SEQ ID NO: 11847 - RNA, 20 nt, Artificial Sequence
  MKO10011847_A_Creb3l3
  gRNA
ugccguccugccgaucaaac

SEQ ID NO: 11848 - RNA, 20 nt, Artificial Sequence
  MKO10011848_A_Creb3l3
  gRNA
cggccagcuccacguuucuc

SEQ ID NO: 11849 - RNA, 20 nt, Artificial Sequence
  MKO10011849_A_Creb3l3
  gRNA
gugacaccuggcuaccgugu

SEQ ID NO: 11850 - RNA, 20 nt, Artificial Sequence
  MKO10011850_A_Creb3l4
  gRNA
aguauucuuucuuccgccgc

SEQ ID NO: 11851 - RNA, 20 nt, Artificial Sequence
  MKO10011851_A_Creb3l4
  gRNA
caggauaugucuaugcgaau

SEQ ID NO: 11852 - RNA, 20 nt, Artificial Sequence
  MKO10011852_A_Creb3l4
  gRNA
cugaauagagaugaguccga

SEQ ID NO: 11853 - RNA, 20 nt, Artificial Sequence
  MKO10011853_A_Creb3
  gRNA
gagaacaucccgcgauacug

SEQ ID NO: 11854 - RNA, 20 nt, Artificial Sequence
  MKO10011854_A_Creb3
  gRNA
ugcucagucccucaguaucg

SEQ ID NO: 11855 - RNA, 20 nt, Artificial Sequence
  MKO10011855_A_Creb3
  gRNA
aggagccuuaccuuagugag

SEQ ID NO: 11856 - RNA, 20 nt, Artificial Sequence
  MKO10011856_A_Creb5
  gRNA
cauccugccgccaugucgaa

SEQ ID NO: 11857 - RNA, 20 nt, Artificial Sequence
  MKO10011857_A_Creb5
  gRNA
auacaaccgccccagcccac

SEQ ID NO: 11858 - RNA, 20 nt, Artificial Sequence
  MKO10011858_A_Creb5
  gRNA
ccucauccaccacucuucgc

SEQ ID NO: 11859 - RNA, 20 nt, Artificial Sequence
  MKO10011859_A_Crebbp
  gRNA
uaacuggggguucacuccag

SEQ ID NO: 11860 - RNA, 20 nt, Artificial Sequence
  MKO10011860_A_Crebbp
  gRNA
ggacaacccuuuagucaaac

SEQ ID NO: 11861 - RNA, 20 nt, Artificial Sequence
  MKO10011861_A_Crebbp
  gRNA
uuguugguuucgcuugucac

SEQ ID NO: 11862 - RNA, 20 nt, Artificial Sequence
  MKO10011862_A_Crebl2
  gRNA
agcuauaugugcacuccgag

SEQ ID NO: 11863 - RNA, 20 nt, Artificial Sequence
  MKO10011863_A_Crebl2
  gRNA
ggcuuccguccucgcuuacc

SEQ ID NO: 11864 - RNA, 20 nt, Artificial Sequence
  MKO10011864_A_Crebl2
  gRNA
ucugcuccucgccagugagu

SEQ ID NO: 11865 - RNA, 20 nt, Artificial Sequence
  MKO10011865_A_Crebrf
  gRNA
cggguccauuccgcuuacgc

SEQ ID NO: 11866 - RNA, 20 nt, Artificial Sequence
  MKO10011866_A_Crebrf
  gRNA
uuguuguagcccagcguaag

SEQ ID NO: 11867 - RNA, 20 nt, Artificial Sequence
  MKO10011867_A_Crebrf
  gRNA
ccaggacuauccugcgucag

SEQ ID NO: 11868 - RNA, 20 nt, Artificial Sequence
  MKO10011868_A_Crebzf
  gRNA
cagggcguagucguggucgc

SEQ ID NO: 11869 - RNA, 20 nt, Artificial Sequence
  MKO10011869_A_Crebzf
  gRNA
cggccgcugcccgucuuaau

SEQ ID NO: 11870 - RNA, 20 nt, Artificial Sequence
  MKO10011870_A_Crebzf
  gRNA
ccccuguccucguccggcgg

SEQ ID NO: 11871 - RNA, 20 nt, Artificial Sequence
  MKO10011871_A_Creg1
  gRNA
cucaaucagugacgguccuc

SEQ ID NO: 11872 - RNA, 20 nt, Artificial Sequence
  MKO10011872_A_Creg1
  gRNA
ccgcugccaccccgcgaaga

SEQ ID NO: 11873 - RNA, 20 nt, Artificial Sequence
  MKO10011873_A_Creg1
  gRNA
gacauagucagcguagccuc

SEQ ID NO: 11874 - RNA, 20 nt, Artificial Sequence
  MKO10011874_A_Creg2
  gRNA
ugagcguuaaccgggcacau

SEQ ID NO: 11875 - RNA, 20 nt, Artificial Sequence
  MKO10011875_A_Creg2
  gRNA
aguggccccgacaguaugaa

SEQ ID NO: 11876 - RNA, 20 nt, Artificial Sequence
  MKO10011876_A_Creg2
  gRNA
cguguccuccuugugcgccg

SEQ ID NO: 11877 - RNA, 20 nt, Artificial Sequence
  MKO10011877_A_Creld1
  gRNA
acaggccucgcccccauagc

SEQ ID NO: 11878 - RNA, 20 nt, Artificial Sequence
  MKO10011878_A_Creld1
  gRNA
uguacucagugagacccgcc

SEQ ID NO: 11879 - RNA, 20 nt, Artificial Sequence
  MKO10011879_A_Creld1
  gRNA
gcuccgccucaaaguagcca

SEQ ID NO: 11880 - RNA, 20 nt, Artificial Sequence
  MKO10011880_A_Creld2
  gRNA
gaauuucgguggcggcaaca

SEQ ID NO: 11881 - RNA, 20 nt, Artificial Sequence
  MKO10011881_A_Creld2
  gRNA
cgcugucuaaguacgaauuc

SEQ ID NO: 11882 - RNA, 20 nt, Artificial Sequence
  MKO10011882_A_Creld2
  gRNA
caauagccguuuccgcugca

SEQ ID NO: 11883 - RNA, 20 nt, Artificial Sequence
  MKO10011883_A_Crem
  gRNA
ucgaaguguaacacguucug

SEQ ID NO: 11884 - RNA, 20 nt, Artificial Sequence
  MKO10011884_A_Crem
  gRNA
cuagucugauauaugcuagu

SEQ ID NO: 11885 - RNA, 20 nt, Artificial Sequence
  MKO10011885_A_Crem
  gRNA
uuucacgaagacccucauau

SEQ ID NO: 11886 - RNA, 20 nt, Artificial Sequence
  MKO10011886_A_Crhbp
  gRNA
caggagagggucguagaccg

SEQ ID NO: 11887 - RNA, 20 nt, Artificial Sequence
  MKO10011887_A_Crhbp
  gRNA
cucggguucgccgaugaaga

SEQ ID NO: 11888 - RNA, 20 nt, Artificial Sequence
  MKO10011888_A_Crhbp
  gRNA
cagaggagcagccguaccga

SEQ ID NO: 11889 - RNA, 20 nt, Artificial Sequence
  MKO10011889_A_Crhr1
  gRNA
ugccgucaucaucaacuacc

SEQ ID NO: 11890 - RNA, 20 nt, Artificial Sequence
  MKO10011890_A_Crhr1
  gRNA
cgaaccaccaacugcccugc

SEQ ID NO: 11891 - RNA, 20 nt, Artificial Sequence
  MKO10011891_A_Crhr1
  gRNA
ccugcagugcaaugccuccg

SEQ ID NO: 11892 - RNA, 20 nt, Artificial Sequence
  MKO10011892_A_Crhr2
  gRNA
cgcccucauugucaacuacc

SEQ ID NO: 11893 - RNA, 20 nt, Artificial Sequence
  MKO10011893_A_Crhr2
  gRNA
ccgugccccgaguacuucaa

SEQ ID NO: 11894 - RNA, 20 nt, Artificial Sequence
  MKO10011894_A_Crhr2
  gRNA
gugugaguaguugacccuug

SEQ ID NO: 11895 - RNA, 20 nt, Artificial Sequence
  MKO10011895_A_Crh
  gRNA
gcgccccuaacaugcggcug

SEQ ID NO: 11896 - RNA, 20 nt, Artificial Sequence
  MKO10011896_A_Crh
  gRNA
agccgcagccuggucgugcg

SEQ ID NO: 11897 - RNA, 20 nt, Artificial Sequence
  MKO10011897_A_Crh
  gRNA
gcgcucgcucgacagccgcg

SEQ ID NO: 11898 - RNA, 20 nt, Artificial Sequence
  MKO10011898_A_Crim1
  gRNA
cccauugauuauguugcagc

SEQ ID NO: 11899 - RNA, 20 nt, Artificial Sequence
  MKO10011899_A_Crim1
  gRNA
acuccccgaauagucucucg

SEQ ID NO: 11900 - RNA, 20 nt, Artificial Sequence
  MKO10011900_A_Crim1
  gRNA
gccgaaccaaccuugcuggc

SEQ ID NO: 11901 - RNA, 20 nt, Artificial Sequence
  MKO10011901_A_Crip1
  gRNA
gaagugccccaagugcgaca

SEQ ID NO: 11902 - RNA, 20 nt, Artificial Sequence
  MKO10011902_A_Crip1
  gRNA
auacaccuccuugucgcacu

SEQ ID NO: 11903 - RNA, 20 nt, Artificial Sequence
  MKO10011903_A_Crip1
  gRNA
cccugcuacuccgccauguu

SEQ ID NO: 11904 - RNA, 20 nt, Artificial Sequence
  MKO10011904_A_Crip2
  gRNA
cccugcuaugccacgcuguu

SEQ ID NO: 11905 - RNA, 20 nt, Artificial Sequence
  MKO10011905_A_Crip2
  gRNA
ucaucuacaggcgugaacau

SEQ ID NO: 11906 - RNA, 20 nt, Artificial Sequence
  MKO10011906_A_Crip2
  gRNA
cuacgagaagccucagaccg

SEQ ID NO: 11907 - RNA, 20 nt, Artificial Sequence
  MKO10011907_A_Crip3
  gRNA
ccagcaacuuuagccccccc

SEQ ID NO: 11908 - RNA, 20 nt, Artificial Sequence
  MKO10011908_A_Crip3
  gRNA
acgcggacaaguccagcuca

SEQ ID NO: 11909 - RNA, 20 nt, Artificial Sequence
  MKO10011909_A_Crip3
  gRNA
ugucagcaacccguuuacuu

SEQ ID NO: 11910 - RNA, 20 nt, Artificial Sequence
  MKO10011910_A_Cript
  gRNA
ucaggcaucugugcgaugug

SEQ ID NO: 11911 - RNA, 20 nt, Artificial Sequence
  MKO10011911_A_Cript
  gRNA
caaggcugcgccuacaaaaa

SEQ ID NO: 11912 - RNA, 20 nt, Artificial Sequence
  MKO10011912_A_Cript
  gRNA
gauggugcccggaacaccac

SEQ ID NO: 11913 - RNA, 20 nt, Artificial Sequence
  MKO10011913_A_Crisp1
  gRNA
uaauguccaaccacacuauc

SEQ ID NO: 11914 - RNA, 20 nt, Artificial Sequence
  MKO10011914_A_Crisp1
  gRNA
cccaaagcaaccugauagug

SEQ ID NO: 11915 - RNA, 20 nt, Artificial Sequence
  MKO10011915_A_Crisp1
  gRNA
uggcagugacuuacuaaaaa

SEQ ID NO: 11916 - RNA, 20 nt, Artificial Sequence
  MKO10011916_A_Crisp2
  gRNA
guaauguccgacagcugaau

SEQ ID NO: 11917 - RNA, 20 nt, Artificial Sequence
  MKO10011917_A_Crisp2
  gRNA
uuuaguaugucgcugccagu

SEQ ID NO: 11918 - RNA, 20 nt, Artificial Sequence
  MKO10011918_A_Crisp2
  gRNA
uggcagcgacauacuaaaaa

SEQ ID NO: 11919 - RNA, 20 nt, Artificial Sequence
  MKO10011919_A_Crisp3
  gRNA
cacaccaaauauaagaccuu

SEQ ID NO: 11920 - RNA, 20 nt, Artificial Sequence
  MKO10011920_A_Crisp3
  gRNA
ugucaucuuaccuuguacca

SEQ ID NO: 11921 - RNA, 20 nt, Artificial Sequence
  MKO10011921_A_Crisp3
  gRNA
uggcagugacuuacuaaaua

SEQ ID NO: 11922 - RNA, 20 nt, Artificial Sequence
  MKO10011922_A_Crisp4
  gRNA
ucaauacccauaacgccuuc

SEQ ID NO: 11923 - RNA, 20 nt, Artificial Sequence
  MKO10011923_A_Crisp4
  gRNA
cgaaacugaucacuacacuc

SEQ ID NO: 11924 - RNA, 20 nt, Artificial Sequence
  MKO10011924_A_Crisp4
  gRNA
gaaaaguguccccgccagcc

SEQ ID NO: 11925 - RNA, 20 nt, Artificial Sequence
  MKO10011925_A_Crispld1
  gRNA
ugggcuacuaguagcagaau

SEQ ID NO: 11926 - RNA, 20 nt, Artificial Sequence
  MKO10011926_A_Crispld1
  gRNA
auggcccaaggcagucuacu

SEQ ID NO: 11927 - RNA, 20 nt, Artificial Sequence
  MKO10011927_A_Crispld1
  gRNA
ggccacgcaccuuacaaaca

SEQ ID NO: 11928 - RNA, 20 nt, Artificial Sequence
  MKO10011928_A_Crispld2
  gRNA
ugugcagucaugguacgacg

SEQ ID NO: 11929 - RNA, 20 nt, Artificial Sequence
  MKO10011929_A_Crispld2
  gRNA
ccagacguucauguuccgac

SEQ ID NO: 11930 - RNA, 20 nt, Artificial Sequence
  MKO10011930_A_Crispld2
  gRNA
ccugucggaacaugaacguc

SEQ ID NO: 11931 - RNA, 20 nt, Artificial Sequence
  MKO10011931_A_Crkl
  gRNA
ccugggcgccgguucgauua

SEQ ID NO: 11932 - RNA, 20 nt, Artificial Sequence
  MKO10011932_A_Crkl
  gRNA
cccgaucuuaaagcggcggu

SEQ ID NO: 11933 - RNA, 20 nt, Artificial Sequence
  MKO10011933_A_Crkl
  gRNA
gguugagcauacgcaugagc

SEQ ID NO: 11934 - RNA, 20 nt, Artificial Sequence
  MKO10011934_A_Crk
  gRNA
cauggcgggcaacuucgacu

SEQ ID NO: 11935 - RNA, 20 nt, Artificial Sequence
  MKO10011935_A_Crk
  gRNA
cgagucgaaguugcccgcca

SEQ ID NO: 11936 - RNA, 20 nt, Artificial Sequence
  MKO10011936_A_Crk
  gRNA
ggucuauacuucuccacgua

SEQ ID NO: 11937 - RNA, 20 nt, Artificial Sequence
  MKO10011937_A_Crlf1
  gRNA
aacgcggcucacgugcacgu

SEQ ID NO: 11938 - RNA, 20 nt, Artificial Sequence
  MKO10011938_A_Crlf1
  gRNA
ugaaggaucucacgugccgc

SEQ ID NO: 11939 - RNA, 20 nt, Artificial Sequence
  MKO10011939_A_Crlf1
  gRNA
agcggaucugguacuuggcu

SEQ ID NO: 11940 - RNA, 20 nt, Artificial Sequence
  MKO10011940_A_Crlf2
  gRNA
ucgccccgggccgcgcacua

SEQ ID NO: 11941 - RNA, 20 nt, Artificial Sequence
  MKO10011941_A_Crlf2
  gRNA
cuaggcagcgcgcguccgcc

SEQ ID NO: 11942 - RNA, 20 nt, Artificial Sequence
  MKO10011942_A_Crlf2
  gRNA
gcaaugacgaugaggacgcc

SEQ ID NO: 11943 - RNA, 20 nt, Artificial Sequence
  MKO10011943_A_Crlf3
  gRNA
ucgucccaccuucucggacc

SEQ ID NO: 11944 - RNA, 20 nt, Artificial Sequence
  MKO10011944_A_Crlf3
  gRNA
caucauagugcgauggugua

SEQ ID NO: 11945 - RNA, 20 nt, Artificial Sequence
  MKO10011945_A_Crlf3
  gRNA
gaagcuauuggaugagcgau

SEQ ID NO: 11946 - RNA, 20 nt, Artificial Sequence
  MKO10011946_A_Crls1
  gRNA
acuuaccaaauccguuagcc

SEQ ID NO: 11947 - RNA, 20 nt, Artificial Sequence
  MKO10011947_A_Crls1
  gRNA
auggauuuauugcucgaaac

SEQ ID NO: 11948 - RNA, 20 nt, Artificial Sequence
  MKO10011948_A_Crls1
  gRNA
aaccuagccguggcauagca

SEQ ID NO: 11949 - RNA, 20 nt, Artificial Sequence
  MKO10011949_A_Crmp1
  gRNA
cauucggccauucgccucga

SEQ ID NO: 11950 - RNA, 20 nt, Artificial Sequence
  MKO10011950_A_Crmp1
  gRNA
agacaucggcguagaaggac

SEQ ID NO: 11951 - RNA, 20 nt, Artificial Sequence
  MKO10011951_A_Crmp1
  gRNA
accagcuugugauguccacg

SEQ ID NO: 11952 - RNA, 20 nt, Artificial Sequence
  MKO10011952_A_Crnkl1
  gRNA
gccggccgaagugcagauaa

SEQ ID NO: 11953 - RNA, 20 nt, Artificial Sequence
  MKO10011953_A_Crnkl1
  gRNA
aaggauauagcguucauaga

SEQ ID NO: 11954 - RNA, 20 nt, Artificial Sequence
  MKO10011954_A_Crnkl1
  gRNA
ccauccagcgcucaaacacc

SEQ ID NO: 11955 - RNA, 20 nt, Artificial Sequence
  MKO10011955_A_Crnn
  gRNA
cgaaggcuucgaugaucccg

SEQ ID NO: 11956 - RNA, 20 nt, Artificial Sequence
  MKO10011956_A_Crnn
  gRNA
aagccuucgggugcuaugcc

SEQ ID NO: 11957 - RNA, 20 nt, Artificial Sequence
  MKO10011957_A_Crnn
  gRNA
ucagauaugcaagcacccuu

SEQ ID NO: 11958 - RNA, 20 nt, Artificial Sequence
  MKO10011958_A_Crocc
  gRNA
gucccgcguggaggaccugc

SEQ ID NO: 11959 - RNA, 20 nt, Artificial Sequence
  MKO10011959_A_Crocc
  gRNA
cgugcccaucuucaccucgc

SEQ ID NO: 11960 - RNA, 20 nt, Artificial Sequence
  MKO10011960_A_Crocc
  gRNA
cagcgcucuucugcgccuag

SEQ ID NO: 11961 - RNA, 20 nt, Artificial Sequence
  MKO10011961_A_Crot
  gRNA
uacucgucuucauuugcgaa

SEQ ID NO: 11962 - RNA, 20 nt, Artificial Sequence
  MKO10011962_A_Crot
  gRNA
aucgaaucucuaguaauucc

SEQ ID NO: 11963 - RNA, 20 nt, Artificial Sequence
  MKO10011963_A_Crot
  gRNA
cgcucugccucgacacagca

SEQ ID NO: 11964 - RNA, 20 nt, Artificial Sequence
  MKO10011964_A_Crp
  gRNA
uguuuauuaagccgcagcug

SEQ ID NO: 11965 - RNA, 20 nt, Artificial Sequence
  MKO10011965_A_Crp
  gRNA
caggagcaggacucguaugg

SEQ ID NO: 11966 - RNA, 20 nt, Artificial Sequence
  MKO10011966_A_Crp
  gRNA
uagccauggagaagcuacuc

SEQ ID NO: 11967 - RNA, 20 nt, Artificial Sequence
  MKO10011967_A_Cruac1
  gRNA
gaccgucaggggaacgccau

SEQ ID NO: 11968 - RNA, 20 nt, Artificial Sequence
  MKO10011968_A_Cruac1
  gRNA
caauauucaccagccgauuc

SEQ ID NO: 11969 - RNA, 20 nt, Artificial Sequence
  MKO10011969_A_Cruac1
  gRNA
ccugagugaugacgucaaug

SEQ ID NO: 11970 - RNA, 20 nt, Artificial Sequence
  MKO10011970_A_Cruam
  gRNA
cacacguuagagugagcguu

SEQ ID NO: 11971 - RNA, 20 nt, Artificial Sequence
  MKO10011971_A_Cruam
  gRNA
guccaauguaacucuccgag

SEQ ID NO: 11972 - RNA, 20 nt, Artificial Sequence
  MKO10011972_A_Cruam
  gRNA
gacuccuuuccagccaaccg

SEQ ID NO: 11973 - RNA, 20 nt, Artificial Sequence
  MKO10011973_A_Cruap
  gRNA
cuuggaaaccaagucguacg

SEQ ID NO: 11974 - RNA, 20 nt, Artificial Sequence
  MKO10011974_A_Cruap
  gRNA
cccgcaccgcacggacaaac

SEQ ID NO: 11975 - RNA, 20 nt, Artificial Sequence
  MKO10011975_A_Cruap
  gRNA
gugguguaccucguacgacu

SEQ ID NO: 11976 - RNA, 20 nt, Artificial Sequence
  MKO10011976_A_Cruc1
  gRNA
ccgacucguguccaggccug

SEQ ID NO: 11977 - RNA, 20 nt, Artificial Sequence
  MKO10011977_A_Cruc1
  gRNA
gacagaguauaucgugagcg

SEQ ID NO: 11978 - RNA, 20 nt, Artificial Sequence
  MKO10011978_A_Cruc1
  gRNA
cucucuucuggugcgcaucc

SEQ ID NO: 11979 - RNA, 20 nt, Artificial Sequence
  MKO10011979_A_Cruc2
  gRNA
ucucggagcacucggcacca

SEQ ID NO: 11980 - RNA, 20 nt, Artificial Sequence
  MKO10011980_A_Cruc2
  gRNA
guacccguuccaccaaccca

SEQ ID NO: 11981 - RNA, 20 nt, Artificial Sequence
  MKO10011981_A_Cruc2
  gRNA
uauacaaggagcucccauua

SEQ ID NO: 11982 - RNA, 20 nt, Artificial Sequence
  MKO10011982_A_Cruc3
  gRNA
caucaagccgauaauguucg

SEQ ID NO: 11983 - RNA, 20 nt, Artificial Sequence
  MKO10011983_A_Cruc3
  gRNA
guaaggaucccccgugguac

SEQ ID NO: 11984 - RNA, 20 nt, Artificial Sequence
  MKO10011984_A_Cruc3
  gRNA
guuccgcagcuggcucacgu

SEQ ID NO: 11985 - RNA, 20 nt, Artificial Sequence
  MKO10011985_A_Crxos
  gRNA
uggccaugaucuuucgaucc

SEQ ID NO: 11986 - RNA, 20 nt, Artificial Sequence
  MKO10011986_A_Crxos
  gRNA
ugucuuagccuccuguaccc

SEQ ID NO: 11987 - RNA, 20 nt, Artificial Sequence
  MKO10011987_A_Crxos
  gRNA
cccacaaagcccugugcugc

SEQ ID NO: 11988 - RNA, 20 nt, Artificial Sequence
  MKO10011988_A_Crx
  gRNA
ccaaggcucguccugcgaag

SEQ ID NO: 11989 - RNA, 20 nt, Artificial Sequence
  MKO10011989_A_Crx
  gRNA
gggagcggaccacauucacc

SEQ ID NO: 11990 - RNA, 20 nt, Artificial Sequence
  MKO10011990_A_Crx
  gRNA
ggaucccuaccuuucgccca

SEQ ID NO: 11991 - RNA, 20 nt, Artificial Sequence
  MKO10011991_A_Cry1
  gRNA
gaacgccauauuucucauca

SEQ ID NO: 11992 - RNA, 20 nt, Artificial Sequence
  MKO10011992_A_Cry1
  gRNA
aacugaggcacuuacacguu

SEQ ID NO: 11993 - RNA, 20 nt, Artificial Sequence
  MKO10011993_A_Cry1
  gRNA
uccuuaggcuuugauacaga

SEQ ID NO: 11994 - RNA, 20 nt, Artificial Sequence
  MKO10011994_A_Cry2
  gRNA
gcacgccauaggugucguca

SEQ ID NO: 11995 - RNA, 20 nt, Artificial Sequence
  MKO10011995_A_Cry2
  gRNA
acacccucuaugaccuagac

SEQ ID NO: 11996 - RNA, 20 nt, Artificial Sequence
  MKO10011996_A_Cry2
  gRNA
ccugaaagcgcuuguaggua

SEQ ID NO: 11997 - RNA, 20 nt, Artificial Sequence
  MKO10011997_A_Cryaa
  gRNA
gguuucagguccgaucugac

SEQ ID NO: 11998 - RNA, 20 nt, Artificial Sequence
  MKO10011998_A_Cryaa
  gRNA
cgaagaacuggucgaacagu

SEQ ID NO: 11999 - RNA, 20 nt, Artificial Sequence
  MKO10011999_A_Cryaa
  gRNA
ccccaagaacaaccccguca

SEQ ID NO: 12000 - RNA, 20 nt, Artificial Sequence
  MKO10012000_A_Cryab
  gRNA
ggcguucuucgugcuugccg

SEQ ID NO: 12001 - RNA, 20 nt, Artificial Sequence
  MKO10012001_A_Cryab
  gRNA
cggcaagcacgaagaacgcc

SEQ ID NO: 12002 - RNA, 20 nt, Artificial Sequence
  MKO10012002_A_Cryab
  gRNA
caauccagcugggugcccgc

SEQ ID NO: 12003 - RNA, 20 nt, Artificial Sequence
  MKO10012003_A_Cryba1
  gRNA
ccgcuccaggcaucccaucg

SEQ ID NO: 12004 - RNA, 20 nt, Artificial Sequence
  MKO10012004_A_Cryba1
  gRNA
caugagacgcucaauaugau

SEQ ID NO: 12005 - RNA, 20 nt, Artificial Sequence
  MKO10012005_A_Cryba1
  gRNA
cgccccacauuguaucuuca

SEQ ID NO: 12006 - RNA, 20 nt, Artificial Sequence
  MKO10012006_A_Cryba2
  gRNA
uucgaaacuccccgcugugc

SEQ ID NO: 12007 - RNA, 20 nt, Artificial Sequence
  MKO10012007_A_Cryba2
  gRNA
cuucgaguaccccgacuucc

SEQ ID NO: 12008 - RNA, 20 nt, Artificial Sequence
  MKO10012008_A_Cryba2
  gRNA
caugagcagcgcccccgcgc

SEQ ID NO: 12009 - RNA, 20 nt, Artificial Sequence
  MKO10012009_A_Cryba4
  gRNA
agaggggcgauuacccgggc

SEQ ID NO: 12010 - RNA, 20 nt, Artificial Sequence
  MKO10012010_A_Cryba4
  gRNA
uguagaaccaccgcgacuca

SEQ ID NO: 12011 - RNA, 20 nt, Artificial Sequence
  MKO10012011_A_Cryba4
  gRNA
aaggaggugagccucuccgc

SEQ ID NO: 12012 - RNA, 20 nt, Artificial Sequence
  MKO10012012_A_Crybb1
  gRNA
acggucccgagacgacgauc

SEQ ID NO: 12013 - RNA, 20 nt, Artificial Sequence
  MKO10012013_A_Crybb1
  gRNA
acagcugaucgucuucgagc

SEQ ID NO: 12014 - RNA, 20 nt, Artificial Sequence
  MKO10012014_A_Crybb1
  gRNA
cauaagaucugccuguucga

SEQ ID NO: 12015 - RNA, 20 nt, Artificial Sequence
  MKO10012015_A_Crybb2
  gRNA
cagcugggugggcuacgagc

SEQ ID NO: 12016 - RNA, 20 nt, Artificial Sequence
  MKO10012016_A_Crybb2
  gRNA
cgugccgcucugcacacgca

SEQ ID NO: 12017 - RNA, 20 nt, Artificial Sequence
  MKO10012017_A_Crybb2
  gRNA
ggagaaggcgggcuccgucc

SEQ ID NO: 12018 - RNA, 20 nt, Artificial Sequence
  MKO10012018_A_Crybb3
  gRNA
cgccccgcucgaacacguac

SEQ ID NO: 12019 - RNA, 20 nt, Artificial Sequence
  MKO10012019_A_Crybb3
  gRNA
gguggcuggcguucgagcgc

SEQ ID NO: 12020 - RNA, 20 nt, Artificial Sequence
  MKO10012020_A_Crybb3
  gRNA
agaagggggacuacccucgc

SEQ ID NO: 12021 - RNA, 20 nt, Artificial Sequence
  MKO10012021_A_Crybg3
  gRNA
aaagaguguuagaccgggac

SEQ ID NO: 12022 - RNA, 20 nt, Artificial Sequence
  MKO10012022_A_Crybg3
  gRNA
acaccgaucuguccccaaug

SEQ ID NO: 12023 - RNA, 20 nt, Artificial Sequence
  MKO10012023_A_Crybg3
  gRNA
agacacguuugauagagccc

SEQ ID NO: 12024 - RNA, 20 nt, Artificial Sequence
  MKO10012024_A_Cryga
  gRNA
gaucuacuccaugcacgugc

SEQ ID NO: 12025 - RNA, 20 nt, Artificial Sequence
  MKO10012025_A_Cryga
  gRNA
cauggaggcggaagcgaucg

SEQ ID NO: 12026 - RNA, 20 nt, Artificial Sequence
  MKO10012026_A_Cryga
  gRNA
ccgcugcaacuccauccgug

SEQ ID NO: 12027 - RNA, 20 nt, Artificial Sequence
  MKO10012027_A_Crygb
  gRNA
ucgccuaaaagagccaacuu

SEQ ID NO: 12028 - RNA, 20 nt, Artificial Sequence
  MKO10012028_A_Crygb
  gRNA
agacgauugucucucucuuc

SEQ ID NO: 12029 - RNA, 20 nt, Artificial Sequence
  MKO10012029_A_Crygb
  gRNA
ccaaacucacuugggggaug

SEQ ID NO: 12030 - RNA, 20 nt, Artificial Sequence
  MKO10012030_A_Crygc
  gRNA
cgcucgcugcaagugcugga

SEQ ID NO: 12031 - RNA, 20 nt, Artificial Sequence
  MKO10012031_A_Crygc
  gRNA
ggaucgcuuccaccucagug

SEQ ID NO: 12032 - RNA, 20 nt, Artificial Sequence
  MKO10012032_A_Crygc
  gRNA
uuuacagaucaccuucuucg

SEQ ID NO: 12033 - RNA, 20 nt, Artificial Sequence
  MKO10012033_A_Crygd
  gRNA
guacuggcagcccgugaagu

SEQ ID NO: 12034 - RNA, 20 nt, Artificial Sequence
  MKO10012034_A_Crygd
  gRNA
ccagaugauagaguucacgg

SEQ ID NO: 12035 - RNA, 20 nt, Artificial Sequence
  MKO10012035_A_Crygd
  gRNA
ccuccgugaacucuaucauc

SEQ ID NO: 12036 - RNA, 20 nt, Artificial Sequence
  MKO10012036_A_Cryge
  gRNA
cgucugugaucuccaccauu

SEQ ID NO: 12037 - RNA, 20 nt, Artificial Sequence
  MKO10012037_A_Cryge
  gRNA
gaucuugauccugugagaac

SEQ ID NO: 12038 - RNA, 20 nt, Artificial Sequence
  MKO10012038_A_Cryge
  gRNA
aaagacucacgugggggaug

SEQ ID NO: 12039 - RNA, 20 nt, Artificial Sequence
  MKO10012039_A_Crygf
  gRNA
aguauaggcgcuaccacgau

SEQ ID NO: 12040 - RNA, 20 nt, Artificial Sequence
  MKO10012040_A_Crygf
  gRNA
ccgcugcaacucugugcgag

SEQ ID NO: 12041 - RNA, 20 nt, Artificial Sequence
  MKO10012041_A_Crygf
  gRNA
acacucaguccacuucucac

SEQ ID NO: 12042 - RNA, 20 nt, Artificial Sequence
  MKO10012042_A_Crygn
  gRNA
cacgcgugcagucgcuccgc

SEQ ID NO: 12043 - RNA, 20 nt, Artificial Sequence
  MKO10012043_A_Crygn
  gRNA
ccgggugaauuccauccgug

SEQ ID NO: 12044 - RNA, 20 nt, Artificial Sequence
  MKO10012044_A_Crygn
  gRNA
ccgcggccgcauguacgugu

SEQ ID NO: 12045 - RNA, 20 nt, Artificial Sequence
  MKO10012045_A_Crygs
  gRNA
aguaccggaagcccgucgau

SEQ ID NO: 12046 - RNA, 20 nt, Artificial Sequence
  MKO10012046_A_Crygs
  gRNA
ccagucguuccgccgcauug

SEQ ID NO: 12047 - RNA, 20 nt, Artificial Sequence
  MKO10012047_A_Crygs
  gRNA
uaauggaguugcagcgacuu

SEQ ID NO: 12048 - RNA, 20 nt, Artificial Sequence
  MKO10012048_A_Cryl1
  gRNA
cacugaugacggcguacugc

SEQ ID NO: 12049 - RNA, 20 nt, Artificial Sequence
  MKO10012049_A_Cryl1
  gRNA
uaacccggucauccacaaug

SEQ ID NO: 12050 - RNA, 20 nt, Artificial Sequence
  MKO10012050_A_Cryl1
  gRNA
cgaagccgucaaucuccuuc

SEQ ID NO: 12051 - RNA, 20 nt, Artificial Sequence
  MKO10012051_A_Crym
  gRNA
ucucauagugacuguacgcc

SEQ ID NO: 12052 - RNA, 20 nt, Artificial Sequence
  MKO10012052_A_Crym
  gRNA
cggucuuaccuuuguggcaa

SEQ ID NO: 12053 - RNA, 20 nt, Artificial Sequence
  MKO10012053_A_Crym
  gRNA
cacagcgguccccucccauc

SEQ ID NO: 12054 - RNA, 20 nt, Artificial Sequence
  MKO10012054_A_Cryzl1
  gRNA
ucgaguacaugagcauuacc

SEQ ID NO: 12055 - RNA, 20 nt, Artificial Sequence
  MKO10012055_A_Cryzl1
  gRNA
cgaagaccccgggcucugug

SEQ ID NO: 12056 - RNA, 20 nt, Artificial Sequence
  MKO10012056_A_Cryzl1
  gRNA
acaaaguuauccucugugac

SEQ ID NO: 12057 - RNA, 20 nt, Artificial Sequence
  MKO10012057_A_Cryz
  gRNA
uuccgcguagccaccagaga

SEQ ID NO: 12058 - RNA, 20 nt, Artificial Sequence
  MKO10012058_A_Cryz
  gRNA
cgcuuucgccagcucgagca

SEQ ID NO: 12059 - RNA, 20 nt, Artificial Sequence
  MKO10012059_A_Cryz
  gRNA
guagagacauacauucgcuc

SEQ ID NO: 12060 - RNA, 20 nt, Artificial Sequence
  MKO10012060_A_Csad
  gRNA
gcugaagaaacuccgugccc

SEQ ID NO: 12061 - RNA, 20 nt, Artificial Sequence
  MKO10012061_A_Csad
  gRNA
ucuccuccuaggucugcgaa

SEQ ID NO: 12062 - RNA, 20 nt, Artificial Sequence
  MKO10012062_A_Csad
  gRNA
uuagauccccaugcucuggc

SEQ ID NO: 12063 - RNA, 20 nt, Artificial Sequence
  MKO10012063_A_Csdc2
  gRNA
cgagggggaguacgugccug

SEQ ID NO: 12064 - RNA, 20 nt, Artificial Sequence
  MKO10012064_A_Csdc2
  gRNA
agagucuacauuaccgccag

SEQ ID NO: 12065 - RNA, 20 nt, Artificial Sequence
  MKO10012065_A_Csdc2
  gRNA
gacucacgcugaguaugucc

SEQ ID NO: 12066 - RNA, 20 nt, Artificial Sequence
  MKO10012066_A_Csde1
  gRNA
aguguaugcuacgaacguaa

SEQ ID NO: 12067 - RNA, 20 nt, Artificial Sequence
  MKO10012067_A_Csde1
  gRNA
gauuuacucucuaaguugug

SEQ ID NO: 12068 - RNA, 20 nt, Artificial Sequence
  MKO10012068_A_Csde1
  gRNA
uaugcuguugaaaaagaagc

SEQ ID NO: 12069 - RNA, 20 nt, Artificial Sequence
  MKO10012069_A_Cse1l
  gRNA
aaguuucucgaauccguaga

SEQ ID NO: 12070 - RNA, 20 nt, Artificial Sequence
  MKO10012070_A_Cse1l
  gRNA
auagugagugcgcuguacga

SEQ ID NO: 12071 - RNA, 20 nt, Artificial Sequence
  MKO10012071_A_Cse1l
  gRNA
auggugaaucgcuuucagag

SEQ ID NO: 12072 - RNA, 20 nt, Artificial Sequence
  MKO10012072_A_Csf1r
  gRNA
gaaucccacuucggcguuag

SEQ ID NO: 12073 - RNA, 20 nt, Artificial Sequence
  MKO10012073_A_Csf1r
  gRNA
cggauaaugaacccucgcca

SEQ ID NO: 12074 - RNA, 20 nt, Artificial Sequence
  MKO10012074_A_Csf1r
  gRNA
uucaagcucgguacaacggu

SEQ ID NO: 12075 - RNA, 20 nt, Artificial Sequence
  MKO10012075_A_Csf1
  gRNA
cagcugcccguaugaccgcg

SEQ ID NO: 12076 - RNA, 20 nt, Artificial Sequence
  MKO10012076_A_Csf1
  gRNA
cgaagaagggcagcgccccg

SEQ ID NO: 12077 - RNA, 20 nt, Artificial Sequence
  MKO10012077_A_Csf1
  gRNA
ccaaugcuaacgccaccgag

SEQ ID NO: 12078 - RNA, 20 nt, Artificial Sequence
  MKO10012078_A_Csf2ra
  gRNA
ccccacguaccgagacucgc

SEQ ID NO: 12079 - RNA, 20 nt, Artificial Sequence
  MKO10012079_A_Csf2ra
  gRNA
cagcgaguaccggacguccg

SEQ ID NO: 12080 - RNA, 20 nt, Artificial Sequence
  MKO10012080_A_Csf2ra
  gRNA
aggcugagcuucgucaacga

SEQ ID NO: 12081 - RNA, 20 nt, Artificial Sequence
  MKO10012081_A_Csf2rb2
  gRNA
cuuccagccagaucgugacc

SEQ ID NO: 12082 - RNA, 20 nt, Artificial Sequence
  MKO10012082_A_Csf2rb2
  gRNA
uggaugcccaggucacgauc

SEQ ID NO: 12083 - RNA, 20 nt, Artificial Sequence
  MKO10012083_A_Csf2rb2
  gRNA
guggcacucacuugucuagc

SEQ ID NO: 12084 - RNA, 20 nt, Artificial Sequence
  MKO10012084_A_Csf2rb
  gRNA
acgaagacuacuacuccuuc

SEQ ID NO: 12085 - RNA, 20 nt, Artificial Sequence
  MKO10012085_A_Csf2rb
  gRNA
guaguagucuucguuuguga

SEQ ID NO: 12086 - RNA, 20 nt, Artificial Sequence
  MKO10012086_A_Csf2rb
  gRNA
guggcacucacuucucuagc

SEQ ID NO: 12087 - RNA, 20 nt, Artificial Sequence
  MKO10012087_A_Csf2
  gRNA
ccgccugaagauauucgagc

SEQ ID NO: 12088 - RNA, 20 nt, Artificial Sequence
  MKO10012088_A_Csf2
  gRNA
gcugucuaugaaauccgcau

SEQ ID NO: 12089 - RNA, 20 nt, Artificial Sequence
  MKO10012089_A_Csf2
  gRNA
guucaaggcgcccuugaguu

SEQ ID NO: 12090 - RNA, 20 nt, Artificial Sequence
  MKO10012090_A_Csf3r
  gRNA
uucacccccuguuguccgcc

SEQ ID NO: 12091 - RNA, 20 nt, Artificial Sequence
  MKO10012091_A_Csf3r
  gRNA
aaagcugugccucgacccca

SEQ ID NO: 12092 - RNA, 20 nt, Artificial Sequence
  MKO10012092_A_Csf3r
  gRNA
cuccuguuccauguacucac

SEQ ID NO: 12093 - RNA, 20 nt, Artificial Sequence
  MKO10012093_A_Csf3
  gRNA
cuacaagcugugucaccccg

SEQ ID NO: 12094 - RNA, 20 nt, Artificial Sequence
  MKO10012094_A_Csf3
  gRNA
gagcaaggcgagccgucucc

SEQ ID NO: 12095 - RNA, 20 nt, Artificial Sequence
  MKO10012095_A_Csf3
  gRNA
accuccugcccggcgcugga

SEQ ID NO: 12096 - RNA, 20 nt, Artificial Sequence
  MKO10012096_A_Csgalnacu1
  gRNA
gugauggccguagauuacgc

SEQ ID NO: 12097 - RNA, 20 nt, Artificial Sequence
  MKO10012097_A_Csgalnacu1
  gRNA
cagggauuuaccgaaccgaa

SEQ ID NO: 12098 - RNA, 20 nt, Artificial Sequence
  MKO10012098_A_Csgalnacu1
  gRNA
cacgaugcagucccuccgcu

SEQ ID NO: 12099 - RNA, 20 nt, Artificial Sequence
  MKO10012099_A_Csgalnacu2
  gRNA
uuggacgaagaauuuaaucg

SEQ ID NO: 12100 - RNA, 20 nt, Artificial Sequence
  MKO10012100_A_Csgalnacu2
  gRNA
gugacccucuuccgcccuuu

SEQ ID NO: 12101 - RNA, 20 nt, Artificial Sequence
  MKO10012101_A_Csgalnacu2
  gRNA
uucuucguccaacgagacca

SEQ ID NO: 12102 - RNA, 20 nt, Artificial Sequence
  MKO10012102_A_Csk
  gRNA
aguuggugcuuucccgcacg

SEQ ID NO: 12103 - RNA, 20 nt, Artificial Sequence
  MKO10012103_A_Csk
  gRNA
gcucccgugugaucuugccg

SEQ ID NO: 12104 - RNA, 20 nt, Artificial Sequence
  MKO10012104_A_Csk
  gRNA
ggagggcaccguggcggccc

SEQ ID NO: 12105 - RNA, 20 nt, Artificial Sequence
  MKO10012105_A_Csl
  gRNA
ucucccucaugccguaguac

SEQ ID NO: 12106 - RNA, 20 nt, Artificial Sequence
  MKO10012106_A_Csl
  gRNA
ugcuccaguacuacggcaug

SEQ ID NO: 12107 - RNA, 20 nt, Artificial Sequence
  MKO10012107_A_Csl
  gRNA
cgaacuugaaagacgugcug

SEQ ID NO: 12108 - RNA, 20 nt, Artificial Sequence
  MKO10012108_A_Csmd1
  gRNA
cuauguugaaccucguuccg

SEQ ID NO: 12109 - RNA, 20 nt, Artificial Sequence
  MKO10012109_A_Csmd1
  gRNA
uuauuacuggggagcgcaac

SEQ ID NO: 12110 - RNA, 20 nt, Artificial Sequence
  MKO10012110_A_Csmd1
  gRNA
cacggaacgagguucaacau

SEQ ID NO: 12111 - RNA, 20 nt, Artificial Sequence
  MKO10012111_A_Csmd2os
  gRNA
ugucaaguguaagcgcuuuc

SEQ ID NO: 12112 - RNA, 20 nt, Artificial Sequence
  MKO10012112_A_Csmd2os
  gRNA
ccucccgucgcuauguaccc

SEQ ID NO: 12113 - RNA, 20 nt, Artificial Sequence
  MKO10012113_A_Csmd2os
  gRNA
cgaccuuaccuugacuccca

SEQ ID NO: 12114 - RNA, 20 nt, Artificial Sequence
  MKO10012114_A_Csmd2
  gRNA
cguaguucggguagccguaa

SEQ ID NO: 12115 - RNA, 20 nt, Artificial Sequence
  MKO10012115_A_Csmd2
  gRNA
gagaaugguaccuuguucga

SEQ ID NO: 12116 - RNA, 20 nt, Artificial Sequence
  MKO10012116_A_Csmd2
  gRNA
ugacugcauagucgcugaug

SEQ ID NO: 12117 - RNA, 20 nt, Artificial Sequence
  MKO10012117_A_Csmd3
  gRNA
auccucauccgacgaacuuu

SEQ ID NO: 12118 - RNA, 20 nt, Artificial Sequence
  MKO10012118_A_Csmd3
  gRNA
aaccuuguccuaaaguucgu

SEQ ID NO: 12119 - RNA, 20 nt, Artificial Sequence
  MKO10012119_A_Csmd3
  gRNA
ggaagcuguauuaaccgaau

SEQ ID NO: 12120 - RNA, 20 nt, Artificial Sequence
  MKO10012120_A_Csn1s1
  gRNA
ugauuuagguugagauacuu

SEQ ID NO: 12121 - RNA, 20 nt, Artificial Sequence
  MKO10012121_A_Csn1s1
  gRNA
aaaguaucucaaccuaaauc

SEQ ID NO: 12122 - RNA, 20 nt, Artificial Sequence
  MKO10012122_A_Csn1s2a
  gRNA
ugcuagcaguucauccagug

SEQ ID NO: 12123 - RNA, 20 nt, Artificial Sequence
  MKO10012123_A_Csn1s2a
  gRNA
cguguucuuccaaacaacua

SEQ ID NO: 12124 - RNA, 20 nt, Artificial Sequence
  MKO10012124_A_Csn1s2a
  gRNA
aaaggauaaguccuccagug

SEQ ID NO: 12125 - RNA, 20 nt, Artificial Sequence
  MKO10012125_A_Csn1s2b
  gRNA
uacuucuugagaguuaucca

SEQ ID NO: 12126 - RNA, 20 nt, Artificial Sequence
  MKO10012126_A_Csn1s2b
  gRNA
ggagcaauacaucuccagug

SEQ ID NO: 12127 - RNA, 20 nt, Artificial Sequence
  MKO10012127_A_Csn2
  gRNA
aucuguugaacauaucaaug

SEQ ID NO: 12128 - RNA, 20 nt, Artificial Sequence
  MKO10012128_A_Csn2
  gRNA
gacugauaguauuuccagug

SEQ ID NO: 12129 - RNA, 20 nt, Artificial Sequence
  MKO10012129_A_Csn2
  gRNA
uuucuagcagaaacuucaga

SEQ ID NO: 12130 - RNA, 20 nt, Artificial Sequence
  MKO10012130_A_Csn3
  gRNA
aaccuaauuacuaccacuac

SEQ ID NO: 12131 - RNA, 20 nt, Artificial Sequence
  MKO10012131_A_Csn3
  gRNA
uaucaacuuacguuugaauc

SEQ ID NO: 12132 - RNA, 20 nt, Artificial Sequence
  MKO10012132_A_Csn3
  gRNA
acugggacuguaguagucuc

SEQ ID NO: 12133 - RNA, 20 nt, Artificial Sequence
  MKO10012133_A_Csnk1a1
  gRNA
aaggugcuuaccguauguga

SEQ ID NO: 12134 - RNA, 20 nt, Artificial Sequence
  MKO10012134_A_Csnk1a1
  gRNA
cguaucgggcagugccagug

SEQ ID NO: 12135 - RNA, 20 nt, Artificial Sequence
  MKO10012135_A_Csnk1a1
  gRNA
cguacuuauguuagcugacc

SEQ ID NO: 12136 - RNA, 20 nt, Artificial Sequence
  MKO10012136_A_Csnk1d
  gRNA
gucgggaacagguaccgacu

SEQ ID NO: 12137 - RNA, 20 nt, Artificial Sequence
  MKO10012137_A_Csnk1d
  gRNA
ugccgaucuugcggcccagu

SEQ ID NO: 12138 - RNA, 20 nt, Artificial Sequence
  MKO10012138_A_Csnk1d
  gRNA
aaugccaaggugcguguuga

SEQ ID NO: 12139 - RNA, 20 nt, Artificial Sequence
  MKO10012139_A_Csnk1e
  gRNA
gaagaugucaacgccaaucg

SEQ ID NO: 12140 - RNA, 20 nt, Artificial Sequence
  MKO10012140_A_Csnk1e
  gRNA
ccgcucguacuucugacgcu

SEQ ID NO: 12141 - RNA, 20 nt, Artificial Sequence
  MKO10012141_A_Csnk1e
  gRNA
ccucaagacggugcuguugc

SEQ ID NO: 12142 - RNA, 20 nt, Artificial Sequence
  MKO10012142_A_Csnk1g1
  gRNA
guuaaugauagccauccagu

SEQ ID NO: 12143 - RNA, 20 nt, Artificial Sequence
  MKO10012143_A_Csnk1g1
  gRNA
ccgucuucaaaguaaacguu

SEQ ID NO: 12144 - RNA, 20 nt, Artificial Sequence
  MKO10012144_A_Csnk1g1
  gRNA
uucaggaucaacauauuccu

SEQ ID NO: 12145 - RNA, 20 nt, Artificial Sequence
  MKO10012145_A_Csnk1g2
  gRNA
gcuccgacucgugccgguuu

SEQ ID NO: 12146 - RNA, 20 nt, Artificial Sequence
  MKO10012146_A_Csnk1g2
  gRNA
uccccgaacugcggacgccg

SEQ ID NO: 12147 - RNA, 20 nt, Artificial Sequence
  MKO10012147_A_Csnk1g2
  gRNA
ucacucgcagaucacgcgca

SEQ ID NO: 12148 - RNA, 20 nt, Artificial Sequence
  MKO10012148_A_Csnk1g3
  gRNA
ucccacuaagauuucucgua

SEQ ID NO: 12149 - RNA, 20 nt, Artificial Sequence
  MKO10012149_A_Csnk1g3
  gRNA
ucucaugauagcuauacagc

SEQ ID NO: 12150 - RNA, 20 nt, Artificial Sequence
  MKO10012150_A_Csnk1g3
  gRNA
uugugguaaauacaacgcga

SEQ ID NO: 12151 - RNA, 20 nt, Artificial Sequence
  MKO10012151_A_Csnk2a1
  gRNA
agacauuguaaaagacccug

SEQ ID NO: 12152 - RNA, 20 nt, Artificial Sequence
  MKO10012152_A_Csnk2a1
  gRNA
aguuguuguuaaaauucuca

SEQ ID NO: 12153 - RNA, 20 nt, Artificial Sequence
  MKO10012153_A_Csnk2a1
  gRNA
uuagucacgaaccccugccu

SEQ ID NO: 12154 - RNA, 20 nt, Artificial Sequence
  MKO10012154_A_Csnk2a2
  gRNA
ugauauuuguuccaccacga

SEQ ID NO: 12155 - RNA, 20 nt, Artificial Sequence
  MKO10012155_A_Csnk2a2
  gRNA
aagauucuggagaaccuucg

SEQ ID NO: 12156 - RNA, 20 nt, Artificial Sequence
  MKO10012156_A_Csnk2a2
  gRNA
uccugacugacuuugauauc

SEQ ID NO: 12157 - RNA, 20 nt, Artificial Sequence
  MKO10012157_A_Csnk2b
  gRNA
ccagagcgacuugaucgaac

SEQ ID NO: 12158 - RNA, 20 nt, Artificial Sequence
  MKO10012158_A_Csnk2b
  gRNA
cgaaguaugcgccguccgug

SEQ ID NO: 12159 - RNA, 20 nt, Artificial Sequence
  MKO10012159_A_Csnk2b
  gRNA
ggucgcuugggccgguacuc

SEQ ID NO: 12160 - RNA, 20 nt, Artificial Sequence
  MKO10012160_A_Csnka2ip
  gRNA
cccacuccgguuccgguuuc

SEQ ID NO: 12161 - RNA, 20 nt, Artificial Sequence
  MKO10012161_A_Csnka2ip
  gRNA
auacguccagauugucaucg

SEQ ID NO: 12162 - RNA, 20 nt, Artificial Sequence
  MKO10012162_A_Csnka2ip
  gRNA
cggggaccaggacgaggguu

SEQ ID NO: 12163 - RNA, 20 nt, Artificial Sequence
  MKO10012163_A_Cspg4
  gRNA
gaaccgguagaugggccucg

SEQ ID NO: 12164 - RNA, 20 nt, Artificial Sequence
  MKO10012164_A_Cspg4
  gRNA
ccuacgcguacuuucaaccg

SEQ ID NO: 12165 - RNA, 20 nt, Artificial Sequence
  MKO10012165_A_Cspg4
  gRNA
cugauccgcuacgugcauga

SEQ ID NO: 12166 - RNA, 20 nt, Artificial Sequence
  MKO10012166_A_Cspg5
  gRNA
agucgcgugccaaugacacg

SEQ ID NO: 12167 - RNA, 20 nt, Artificial Sequence
  MKO10012167_A_Cspg5
  gRNA
ccgccguugugacaguaacu

SEQ ID NO: 12168 - RNA, 20 nt, Artificial Sequence
  MKO10012168_A_Cspg5
  gRNA
uuacuugguccuccgcagcu

SEQ ID NO: 12169 - RNA, 20 nt, Artificial Sequence
  MKO10012169_A_Cspp1
  gRNA
ggcagauaaccgcucaucaa

SEQ ID NO: 12170 - RNA, 20 nt, Artificial Sequence
  MKO10012170_A_Cspp1
  gRNA
uuauagacgauaucuuacuc

SEQ ID NO: 12171 - RNA, 20 nt, Artificial Sequence
  MKO10012171_A_Cspp1
  gRNA
uaccauaccuaagggucccu

SEQ ID NO: 12172 - RNA, 20 nt, Artificial Sequence
  MKO10012172_A_Csprs
  gRNA
aacauucuugaguaugacug

SEQ ID NO: 12173 - RNA, 20 nt, Artificial Sequence
  MKO10012173_A_Csprs
  gRNA
ccaaacaucacgugucucca

SEQ ID NO: 12174 - RNA, 20 nt, Artificial Sequence
  MKO10012174_A_Csprs
  gRNA
uccugcucuaaugcagagag

SEQ ID NO: 12175 - RNA, 20 nt, Artificial Sequence
  MKO10012175_A_Csrnp1
  gRNA
gaagcuccgccgccguuuaa

SEQ ID NO: 12176 - RNA, 20 nt, Artificial Sequence
  MKO10012176_A_Csrnp1
  gRNA
cguucgaaggauugaccgag

SEQ ID NO: 12177 - RNA, 20 nt, Artificial Sequence
  MKO10012177_A_Csrnp1
  gRNA
ccgggcugcccgacacccuu

SEQ ID NO: 12178 - RNA, 20 nt, Artificial Sequence
  MKO10012178_A_Csrnp2
  gRNA
aucaucgagugucaagccgu

SEQ ID NO: 12179 - RNA, 20 nt, Artificial Sequence
  MKO10012179_A_Csrnp2
  gRNA
aguuuaacccgauccgagug

SEQ ID NO: 12180 - RNA, 20 nt, Artificial Sequence
  MKO10012180_A_Csrnp2
  gRNA
cccgccgccguuuggugggc

SEQ ID NO: 12181 - RNA, 20 nt, Artificial Sequence
  MKO10012181_A_Csrnp3
  gRNA
gcucucgcgcaaacucgccc

SEQ ID NO: 12182 - RNA, 20 nt, Artificial Sequence
  MKO10012182_A_Csrnp3
  gRNA
gcgcacgcuguugugacgac

SEQ ID NO: 12183 - RNA, 20 nt, Artificial Sequence
  MKO10012183_A_Csrnp3
  gRNA
caugggcgcuuaucuccccg

SEQ ID NO: 12184 - RNA, 20 nt, Artificial Sequence
  MKO10012184_A_Csrp1
  gRNA
ucuccgcagcauagaccgcc

SEQ ID NO: 12185 - RNA, 20 nt, Artificial Sequence
  MKO10012185_A_Csrp1
  gRNA
aggccuugagucgaccaccc

SEQ ID NO: 12186 - RNA, 20 nt, Artificial Sequence
  MKO10012186_A_Csrp1
  gRNA
ugcccguagccguagccuuu

SEQ ID NO: 12187 - RNA, 20 nt, Artificial Sequence
  MKO10012187_A_Csrp2bp
  gRNA
uuaggaaaaagacgucgacg

SEQ ID NO: 12188 - RNA, 20 nt, Artificial Sequence
  MKO10012188_A_Csrp2bp
  gRNA
agagaagcggucgcgaacac

SEQ ID NO: 12189 - RNA, 20 nt, Artificial Sequence
  MKO10012189_A_Csrp2bp
  gRNA
cccgucaaguucauaagccg

SEQ ID NO: 12190 - RNA, 20 nt, Artificial Sequence
  MKO10012190_A_Csrp2
  gRNA
gggcgcuggcacgcucaaca

SEQ ID NO: 12191 - RNA, 20 nt, Artificial Sequence
  MKO10012191_A_Csrp2
  gRNA
gaucuucuccgcagcauaca

SEQ ID NO: 12192 - RNA, 20 nt, Artificial Sequence
  MKO10012192_A_Csrp2
  gRNA
uguugagcgugccagcgccc

SEQ ID NO: 12193 - RNA, 20 nt, Artificial Sequence
  MKO10012193_A_Csrp3
  gRNA
aucggguucggacaaggcgc

SEQ ID NO: 12194 - RNA, 20 nt, Artificial Sequence
  MKO10012194_A_Csrp3
  gRNA
uuguccgaacccgauccccu

SEQ ID NO: 12195 - RNA, 20 nt, Artificial Sequence
  MKO10012195_A_Csrp3
  gRNA
uauaccgacuuuccacaucg

SEQ ID NO: 12196 - RNA, 20 nt, Artificial Sequence
  MKO10012196_A_Cst10
  gRNA
gccaaggugcaacguugauc

SEQ ID NO: 12197 - RNA, 20 nt, Artificial Sequence
  MKO10012197_A_Cst10
  gRNA
cuggcgcucaucagucguau

SEQ ID NO: 12198 - RNA, 20 nt, Artificial Sequence
  MKO10012198_A_Cst10
  gRNA
uccagaucaacguugcaccu

SEQ ID NO: 12199 - RNA, 20 nt, Artificial Sequence
  MKO10012199_A_Cst11
  gRNA
gaaagauggcggccggaucu

SEQ ID NO: 12200 - RNA, 20 nt, Artificial Sequence
  MKO10012200_A_Cst11
  gRNA
ccguguugccuuccaagauc

SEQ ID NO: 12201 - RNA, 20 nt, Artificial Sequence
  MKO10012201_A_Cst11
  gRNA
ccacugugaugugauacucc

SEQ ID NO: 12202 - RNA, 20 nt, Artificial Sequence
  MKO10012202_A_Cst12
  gRNA
cauauuucccgcaaagcgua

SEQ ID NO: 12203 - RNA, 20 nt, Artificial Sequence
  MKO10012203_A_Cst12
  gRNA
agaugggccguacgcuuugc

SEQ ID NO: 12204 - RNA, 20 nt, Artificial Sequence
  MKO10012204_A_Cst12
  gRNA
caggaccgacuuccacaaca

SEQ ID NO: 12205 - RNA, 20 nt, Artificial Sequence
  MKO10012205_A_Cst13
  gRNA
uaucuagaagagucgaagcc

SEQ ID NO: 12206 - RNA, 20 nt, Artificial Sequence
  MKO10012206_A_Cst13
  gRNA
ucgaauggccucacaaucug

SEQ ID NO: 12207 - RNA, 20 nt, Artificial Sequence
  MKO10012207_A_Cst13
  gRNA
caaucuucuugcacauuguu

SEQ ID NO: 12208 - RNA, 20 nt, Artificial Sequence
  MKO10012208_A_Cst3
  gRNA
guaccacagccgcgccauac

SEQ ID NO: 12209 - RNA, 20 nt, Artificial Sequence
  MKO10012209_A_Cst3
  gRNA
uccagaucuacagcgugccc

SEQ ID NO: 12210 - RNA, 20 nt, Artificial Sequence
  MKO10012210_A_Cst3
  gRNA
aaaacaaggcccgcgaaugu

SEQ ID NO: 12211 - RNA, 20 nt, Artificial Sequence
  MKO10012211_A_Cst6
  gRNA
acuugucacccaccgacccg

SEQ ID NO: 12212 - RNA, 20 nt, Artificial Sequence
  MKO10012212_A_Cst6
  gRNA
cugacgcccgcgccgagcug

SEQ ID NO: 12213 - RNA, 20 nt, Artificial Sequence
  MKO10012213_A_Cst6
  gRNA
caucaaguacuaccugacuu

SEQ ID NO: 12214 - RNA, 20 nt, Artificial Sequence
  MKO10012214_A_Cst7
  gRNA
aaaucggccgaacuacaugc

SEQ ID NO: 12215 - RNA, 20 nt, Artificial Sequence
  MKO10012215_A_Cst7
  gRNA
uaccuggggggcgugcccca

SEQ ID NO: 12216 - RNA, 20 nt, Artificial Sequence
  MKO10012216_A_Cst7
  gRNA
gaacaggcaccucaaaacug

SEQ ID NO: 12217 - RNA, 20 nt, Artificial Sequence
  MKO10012217_A_Cst8
  gRNA
ggaccauggcaaaacccuug

SEQ ID NO: 12218 - RNA, 20 nt, Artificial Sequence
  MKO10012218_A_Cst8
  gRNA
gauacuccaugccaaacuuc

SEQ ID NO: 12219 - RNA, 20 nt, Artificial Sequence
  MKO10012219_A_Cst8
  gRNA
uugacagaucacagaccgaa

SEQ ID NO: 12220 - RNA, 20 nt, Artificial Sequence
  MKO10012220_A_Cst9
  gRNA
gauagguaccgacaguaaac

SEQ ID NO: 12221 - RNA, 20 nt, Artificial Sequence
  MKO10012221_A_Cst9
  gRNA
uuccaaccguguauuccaug

SEQ ID NO: 12222 - RNA, 20 nt, Artificial Sequence
  MKO10012222_A_Cst9
  gRNA
guucacggcaaauuccacug

SEQ ID NO: 12223 - RNA, 20 nt, Artificial Sequence
  MKO10012223_A_Csuad
  gRNA
cuggcuguaccaacucauga

SEQ ID NO: 12224 - RNA, 20 nt, Artificial Sequence
  MKO10012224_A_Csuad
  gRNA
uuccuugugagccuccguua

SEQ ID NO: 12225 - RNA, 20 nt, Artificial Sequence
  MKO10012225_A_Csuad
  gRNA
cacugagagccaucaugagu

SEQ ID NO: 12226 - RNA, 20 nt, Artificial Sequence
  MKO10012226_A_Csua
  gRNA
ggucaaagcacagcucgaag

SEQ ID NO: 12227 - RNA, 20 nt, Artificial Sequence
  MKO10012227_A_Csua
  gRNA
ucacccggucagcaaucucc

SEQ ID NO: 12228 - RNA, 20 nt, Artificial Sequence
  MKO10012228_A_Csua
  gRNA
ucuggccuccgucaagccuc

SEQ ID NO: 12229 - RNA, 20 nt, Artificial Sequence
  MKO10012229_A_Cstb
  gRNA
gacgcaggaggucgccgacc

SEQ ID NO: 12230 - RNA, 20 nt, Artificial Sequence
  MKO10012230_A_Cstb
  gRNA
gucggcgaccuccugcgucu

SEQ ID NO: 12231 - RNA, 20 nt, Artificial Sequence
  MKO10012231_A_Cstb
  gRNA
agauaaaugcgugcacuuga

SEQ ID NO: 12232 - RNA, 20 nt, Artificial Sequence
  MKO10012232_A_Cstf1
  gRNA
gauuuccacagggcggacgc

SEQ ID NO: 12233 - RNA, 20 nt, Artificial Sequence
  MKO10012233_A_Cstf1
  gRNA
ccgaacucuuuacgaccacg

SEQ ID NO: 12234 - RNA, 20 nt, Artificial Sequence
  MKO10012234_A_Cstf1
  gRNA
acggcaagugcaccggacac

SEQ ID NO: 12235 - RNA, 20 nt, Artificial Sequence
  MKO10012235_A_Cstf2t
  gRNA
cgaacgcagcgaucgaucca

SEQ ID NO: 12236 - RNA, 20 nt, Artificial Sequence
  MKO10012236_A_Cstf2t
  gRNA
gagucaaugaugggggccgc

SEQ ID NO: 12237 - RNA, 20 nt, Artificial Sequence
  MKO10012237_A_Cstf2t
  gRNA
cauggaucgaucgcugcguu

SEQ ID NO: 12238 - RNA, 20 nt, Artificial Sequence
  MKO10012238_A_Cstf2
  gRNA
gcacucaccagcgcaaucuc

SEQ ID NO: 12239 - RNA, 20 nt, Artificial Sequence
  MKO10012239_A_Cstf2
  gRNA
ucugcagauugguauacgau

SEQ ID NO: 12240 - RNA, 20 nt, Artificial Sequence
  MKO10012240_A_Cstf2
  gRNA
uguggauccugagauugcgc

SEQ ID NO: 12241 - RNA, 20 nt, Artificial Sequence
  MKO10012241_A_Cstf3
  gRNA
guagcugggcaguuuacccu

SEQ ID NO: 12242 - RNA, 20 nt, Artificial Sequence
  MKO10012242_A_Cstf3
  gRNA
uucauacgucagagaaacca

SEQ ID NO: 12243 - RNA, 20 nt, Artificial Sequence
  MKO10012243_A_Cstf3
  gRNA
aucaaccuauagacaaagca

SEQ ID NO: 12244 - RNA, 20 nt, Artificial Sequence
  MKO10012244_A_Cstl1
  gRNA
ugcuugcguuguuguaagag

SEQ ID NO: 12245 - RNA, 20 nt, Artificial Sequence
  MKO10012245_A_Cstl1
  gRNA
gacuguggucguaauggcua

SEQ ID NO: 12246 - RNA, 20 nt, Artificial Sequence
  MKO10012246_A_Cstl1
  gRNA
gagcugguaguaguucaucc

SEQ ID NO: 12247 - RNA, 20 nt, Artificial Sequence
  MKO10012247_A_Cs
  gRNA
cucaagggcauccguuuccg

SEQ ID NO: 12248 - RNA, 20 nt, Artificial Sequence
  MKO10012248_A_Cs
  gRNA
caugccgggcagcaaggacg

SEQ ID NO: 12249 - RNA, 20 nt, Artificial Sequence
  MKO10012249_A_Cs
  gRNA
acugagcaaucugauaccua

SEQ ID NO: 12250 - RNA, 20 nt, Artificial Sequence
  MKO10012250_A_Cuag2
  gRNA
gcaagcucacaucguacuga

SEQ ID NO: 12251 - RNA, 20 nt, Artificial Sequence
  MKO10012251_A_Cuag2
  gRNA
ugagcaggcaccaauuaucc

SEQ ID NO: 12252 - RNA, 20 nt, Artificial Sequence
  MKO10012252_A_Cuag2
  gRNA
caucccacgcccaguguuua

SEQ ID NO: 12253 - RNA, 20 nt, Artificial Sequence
  MKO10012253_A_Cuage5
  gRNA
acauucugaacaagacgagc

SEQ ID NO: 12254 - RNA, 20 nt, Artificial Sequence
  MKO10012254_A_Cuage5
  gRNA
agaugaaauacuacuccuag

SEQ ID NO: 12255 - RNA, 20 nt, Artificial Sequence
  MKO10012255_A_Cuage5
  gRNA
gcaguaugugugcuuuccgu

SEQ ID NO: 12256 - RNA, 20 nt, Artificial Sequence
  MKO10012256_A_Ctbp1
  gRNA
uugcccgaagugccaccgcc

SEQ ID NO: 12257 - RNA, 20 nt, Artificial Sequence
  MKO10012257_A_Ctbp1
  gRNA
accuguaccgacgaaccacc

SEQ ID NO: 12258 - RNA, 20 nt, Artificial Sequence
  MKO10012258_A_Ctbp1
  gRNA
cccgcucgauuccaucagau

SEQ ID NO: 12259 - RNA, 20 nt, Artificial Sequence
  MKO10012259_A_Ctbp2
  gRNA
cgauucgcacgaucacucuc

SEQ ID NO: 12260 - RNA, 20 nt, Artificial Sequence
  MKO10012260_A_Ctbp2
  gRNA
cugagagugaucgugcgaau

SEQ ID NO: 12261 - RNA, 20 nt, Artificial Sequence
  MKO10012261_A_Ctbp2
  gRNA
aacgaucucugggcgugcaa

SEQ ID NO: 12262 - RNA, 20 nt, Artificial Sequence
  MKO10012262_A_Ctbs
  gRNA
gaguuuccaacgugagaucg

SEQ ID NO: 12263 - RNA, 20 nt, Artificial Sequence
  MKO10012263_A_Ctbs
  gRNA
auccuaccuucagagcaucg

SEQ ID NO: 12264 - RNA, 20 nt, Artificial Sequence
  MKO10012264_A_Ctbs
  gRNA
agguaaccuuugauguagcu

SEQ ID NO: 12265 - RNA, 20 nt, Artificial Sequence
  MKO10012265_A_Cuc1
  gRNA
cgucccaccugcucagauac

SEQ ID NO: 12266 - RNA, 20 nt, Artificial Sequence
  MKO10012266_A_Cuc1
  gRNA
cuuguuccgaaucucccaau

SEQ ID NO: 12267 - RNA, 20 nt, Artificial Sequence
  MKO10012267_A_Cuc1
  gRNA
caguguuaucccucacauac

SEQ ID NO: 12268 - RNA, 20 nt, Artificial Sequence
  MKO10012268_A_Cucfl
  gRNA
uuggucugccuccgccguuu

SEQ ID NO: 12269 - RNA, 20 nt, Artificial Sequence
  MKO10012269_A_Cucfl
  gRNA
gccagugugcuuacgccagc

SEQ ID NO: 12270 - RNA, 20 nt, Artificial Sequence
  MKO10012270_A_Cucfl
  gRNA
cgacgcuggcguacuugcac

SEQ ID NO: 12271 - RNA, 20 nt, Artificial Sequence
  MKO10012271_A_Cucf
  gRNA
cauagcccgaaaaagugauu

SEQ ID NO: 12272 - RNA, 20 nt, Artificial Sequence
  MKO10012272_A_Cucf
  gRNA
caagugcccagacugcgaua

SEQ ID NO: 12273 - RNA, 20 nt, Artificial Sequence
  MKO10012273_A_Cucf
  gRNA
augccgcaccaauucuccac

SEQ ID NO: 12274 - RNA, 20 nt, Artificial Sequence
  MKO10012274_A_Ctdnep1
  gRNA
cauacucaccuaggcgauuc

SEQ ID NO: 12275 - RNA, 20 nt, Artificial Sequence
  MKO10012275_A_Ctdnep1
  gRNA
gugguucagcccaggugaag

SEQ ID NO: 12276 - RNA, 20 nt, Artificial Sequence
  MKO10012276_A_Ctdnep1
  gRNA
uuucguccagauccagcacc

SEQ ID NO: 12277 - RNA, 20 nt, Artificial Sequence
  MKO10012277_A_Ctdp1
  gRNA
caccauggaaaccgucgcug

SEQ ID NO: 12278 - RNA, 20 nt, Artificial Sequence
  MKO10012278_A_Ctdp1
  gRNA
gcugcucagucguaugaauc

SEQ ID NO: 12279 - RNA, 20 nt, Artificial Sequence
  MKO10012279_A_Ctdp1
  gRNA
ggucccccuuuccacagcga

SEQ ID NO: 12280 - RNA, 20 nt, Artificial Sequence
  MKO10012280_A_Ctdsp1
  gRNA
auggcucaccuuggcaaggc

SEQ ID NO: 12281 - RNA, 20 nt, Artificial Sequence
  MKO10012281_A_Ctdsp1
  gRNA
ccuggugcacagcuccuuca

SEQ ID NO: 12282 - RNA, 20 nt, Artificial Sequence
  MKO10012282_A_Ctdsp1
  gRNA
guucacugccagccuugcca

SEQ ID NO: 12283 - RNA, 20 nt, Artificial Sequence
  MKO10012283_A_Ctdsp2
  gRNA
ugcuaccuuggcgauggugu

SEQ ID NO: 12284 - RNA, 20 nt, Artificial Sequence
  MKO10012284_A_Ctdsp2
  gRNA
uccucgccuaagaaaccccg

SEQ ID NO: 12285 - RNA, 20 nt, Artificial Sequence
  MKO10012285_A_Ctdsp2
  gRNA
gucagguaccuuggccaagc

SEQ ID NO: 12286 - RNA, 20 nt, Artificial Sequence
  MKO10012286_A_Ctdspl2
  gRNA
ucaauucuacuccgcuucga

SEQ ID NO: 12287 - RNA, 20 nt, Artificial Sequence
  MKO10012287_A_Ctdspl2
  gRNA
guacucgucagcccaugcag

SEQ ID NO: 12288 - RNA, 20 nt, Artificial Sequence
  MKO10012288_A_Ctdspl2
  gRNA
gcugacgaguacccacucuc

SEQ ID NO: 12289 - RNA, 20 nt, Artificial Sequence
  MKO10012289_A_Ctdspl
  gRNA
uagucgagcaccgucaccuc

SEQ ID NO: 12290 - RNA, 20 nt, Artificial Sequence
  MKO10012290_A_Ctdspl
  gRNA
augguuccgucgauuucaac

SEQ ID NO: 12291 - RNA, 20 nt, Artificial Sequence
  MKO10012291_A_Ctdspl
  gRNA
cauugaucuagacgaaaccc

SEQ ID NO: 12292 - RNA, 20 nt, Artificial Sequence
  MKO10012292_A_Ctf1
  gRNA
cgccauagaggccgcacacg

SEQ ID NO: 12293 - RNA, 20 nt, Artificial Sequence
  MKO10012293_A_Ctf1
  gRNA
uuccacgugugcggccucua

SEQ ID NO: 12294 - RNA, 20 nt, Artificial Sequence
  MKO10012294_A_Ctf1
  gRNA
cggaucuuggccuccaaaug

SEQ ID NO: 12295 - RNA, 20 nt, Artificial Sequence
  MKO10012295_A_Ctf2
  gRNA
uacauagugacccgagaaua

SEQ ID NO: 12296 - RNA, 20 nt, Artificial Sequence
  MKO10012296_A_Ctf2
  gRNA
uagccguucugcaucuucca

SEQ ID NO: 12297 - RNA, 20 nt, Artificial Sequence
  MKO10012297_A_Ctf2
  gRNA
agaugggggccgcaggacug

SEQ ID NO: 12298 - RNA, 20 nt, Artificial Sequence
  MKO10012298_A_Cugf
  gRNA
uaugaugcgagccaacugcc

SEQ ID NO: 12299 - RNA, 20 nt, Artificial Sequence
  MKO10012299_A_Cugf
  gRNA
ucccccgccaaccgcaagau

SEQ ID NO: 12300 - RNA, 20 nt, Artificial Sequence
  MKO10012300_A_Cugf
  gRNA
gacauugcgcgcugcagucc

SEQ ID NO: 12301 - RNA, 20 nt, Artificial Sequence
  MKO10012301_A_Cthrc1
  gRNA
gcaggaguucccggucguga

SEQ ID NO: 12302 - RNA, 20 nt, Artificial Sequence
  MKO10012302_A_Cthrc1
  gRNA
cucagaggcgcugaucggug

SEQ ID NO: 12303 - RNA, 20 nt, Artificial Sequence
  MKO10012303_A_Cthrc1
  gRNA
ggaaugcaugcugucagcgc

SEQ ID NO: 12304 - RNA, 20 nt, Artificial Sequence
  MKO10012304_A_Cth
  gRNA
aaucgcugccucuagcaauu

SEQ ID NO: 12305 - RNA, 20 nt, Artificial Sequence
  MKO10012305_A_Cth
  gRNA
cacccuccugaaguaccugu

SEQ ID NO: 12306 - RNA, 20 nt, Artificial Sequence
  MKO10012306_A_Cth
  gRNA
gcacaaauuguccacaaacg

SEQ ID NO: 12307 - RNA, 20 nt, Artificial Sequence
  MKO10012307_A_Ctif
  gRNA
cgcccucuaguggugccacc

SEQ ID NO: 12308 - RNA, 20 nt, Artificial Sequence
  MKO10012308_A_Ctif
  gRNA
uacccuucucugucgaugug

SEQ ID NO: 12309 - RNA, 20 nt, Artificial Sequence
  MKO10012309_A_Ctif
  gRNA
ggaccuucucaaugucauuc

SEQ ID NO: 12310 - RNA, 20 nt, Artificial Sequence
  MKO10012310_A_Ctla2a
  gRNA
auuugcaaaagccuacaauc

SEQ ID NO: 12311 - RNA, 20 nt, Artificial Sequence
  MKO10012311_A_Ctla2a
  gRNA
aaagacacagaagacucgug

SEQ ID NO: 12312 - RNA, 20 nt, Artificial Sequence
  MKO10012312_A_Ctla2a
  gRNA
gaauucaagacaaauugcua

SEQ ID NO: 12313 - RNA, 20 nt, Artificial Sequence
  MKO10012313_A_Ctla2b
  gRNA
auuugcaaaagccuacaguc

SEQ ID NO: 12314 - RNA, 20 nt, Artificial Sequence
  MKO10012314_A_Ctla2b
  gRNA
uguggaagcucaauguguag

SEQ ID NO: 12315 - RNA, 20 nt, Artificial Sequence
  MKO10012315_A_Ctla2b
  gRNA
uccauccccugauccaaguu

SEQ ID NO: 12316 - RNA, 20 nt, Artificial Sequence
  MKO10012316_A_Ctla4
  gRNA
gauccuugucgcaguuagcu

SEQ ID NO: 12317 - RNA, 20 nt, Artificial Sequence
  MKO10012317_A_Ctla4
  gRNA
uaaacggccuuucaguugau

SEQ ID NO: 12318 - RNA, 20 nt, Artificial Sequence
  MKO10012318_A_Ctla4
  gRNA
guacccaccgccauacuuug

SEQ ID NO: 12319 - RNA, 20 nt, Artificial Sequence
  MKO10012319_A_Ctnna1
  gRNA
gccuuauaggcugcaacauc

SEQ ID NO: 12320 - RNA, 20 nt, Artificial Sequence
  MKO10012320_A_Ctnna1
  gRNA
gauuugaugaagagcgcugc

SEQ ID NO: 12321 - RNA, 20 nt, Artificial Sequence
  MKO10012321_A_Ctnna1
  gRNA
cccugauguugcagccuaua

SEQ ID NO: 12322 - RNA, 20 nt, Artificial Sequence
  MKO10012322_A_Ctnna2
  gRNA
agcccgugcugcacgcacca

SEQ ID NO: 12323 - RNA, 20 nt, Artificial Sequence
  MKO10012323_A_Ctnna2
  gRNA
caccauggugcgugcagcac

SEQ ID NO: 12324 - RNA, 20 nt, Artificial Sequence
  MKO10012324_A_Ctnna2
  gRNA
ccccuuaccugugucacaag

SEQ ID NO: 12325 - RNA, 20 nt, Artificial Sequence
  MKO10012325_A_Ctnna3
  gRNA
ucaagccgcccgcgcccugu

SEQ ID NO: 12326 - RNA, 20 nt, Artificial Sequence
  MKO10012326_A_Ctnna3
  gRNA
cagggggcgcuggcgcauuc

SEQ ID NO: 12327 - RNA, 20 nt, Artificial Sequence
  MKO10012327_A_Ctnna3
  gRNA
uucacagacgguguccuuac

SEQ ID NO: 12328 - RNA, 20 nt, Artificial Sequence
  MKO10012328_A_Ctnnal1
  gRNA
ccacacgcugaaucgcuugc

SEQ ID NO: 12329 - RNA, 20 nt, Artificial Sequence
  MKO10012329_A_Ctnnal1
  gRNA
ccugcaagcgauucagcgug

SEQ ID NO: 12330 - RNA, 20 nt, Artificial Sequence
  MKO10012330_A_Ctnnal1
  gRNA
ccaccauuucguuuccaaac

SEQ ID NO: 12331 - RNA, 20 nt, Artificial Sequence
  MKO10012331_A_Ctnnb1
  gRNA
augagcagcgucaaacugcg

SEQ ID NO: 12332 - RNA, 20 nt, Artificial Sequence
  MKO10012332_A_Ctnnb1
  gRNA
agcuacuugcucuugcguga

SEQ ID NO: 12333 - RNA, 20 nt, Artificial Sequence
  MKO10012333_A_Ctnnb1
  gRNA
aaaauggcagugcgccuagc

SEQ ID NO: 12334 - RNA, 20 nt, Artificial Sequence
  MKO10012334_A_Ctnnbip1
  gRNA
ccguggcucacccuggucga

SEQ ID NO: 12335 - RNA, 20 nt, Artificial Sequence
  MKO10012335_A_Ctnnbip1
  gRNA
ucuucccgggugcucccucg

SEQ ID NO: 12336 - RNA, 20 nt, Artificial Sequence
  MKO10012336_A_Ctnnbip1
  gRNA
agcacccgggaagaguccgg

SEQ ID NO: 12337 - RNA, 20 nt, Artificial Sequence
  MKO10012337_A_Ctnnbl1
  gRNA
acgcggccgcuaucgcgaag

SEQ ID NO: 12338 - RNA, 20 nt, Artificial Sequence
  MKO10012338_A_Ctnnbl1
  gRNA
uggccuccucuucgcgauag

SEQ ID NO: 12339 - RNA, 20 nt, Artificial Sequence
  MKO10012339_A_Ctnnbl1
  gRNA
agaaguucucaucgacgccc

SEQ ID NO: 12340 - RNA, 20 nt, Artificial Sequence
  MKO10012340_A_Ctnnd1
  gRNA
ucugguccgauugcuccgaa

SEQ ID NO: 12341 - RNA, 20 nt, Artificial Sequence
  MKO10012341_A_Ctnnd1
  gRNA
uguggucuccgugcgucuag

SEQ ID NO: 12342 - RNA, 20 nt, Artificial Sequence
  MKO10012342_A_Ctnnd1
  gRNA
ugaugggaccacuagacgca

SEQ ID NO: 12343 - RNA, 20 nt, Artificial Sequence
  MKO10012343_A_Ctnnd2
  gRNA
ugcaagcuuggcucggagac

SEQ ID NO: 12344 - RNA, 20 nt, Artificial Sequence
  MKO10012344_A_Ctnnd2
  gRNA
uuaaacaccuccaaugguga

SEQ ID NO: 12345 - RNA, 20 nt, Artificial Sequence
  MKO10012345_A_Ctnnd2
  gRNA
uaucgaagaugaacuuacaa

SEQ ID NO: 12346 - RNA, 20 nt, Artificial Sequence
  MKO10012346_A_Ctns
  gRNA
uaacagguuauagugccucg

SEQ ID NO: 12347 - RNA, 20 nt, Artificial Sequence
  MKO10012347_A_Ctns
  gRNA
cccaagggugaugucgacgu

SEQ ID NO: 12348 - RNA, 20 nt, Artificial Sequence
  MKO10012348_A_Ctns
  gRNA
accaacgucgacaucacccu

SEQ ID NO: 12349 - RNA, 20 nt, Artificial Sequence
  MKO10012349_A_Ctps2
  gRNA
cccgccaaugaaguauaucc

SEQ ID NO: 12350 - RNA, 20 nt, Artificial Sequence
  MKO10012350_A_Ctps2
  gRNA
uugccucaauaacacauauc

SEQ ID NO: 12351 - RNA, 20 nt, Artificial Sequence
  MKO10012351_A_Ctps2
  gRNA
gagaauagucccaaugcugc

SEQ ID NO: 12352 - RNA, 20 nt, Artificial Sequence
  MKO10012352_A_Ctps
  gRNA
uuaauacccguagacgaaga

SEQ ID NO: 12353 - RNA, 20 nt, Artificial Sequence
  MKO10012353_A_Ctps
  gRNA
ccuugauauccgucucacca

SEQ ID NO: 12354 - RNA, 20 nt, Artificial Sequence
  MKO10012354_A_Ctps
  gRNA
accucaaguguguguuauug

SEQ ID NO: 12355 - RNA, 20 nt, Artificial Sequence
  MKO10012355_A_Ctr9
  gRNA
acaaaguugccugcguaaua

SEQ ID NO: 12356 - RNA, 20 nt, Artificial Sequence
  MKO10012356_A_Ctr9
  gRNA
acuugacuucgaucaguuac

SEQ ID NO: 12357 - RNA, 20 nt, Artificial Sequence
  MKO10012357_A_Ctr9
  gRNA
agugaaacugugcgucagcu

SEQ ID NO: 12358 - RNA, 20 nt, Artificial Sequence
  MKO10012358_A_Ctrb1
  gRNA
gcucccucaucagcgaaaac

SEQ ID NO: 12359 - RNA, 20 nt, Artificial Sequence
  MKO10012359_A_Ctrb1
  gRNA
aaugccuaggacaaccgaug

SEQ ID NO: 12360 - RNA, 20 nt, Artificial Sequence
  MKO10012360_A_Ctrb1
  gRNA
auccucuccguugacgaucc

SEQ ID NO: 12361 - RNA, 20 nt, Artificial Sequence
  MKO10012361_A_Ctrc
  gRNA
cacaaacuugaccuaccgcg

SEQ ID NO: 12362 - RNA, 20 nt, Artificial Sequence
  MKO10012362_A_Ctrc
  gRNA
ugaggaaggcuccguguacg

SEQ ID NO: 12363 - RNA, 20 nt, Artificial Sequence
  MKO10012363_A_Ctrc
  gRNA
cgacaucgccaucaucaagu

SEQ ID NO: 12364 - RNA, 20 nt, Artificial Sequence
  MKO10012364_A_Ctrl
  gRNA
uacuuacccuugcgaucgag

SEQ ID NO: 12365 - RNA, 20 nt, Artificial Sequence
  MKO10012365_A_Ctrl
  gRNA
uggacgccacuuugucguuu

SEQ ID NO: 12366 - RNA, 20 nt, Artificial Sequence
  MKO10012366_A_Ctrl
  gRNA
guucucucaucaguccgaac

SEQ ID NO: 12367 - RNA, 20 nt, Artificial Sequence
  MKO10012367_A_Cts3
  gRNA
gacggaaguggcugucaugc

SEQ ID NO: 12368 - RNA, 20 nt, Artificial Sequence
  MKO10012368_A_Cts3
  gRNA
uuccgucaacacaguccacu

SEQ ID NO: 12369 - RNA, 20 nt, Artificial Sequence
  MKO10012369_A_Cts3
  gRNA
gacuugccacagcacucauu

SEQ ID NO: 12370 - RNA, 20 nt, Artificial Sequence
  MKO10012370_A_Cts6
  gRNA
aaggcuaugugacucgagua

SEQ ID NO: 12371 - RNA, 20 nt, Artificial Sequence
  MKO10012371_A_Cts6
  gRNA
caauguauggaucaccccau

SEQ ID NO: 12372 - RNA, 20 nt, Artificial Sequence
  MKO10012372_A_Cts6
  gRNA
auuagaauaucuucgcuuuc

SEQ ID NO: 12373 - RNA, 20 nt, Artificial Sequence
  MKO10012373_A_Cts7
  gRNA
accuccccgauaugaaugaa

SEQ ID NO: 12374 - RNA, 20 nt, Artificial Sequence
  MKO10012374_A_Cts7
  gRNA
uguuauaccugucuucgcac

SEQ ID NO: 12375 - RNA, 20 nt, Artificial Sequence
  MKO10012375_A_Cts7
  gRNA
cucaguaucuuauggcacca

SEQ ID NO: 12376 - RNA, 20 nt, Artificial Sequence
  MKO10012376_A_Cts8
  gRNA
aguauccaccaaccuauugc

SEQ ID NO: 12377 - RNA, 20 nt, Artificial Sequence
  MKO10012377_A_Cts8
  gRNA
cuacuuaccguuccuuugua

SEQ ID NO: 12378 - RNA, 20 nt, Artificial Sequence
  MKO10012378_A_Cts8
  gRNA
ugaagacuggugaggaauac

SEQ ID NO: 12379 - RNA, 20 nt, Artificial Sequence
  MKO10012379_A_Ctsa
  gRNA
ugcuucguuccgggacgccc

SEQ ID NO: 12380 - RNA, 20 nt, Artificial Sequence
  MKO10012380_A_Ctsa
  gRNA
gaugaaaucgauugucuccc

SEQ ID NO: 12381 - RNA, 20 nt, Artificial Sequence
  MKO10012381_A_Ctsa
  gRNA
guacaucuugucauccgagu

SEQ ID NO: 12382 - RNA, 20 nt, Artificial Sequence
  MKO10012382_A_Ctsb
  gRNA
ugguccaacugcccgaccau

SEQ ID NO: 12383 - RNA, 20 nt, Artificial Sequence
  MKO10012383_A_Ctsb
  gRNA
ccauuguucccgugcaucaa

SEQ ID NO: 12384 - RNA, 20 nt, Artificial Sequence
  MKO10012384_A_Ctsb
  gRNA
cagacaccuccacguugacu

SEQ ID NO: 12385 - RNA, 20 nt, Artificial Sequence
  MKO10012385_A_Ctsc
  gRNA
uacgacgagcugggcaauuc

SEQ ID NO: 12386 - RNA, 20 nt, Artificial Sequence
  MKO10012386_A_Ctsc
  gRNA
ugagccugcgagaucugaua

SEQ ID NO: 12387 - RNA, 20 nt, Artificial Sequence
  MKO10012387_A_Ctsc
  gRNA
uucuccuuaucagaucucgc

SEQ ID NO: 12388 - RNA, 20 nt, Artificial Sequence
  MKO10012388_A_Ctsd
  gRNA
auagaugugaacuugcgcag

SEQ ID NO: 12389 - RNA, 20 nt, Artificial Sequence
  MKO10012389_A_Ctsd
  gRNA
gcaaguucacaucuauccgu

SEQ ID NO: 12390 - RNA, 20 nt, Artificial Sequence
  MKO10012390_A_Ctsd
  gRNA
cucuguuaacaacgugcuuc

SEQ ID NO: 12391 - RNA, 20 nt, Artificial Sequence
  MKO10012391_A_Ctse
  gRNA
aucgcaguccgacacauaca

SEQ ID NO: 12392 - RNA, 20 nt, Artificial Sequence
  MKO10012392_A_Ctse
  gRNA
cagcuccaaugauuccuguc

SEQ ID NO: 12393 - RNA, 20 nt, Artificial Sequence
  MKO10012393_A_Ctse
  gRNA
ugaaccccucaucaacuacc

SEQ ID NO: 12394 - RNA, 20 nt, Artificial Sequence
  MKO10012394_A_Ctsf
  gRNA
gccaccuugcaaugaucccc

SEQ ID NO: 12395 - RNA, 20 nt, Artificial Sequence
  MKO10012395_A_Ctsf
  gRNA
cuguagcccagugaaugcca

SEQ ID NO: 12396 - RNA, 20 nt, Artificial Sequence
  MKO10012396_A_Ctsf
  gRNA
cacaccaggggaucauugca

SEQ ID NO: 12397 - RNA, 20 nt, Artificial Sequence
  MKO10012397_A_Ctsg
  gRNA
acaacauccaaaugcgagaa

SEQ ID NO: 12398 - RNA, 20 nt, Artificial Sequence
  MKO10012398_A_Ctsg
  gRNA
gggccacauugcuacauacc

SEQ ID NO: 12399 - RNA, 20 nt, Artificial Sequence
  MKO10012399_A_Ctsg
  gRNA
auuacaauccgcagaacauc

SEQ ID NO: 12400 - RNA, 20 nt, Artificial Sequence
  MKO10012400_A_Ctsh
  gRNA
accaaaaguaacuaccuccg

SEQ ID NO: 12401 - RNA, 20 nt, Artificial Sequence
  MKO10012401_A_Ctsh
  gRNA
aaggguaggggccuguaccu

SEQ ID NO: 12402 - RNA, 20 nt, Artificial Sequence
  MKO10012402_A_Ctsh
  gRNA
uaaccugaggcucugaccaa

SEQ ID NO: 12403 - RNA, 20 nt, Artificial Sequence
  MKO10012403_A_Ctsj
  gRNA
uagcacuagcguucucacua

SEQ ID NO: 12404 - RNA, 20 nt, Artificial Sequence
  MKO10012404_A_Ctsj
  gRNA
ucaaaacauacucgaaugcu

SEQ ID NO: 12405 - RNA, 20 nt, Artificial Sequence
  MKO10012405_A_Ctsj
  gRNA
uagaugcuacagcaacccau

SEQ ID NO: 12406 - RNA, 20 nt, Artificial Sequence
  MKO10012406_A_Ctsk
  gRNA
uccuuucuuucgauagucga

SEQ ID NO: 12407 - RNA, 20 nt, Artificial Sequence
  MKO10012407_A_Ctsk
  gRNA
uccaucgacuaucgaaagaa

SEQ ID NO: 12408 - RNA, 20 nt, Artificial Sequence
  MKO10012408_A_Ctsk
  gRNA
cuccguucugcugcacguau

SEQ ID NO: 12409 - RNA, 20 nt, Artificial Sequence
  MKO10012409_A_Ctsll3
  gRNA
uagugcaguugguucacuag

SEQ ID NO: 12410 - RNA, 20 nt, Artificial Sequence
  MKO10012410_A_Ctsll3
  gRNA
caagucguuccaguucuaca

SEQ ID NO: 12411 - RNA, 20 nt, Artificial Sequence
  MKO10012411_A_Ctsll3
  gRNA
gcaagccaccaucgcagccu

SEQ ID NO: 12412 - RNA, 20 nt, Artificial Sequence
  MKO10012412_A_Ctsl
  gRNA
gucuuaccccuaugaagcga

SEQ ID NO: 12413 - RNA, 20 nt, Artificial Sequence
  MKO10012413_A_Ctsl
  gRNA
accaauuaccuucgcuucau

SEQ ID NO: 12414 - RNA, 20 nt, Artificial Sequence
  MKO10012414_A_Ctsl
  gRNA
auacagagccgaguucgcug

SEQ ID NO: 12415 - RNA, 20 nt, Artificial Sequence
  MKO10012415_A_Ctsm
  gRNA
uaacagccccaguugccuug

SEQ ID NO: 12416 - RNA, 20 nt, Artificial Sequence
  MKO10012416_A_Ctsm
  gRNA
ccuugcauugcacuauguga

SEQ ID NO: 12417 - RNA, 20 nt, Artificial Sequence
  MKO10012417_A_Ctsm
  gRNA
aauucuacugcuaauauaac

SEQ ID NO: 12418 - RNA, 20 nt, Artificial Sequence
  MKO10012418_A_Ctso
  gRNA
cgaugaccugcugcacgcuc

SEQ ID NO: 12419 - RNA, 20 nt, Artificial Sequence
  MKO10012419_A_Ctso
  gRNA
ggauuaccugagcgugcagc

SEQ ID NO: 12420 - RNA, 20 nt, Artificial Sequence
  MKO10012420_A_Ctso
  gRNA
aaacugauuuacuccauaga

SEQ ID NO: 12421 - RNA, 20 nt, Artificial Sequence
  MKO10012421_A_Ctsq
  gRNA
cguugggguaauacauacaa

SEQ ID NO: 12422 - RNA, 20 nt, Artificial Sequence
  MKO10012422_A_Ctsq
  gRNA
cuuugcccaaauuuguugau

SEQ ID NO: 12423 - RNA, 20 nt, Artificial Sequence
  MKO10012423_A_Ctsq
  gRNA
acuaaaggccccauugcuac

SEQ ID NO: 12424 - RNA, 20 nt, Artificial Sequence
  MKO10012424_A_Ctsr
  gRNA
cuucauaccugucuccguac

SEQ ID NO: 12425 - RNA, 20 nt, Artificial Sequence
  MKO10012425_A_Ctsr
  gRNA
cuuucgccaaucgacaaauu

SEQ ID NO: 12426 - RNA, 20 nt, Artificial Sequence
  MKO10012426_A_Ctsr
  gRNA
gacuggugccauagaagcac

SEQ ID NO: 12427 - RNA, 20 nt, Artificial Sequence
  MKO10012427_A_Ctss
  gRNA
ccauaucguucaugcccacu

SEQ ID NO: 12428 - RNA, 20 nt, Artificial Sequence
  MKO10012428_A_Ctss
  gRNA
ccaagugggcaugaacgaua

SEQ ID NO: 12429 - RNA, 20 nt, Artificial Sequence
  MKO10012429_A_Ctss
  gRNA
cacaugaagcauccacaaug

SEQ ID NO: 12430 - RNA, 20 nt, Artificial Sequence
  MKO10012430_A_Ctsw
  gRNA
cuuugcuuuacgccagucac

SEQ ID NO: 12431 - RNA, 20 nt, Artificial Sequence
  MKO10012431_A_Ctsw
  gRNA
agcaaagaacaucaucucgu

SEQ ID NO: 12432 - RNA, 20 nt, Artificial Sequence
  MKO10012432_A_Ctsw
  gRNA
ggcagcugccgacaacaucc

SEQ ID NO: 12433 - RNA, 20 nt, Artificial Sequence
  MKO10012433_A_Ctsz
  gRNA
gcaacgauggcaucgaguac

SEQ ID NO: 12434 - RNA, 20 nt, Artificial Sequence
  MKO10012434_A_Ctsz
  gRNA
gugcugguuccuggugacgc

SEQ ID NO: 12435 - RNA, 20 nt, Artificial Sequence
  MKO10012435_A_Ctsz
  gRNA
auggccgagaucuaugccaa

SEQ ID NO: 12436 - RNA, 20 nt, Artificial Sequence
  MKO10012436_A_Cuunbp2nl
  gRNA
gaaccggacccgugcccuga

SEQ ID NO: 12437 - RNA, 20 nt, Artificial Sequence
  MKO10012437_A_Cuunbp2nl
  gRNA
agcgcugguugaucccgacu

SEQ ID NO: 12438 - RNA, 20 nt, Artificial Sequence
  MKO10012438_A_Cuunbp2nl
  gRNA
acuuucauugaagaacgcua

SEQ ID NO: 12439 - RNA, 20 nt, Artificial Sequence
  MKO10012439_A_Cuunbp2
  gRNA
uuuaaaccgguucgaccaac

SEQ ID NO: 12440 - RNA, 20 nt, Artificial Sequence
  MKO10012440_A_Cuunbp2
  gRNA
acuagguugucacgacucgu

SEQ ID NO: 12441 - RNA, 20 nt, Artificial Sequence
  MKO10012441_A_Cuunbp2
  gRNA
uuuguuguaggcucgcagga

SEQ ID NO: 12442 - RNA, 20 nt, Artificial Sequence
  MKO10012442_A_Cuun
  gRNA
auggggugcuaaaaccgugc

SEQ ID NO: 12443 - RNA, 20 nt, Artificial Sequence
  MKO10012443_A_Cuun
  gRNA
cgaacuucccgccauagccg

SEQ ID NO: 12444 - RNA, 20 nt, Artificial Sequence
  MKO10012444_A_Cuun
  gRNA
uccuccaucauccugcguga

SEQ ID NO: 12445 - RNA, 20 nt, Artificial Sequence
  MKO10012445_A_Ctu1
  gRNA
cgguccccuccauugccgca

SEQ ID NO: 12446 - RNA, 20 nt, Artificial Sequence
  MKO10012446_A_Ctu1
  gRNA
gcccuccgucgcccacguuc

SEQ ID NO: 12447 - RNA, 20 nt, Artificial Sequence
  MKO10012447_A_Ctu1
  gRNA
ggcgcucugccgagugcacg

SEQ ID NO: 12448 - RNA, 20 nt, Artificial Sequence
  MKO10012448_A_Ctu2
  gRNA
aaacggcugcgcuuugugcc

SEQ ID NO: 12449 - RNA, 20 nt, Artificial Sequence
  MKO10012449_A_Ctu2
  gRNA
cccgcucguaucaccaccac

SEQ ID NO: 12450 - RNA, 20 nt, Artificial Sequence
  MKO10012450_A_Ctu2
  gRNA
ggacgaagggcccccagacc

SEQ ID NO: 12451 - RNA, 20 nt, Artificial Sequence
  MKO10012451_A_Ctxn1
  gRNA
ccgugcguugcucgacgucc

SEQ ID NO: 12452 - RNA, 20 nt, Artificial Sequence
  MKO10012452_A_Ctxn1
  gRNA
ugugagcuaugaguucggcg

SEQ ID NO: 12453 - RNA, 20 nt, Artificial Sequence
  MKO10012453_A_Ctxn1
  gRNA
cacaaggaggcgcucgaacg

SEQ ID NO: 12454 - RNA, 20 nt, Artificial Sequence
  MKO10012454_A_Ctxn2
  gRNA
ucaggcaagugcauacucaa

SEQ ID NO: 12455 - RNA, 20 nt, Artificial Sequence
  MKO10012455_A_Ctxn2
  gRNA
augaugaguagcaccuacug

SEQ ID NO: 12456 - RNA, 20 nt, Artificial Sequence
  MKO10012456_A_Ctxn2
  gRNA
guagcaugcccucuucuaca

SEQ ID NO: 12457 - RNA, 20 nt, Artificial Sequence
  MKO10012457_A_Ctxn3
  gRNA
uauaaucugauccguuccca

SEQ ID NO: 12458 - RNA, 20 nt, Artificial Sequence
  MKO10012458_A_Ctxn3
  gRNA
guccccacuaagcaagggca

SEQ ID NO: 12459 - RNA, 20 nt, Artificial Sequence
  MKO10012459_A_Ctxn3
  gRNA
aagcccaucagcccauguug

SEQ ID NO: 12460 - RNA, 20 nt, Artificial Sequence
  MKO10012460_A_Cubn
  gRNA
ccugguguaaacauucgcca

SEQ ID NO: 12461 - RNA, 20 nt, Artificial Sequence
  MKO10012461_A_Cubn
  gRNA
aguccaccaacuuaacucga

SEQ ID NO: 12462 - RNA, 20 nt, Artificial Sequence
  MKO10012462_A_Cubn
  gRNA
accuuaccuucgaguuaagu

SEQ ID NO: 12463 - RNA, 20 nt, Artificial Sequence
  MKO10012463_A_Cuedc1
  gRNA
auuuccaaccgccgcauugu

SEQ ID NO: 12464 - RNA, 20 nt, Artificial Sequence
  MKO10012464_A_Cuedc1
  gRNA
uggacgcucaccggggaggu

SEQ ID NO: 12465 - RNA, 20 nt, Artificial Sequence
  MKO10012465_A_Cuedc1
  gRNA
accacaugcacguguucgac

SEQ ID NO: 12466 - RNA, 20 nt, Artificial Sequence
  MKO10012466_A_Cuedc2
  gRNA
ucccgggaacacccuagaug

SEQ ID NO: 12467 - RNA, 20 nt, Artificial Sequence
  MKO10012467_A_Cuedc2
  gRNA
uccaggagcacaucgacucc

SEQ ID NO: 12468 - RNA, 20 nt, Artificial Sequence
  MKO10012468_A_Cuedc2
  gRNA
cuccaaguccccccgagcuu

SEQ ID NO: 12469 - RNA, 20 nt, Artificial Sequence
  MKO10012469_A_Cul1
  gRNA
guucgccgugaaugugauga

SEQ ID NO: 12470 - RNA, 20 nt, Artificial Sequence
  MKO10012470_A_Cul1
  gRNA
uucguccuucaucacauuca

SEQ ID NO: 12471 - RNA, 20 nt, Artificial Sequence
  MKO10012471_A_Cul1
  gRNA
ccaacaaacugagcuccccc

SEQ ID NO: 12472 - RNA, 20 nt, Artificial Sequence
  MKO10012472_A_Cul2
  gRNA
uaauuucucgaagcagcauc

SEQ ID NO: 12473 - RNA, 20 nt, Artificial Sequence
  MKO10012473_A_Cul2
  gRNA
cccuucagaacauccucauc

SEQ ID NO: 12474 - RNA, 20 nt, Artificial Sequence
  MKO10012474_A_Cul2
  gRNA
auauaagcaguccauauagu

SEQ ID NO: 12475 - RNA, 20 nt, Artificial Sequence
  MKO10012475_A_Cul3
  gRNA
gaccacuguuauucuuacgc

SEQ ID NO: 12476 - RNA, 20 nt, Artificial Sequence
  MKO10012476_A_Cul3
  gRNA
auccagcguaagaauaacag

SEQ ID NO: 12477 - RNA, 20 nt, Artificial Sequence
  MKO10012477_A_Cul3
  gRNA
aacuucuccuuuccgcucuc

SEQ ID NO: 12478 - RNA, 20 nt, Artificial Sequence
  MKO10012478_A_Cul4a
  gRNA
cguagguucgauccagaaac

SEQ ID NO: 12479 - RNA, 20 nt, Artificial Sequence
  MKO10012479_A_Cul4a
  gRNA
cgcagcugcuuguagagcgu

SEQ ID NO: 12480 - RNA, 20 nt, Artificial Sequence
  MKO10012480_A_Cul4a
  gRNA
guggcggaagcuucacgaag

SEQ ID NO: 12481 - RNA, 20 nt, Artificial Sequence
  MKO10012481_A_Cul4b
  gRNA
agugcaccaugcaaacggcc

SEQ ID NO: 12482 - RNA, 20 nt, Artificial Sequence
  MKO10012482_A_Cul4b
  gRNA
ugaaggggacgccgaaucuc

SEQ ID NO: 12483 - RNA, 20 nt, Artificial Sequence
  MKO10012483_A_Cul4b
  gRNA
ucgcucuuaccggaagugcc

SEQ ID NO: 12484 - RNA, 20 nt, Artificial Sequence
  MKO10012484_A_Cul5
  gRNA
cgucagcgccgagcucgucc

SEQ ID NO: 12485 - RNA, 20 nt, Artificial Sequence
  MKO10012485_A_Cul5
  gRNA
acgucgccauguucucaacu

SEQ ID NO: 12486 - RNA, 20 nt, Artificial Sequence
  MKO10012486_A_Cul5
  gRNA
agucccacuugucuucaaac

SEQ ID NO: 12487 - RNA, 20 nt, Artificial Sequence
  MKO10012487_A_Cul7
  gRNA
caucgccguucagccgaucc

SEQ ID NO: 12488 - RNA, 20 nt, Artificial Sequence
  MKO10012488_A_Cul7
  gRNA
aucggcugaacggcgaugca

SEQ ID NO: 12489 - RNA, 20 nt, Artificial Sequence
  MKO10012489_A_Cul7
  gRNA
ggaacacccgaugucuuucg

SEQ ID NO: 12490 - RNA, 20 nt, Artificial Sequence
  MKO10012490_A_Cul9
  gRNA
cggcaugcggguucgcaucc

SEQ ID NO: 12491 - RNA, 20 nt, Artificial Sequence
  MKO10012491_A_Cul9
  gRNA
cguauucaccauaaccgcug

SEQ ID NO: 12492 - RNA, 20 nt, Artificial Sequence
  MKO10012492_A_Cul9
  gRNA
caggucuucuggcagucgac

SEQ ID NO: 12493 - RNA, 20 nt, Artificial Sequence
  MKO10012493_A_Cuual
  gRNA
aaauugccagagacaucgcc

SEQ ID NO: 12494 - RNA, 20 nt, Artificial Sequence
  MKO10012494_A_Cuual
  gRNA
acuauaccuggcgaugucuc

SEQ ID NO: 12495 - RNA, 20 nt, Artificial Sequence
  MKO10012495_A_Cuual
  gRNA
cccggcuguuugccuauaug

SEQ ID NO: 12496 - RNA, 20 nt, Artificial Sequence
  MKO10012496_A_Cuua
  gRNA
ucgggcuccggcuacguucc

SEQ ID NO: 12497 - RNA, 20 nt, Artificial Sequence
  MKO10012497_A_Cuua
  gRNA
gacugauccuggaacguagc

SEQ ID NO: 12498 - RNA, 20 nt, Artificial Sequence
  MKO10012498_A_Cuua
  gRNA
ggcagugguagagaagcguc

SEQ ID NO: 12499 - RNA, 20 nt, Artificial Sequence
  MKO10012499_A_Cuuc
  gRNA
auacuccgaccgugaaguug

SEQ ID NO: 12500 - RNA, 20 nt, Artificial Sequence
  MKO10012500_A_Cuuc
  gRNA
uauaagaagucgccuccgcg

SEQ ID NO: 12501 - RNA, 20 nt, Artificial Sequence
  MKO10012501_A_Cuuc
  gRNA
cuugcgagcggaaacaggcg

SEQ ID NO: 12502 - RNA, 20 nt, Artificial Sequence
  MKO10012502_A_Cux1
  gRNA
cacccaggauuuacgcaagc

SEQ ID NO: 12503 - RNA, 20 nt, Artificial Sequence
  MKO10012503_A_Cux1
  gRNA
cugcucaaugagccgcuuuc

SEQ ID NO: 12504 - RNA, 20 nt, Artificial Sequence
  MKO10012504_A_Cux1
  gRNA
uugaaacaucgaucccacau

SEQ ID NO: 12505 - RNA, 20 nt, Artificial Sequence
  MKO10012505_A_Cux2
  gRNA
uacaagacgugcacaucgcg

SEQ ID NO: 12506 - RNA, 20 nt, Artificial Sequence
  MKO10012506_A_Cux2
  gRNA
guccgcgccaccucaaauga

SEQ ID NO: 12507 - RNA, 20 nt, Artificial Sequence
  MKO10012507_A_Cux2
  gRNA
acggggcacacgccagccaa

SEQ ID NO: 12508 - RNA, 20 nt, Artificial Sequence
  MKO10012508_A_Cuzd1
  gRNA
ggacaacuuaccgguagcag

SEQ ID NO: 12509 - RNA, 20 nt, Artificial Sequence
  MKO10012509_A_Cuzd1
  gRNA
ggccgcagaguuguuugagc

SEQ ID NO: 12510 - RNA, 20 nt, Artificial Sequence
  MKO10012510_A_Cuzd1
  gRNA
gauuucaucgcagucuacga

SEQ ID NO: 12511 - RNA, 20 nt, Artificial Sequence
  MKO10012511_A_Cwc15
  gRNA
uacggguaccucgaguuggg

SEQ ID NO: 12512 - RNA, 20 nt, Artificial Sequence
  MKO10012512_A_Cwc15
  gRNA
aacagggaccgcccaacucg

SEQ ID NO: 12513 - RNA, 20 nt, Artificial Sequence
  MKO10012513_A_Cwc15
  gRNA
aaaacacauacgucugugag

SEQ ID NO: 12514 - RNA, 20 nt, Artificial Sequence
  MKO10012514_A_Cwc22
  gRNA
gagaacucugcccuccgccu

SEQ ID NO: 12515 - RNA, 20 nt, Artificial Sequence
  MKO10012515_A_Cwc22
  gRNA
aggacagguaccugucuucu

SEQ ID NO: 12516 - RNA, 20 nt, Artificial Sequence
  MKO10012516_A_Cwc22
  gRNA
agcagaucacagauaaaagc

SEQ ID NO: 12517 - RNA, 20 nt, Artificial Sequence
  MKO10012517_A_Cwc25
  gRNA
aggcucaaucuuugccccgu

SEQ ID NO: 12518 - RNA, 20 nt, Artificial Sequence
  MKO10012518_A_Cwc25
  gRNA
cccgcagacccuucgcaaug

SEQ ID NO: 12519 - RNA, 20 nt, Artificial Sequence
  MKO10012519_A_Cwc25
  gRNA
ggagaugcagcgcuacgcug

SEQ ID NO: 12520 - RNA, 20 nt, Artificial Sequence
  MKO10012520_A_Cwc27
  gRNA
acugguggagaaucuaucua

SEQ ID NO: 12521 - RNA, 20 nt, Artificial Sequence
  MKO10012521_A_Cwc27
  gRNA
guccaagguggagaucccac

SEQ ID NO: 12522 - RNA, 20 nt, Artificial Sequence
  MKO10012522_A_Cwc27
  gRNA
caucaauaucuacuucuguc

SEQ ID NO: 12523 - RNA, 20 nt, Artificial Sequence
  MKO10012523_A_Cwf19l1
  gRNA
auaucuuacucacguccccg

SEQ ID NO: 12524 - RNA, 20 nt, Artificial Sequence
  MKO10012524_A_Cwf19l1
  gRNA
cccaaagcuccccacguacu

SEQ ID NO: 12525 - RNA, 20 nt, Artificial Sequence
  MKO10012525_A_Cwf19l1
  gRNA
guuugcugucuccucguuau

SEQ ID NO: 12526 - RNA, 20 nt, Artificial Sequence
  MKO10012526_A_Cwf19l2
  gRNA
ucaauucgcucaugcacauc

SEQ ID NO: 12527 - RNA, 20 nt, Artificial Sequence
  MKO10012527_A_Cwf19l2
  gRNA
gugaagaacguaagcgacuu

SEQ ID NO: 12528 - RNA, 20 nt, Artificial Sequence
  MKO10012528_A_Cwf19l2
  gRNA
augugacagccacgauauuc

SEQ ID NO: 12529 - RNA, 20 nt, Artificial Sequence
  MKO10012529_A_Cwh43
  gRNA
aaaugcuaagcuucgacuga

SEQ ID NO: 12530 - RNA, 20 nt, Artificial Sequence
  MKO10012530_A_Cwh43
  gRNA
aucagucgaagcuuagcauu

SEQ ID NO: 12531 - RNA, 20 nt, Artificial Sequence
  MKO10012531_A_Cwh43
  gRNA
guagcugugcuugaccgaau

SEQ ID NO: 12532 - RNA, 20 nt, Artificial Sequence
  MKO10012532_A_Cx3cl1
  gRNA
cacaauggcacgcuugccgc

SEQ ID NO: 12533 - RNA, 20 nt, Artificial Sequence
  MKO10012533_A_Cx3cl1
  gRNA
uggcucccucgccgcucgcg

SEQ ID NO: 12534 - RNA, 20 nt, Artificial Sequence
  MKO10012534_A_Cx3cl1
  gRNA
uuucgcauuucgucaugccg

SEQ ID NO: 12535 - RNA, 20 nt, Artificial Sequence
  MKO10012535_A_Cx3cr1
  gRNA
uacgcccucgucuucacguu

SEQ ID NO: 12536 - RNA, 20 nt, Artificial Sequence
  MKO10012536_A_Cx3cr1
  gRNA
ccagaccgaacgugaagacg

SEQ ID NO: 12537 - RNA, 20 nt, Artificial Sequence
  MKO10012537_A_Cx3cr1
  gRNA
gaugaccgcacaggacggcc

SEQ ID NO: 12538 - RNA, 20 nt, Artificial Sequence
  MKO10012538_A_Cxadr
  gRNA
uagauacgcaguuuccccuu

SEQ ID NO: 12539 - RNA, 20 nt, Artificial Sequence
  MKO10012539_A_Cxadr
  gRNA
aaauuccugcugaccguucu

SEQ ID NO: 12540 - RNA, 20 nt, Artificial Sequence
  MKO10012540_A_Cxadr
  gRNA
uacucucagucccgaagacc

SEQ ID NO: 12541 - RNA, 20 nt, Artificial Sequence
  MKO10012541_A_Cxcl10
  gRNA
cagcggaccguccuugcgag

SEQ ID NO: 12542 - RNA, 20 nt, Artificial Sequence
  MKO10012542_A_Cxcl10
  gRNA
ucacuggcccgucaucgaua

SEQ ID NO: 12543 - RNA, 20 nt, Artificial Sequence
  MKO10012543_A_Cxcl10
  gRNA
ugaaagcguuuagccaaaaa

SEQ ID NO: 12544 - RNA, 20 nt, Artificial Sequence
  MKO10012544_A_Cxcl11
  gRNA
acuuugucgcagccguuacu

SEQ ID NO: 12545 - RNA, 20 nt, Artificial Sequence
  MKO10012545_A_Cxcl11
  gRNA
uucgugugccucgugauauu

SEQ ID NO: 12546 - RNA, 20 nt, Artificial Sequence
  MKO10012546_A_Cxcl11
  gRNA
gcucacagucagacguuccc

SEQ ID NO: 12547 - RNA, 20 nt, Artificial Sequence
  MKO10012547_A_Cxcl12
  gRNA
cgauguggcucucgaagaac

SEQ ID NO: 12548 - RNA, 20 nt, Artificial Sequence
  MKO10012548_A_Cxcl12
  gRNA
cgcccacgccauggacgcca

SEQ ID NO: 12549 - RNA, 20 nt, Artificial Sequence
  MKO10012549_A_Cxcl12
  gRNA
caucgguagcucaggcugac

SEQ ID NO: 12550 - RNA, 20 nt, Artificial Sequence
  MKO10012550_A_Cxcl13
  gRNA
cggauucaaguuacgccccc

SEQ ID NO: 12551 - RNA, 20 nt, Artificial Sequence
  MKO10012551_A_Cxcl13
  gRNA
gugugaauccucgugccaaa

SEQ ID NO: 12552 - RNA, 20 nt, Artificial Sequence
  MKO10012552_A_Cxcl13
  gRNA
ucucaccguggccuggagag

SEQ ID NO: 12553 - RNA, 20 nt, Artificial Sequence
  MKO10012553_A_Cxcl14
  gRNA
cugugcgccucgcgcgugga

SEQ ID NO: 12554 - RNA, 20 nt, Artificial Sequence
  MKO10012554_A_Cxcl14
  gRNA
gcacucaccguccacgcgcg

SEQ ID NO: 12555 - RNA, 20 nt, Artificial Sequence
  MKO10012555_A_Cxcl14
  gRNA
gcuucuucacgucgcuguag

SEQ ID NO: 12556 - RNA, 20 nt, Artificial Sequence
  MKO10012556_A_Cxcl15
  gRNA
cuguuggcccaauuacuaac

SEQ ID NO: 12557 - RNA, 20 nt, Artificial Sequence
  MKO10012557_A_Cxcl15
  gRNA
ucguagcucuugagugucac

SEQ ID NO: 12558 - RNA, 20 nt, Artificial Sequence
  MKO10012558_A_Cxcl15
  gRNA
gcuacgaugucuguguauuc

SEQ ID NO: 12559 - RNA, 20 nt, Artificial Sequence
  MKO10012559_A_Cxcl16
  gRNA
uugcaguccaaaagcgugug

SEQ ID NO: 12560 - RNA, 20 nt, Artificial Sequence
  MKO10012560_A_Cxcl16
  gRNA
ccagauaccgcaggguacuu

SEQ ID NO: 12561 - RNA, 20 nt, Artificial Sequence
  MKO10012561_A_Cxcl16
  gRNA
ccaguggguccgugaacuag

SEQ ID NO: 12562 - RNA, 20 nt, Artificial Sequence
  MKO10012562_A_Cxcl17
  gRNA
gugucccugugaucacguca

SEQ ID NO: 12563 - RNA, 20 nt, Artificial Sequence
  MKO10012563_A_Cxcl17
  gRNA
guguugguccccguggcuuc

SEQ ID NO: 12564 - RNA, 20 nt, Artificial Sequence
  MKO10012564_A_Cxcl17
  gRNA
ccugcccuugacgugaucac

SEQ ID NO: 12565 - RNA, 20 nt, Artificial Sequence
  MKO10012565_A_Cxcl1
  gRNA
cucgcgaccauucuugagug

SEQ ID NO: 12566 - RNA, 20 nt, Artificial Sequence
  MKO10012566_A_Cxcl1
  gRNA
auacucacaugacuucgguu

SEQ ID NO: 12567 - RNA, 20 nt, Artificial Sequence
  MKO10012567_A_Cxcl1
  gRNA
gcgcugcacagagaagcgag

SEQ ID NO: 12568 - RNA, 20 nt, Artificial Sequence
  MKO10012568_A_Cxcl2
  gRNA
ggggcgucacacucaagcuc

SEQ ID NO: 12569 - RNA, 20 nt, Artificial Sequence
  MKO10012569_A_Cxcl2
  gRNA
gcauugacagcgcaguucac

SEQ ID NO: 12570 - RNA, 20 nt, Artificial Sequence
  MKO10012570_A_Cxcl2
  gRNA
ccuugacccugaagcccccc

SEQ ID NO: 12571 - RNA, 20 nt, Artificial Sequence
  MKO10012571_A_Cxcl3
  gRNA
ggggcgucaccgucaagcuc

SEQ ID NO: 12572 - RNA, 20 nt, Artificial Sequence
  MKO10012572_A_Cxcl3
  gRNA
gaaguuugccucaaccccca

SEQ ID NO: 12573 - RNA, 20 nt, Artificial Sequence
  MKO10012573_A_Cxcl3
  gRNA
agugccugaacacccuacca

SEQ ID NO: 12574 - RNA, 20 nt, Artificial Sequence
  MKO10012574_A_Cxcl5
  gRNA
caucucgccauucaugcgga

SEQ ID NO: 12575 - RNA, 20 nt, Artificial Sequence
  MKO10012575_A_Cxcl5
  gRNA
cauccgcaugaauggcgaga

SEQ ID NO: 12576 - RNA, 20 nt, Artificial Sequence
  MKO10012576_A_Cxcl5
  gRNA
uuccucagucauagccgcaa

SEQ ID NO: 12577 - RNA, 20 nt, Artificial Sequence
  MKO10012577_A_Cxcl9
  gRNA
cccaaagucgucgucguuca

SEQ ID NO: 12578 - RNA, 20 nt, Artificial Sequence
  MKO10012578_A_Cxcl9
  gRNA
uccuugaacgacgacgacuu

SEQ ID NO: 12579 - RNA, 20 nt, Artificial Sequence
  MKO10012579_A_Cxcl9
  gRNA
aucgugcauuccuuaucacu

SEQ ID NO: 12580 - RNA, 20 nt, Artificial Sequence
  MKO10012580_A_Cxcr1
  gRNA
cguccaugccacccguacgc

SEQ ID NO: 12581 - RNA, 20 nt, Artificial Sequence
  MKO10012581_A_Cxcr1
  gRNA
cguacggguggcauggacga

SEQ ID NO: 12582 - RNA, 20 nt, Artificial Sequence
  MKO10012582_A_Cxcr1
  gRNA
cuugguuaaauucgugugcg

SEQ ID NO: 12583 - RNA, 20 nt, Artificial Sequence
  MKO10012583_A_Cxcr2
  gRNA
aaugucaucgcggcgcucac

SEQ ID NO: 12584 - RNA, 20 nt, Artificial Sequence
  MKO10012584_A_Cxcr2
  gRNA
uacgcaguacgacccucaaa

SEQ ID NO: 12585 - RNA, 20 nt, Artificial Sequence
  MKO10012585_A_Cxcr2
  gRNA
ugugguuguaauauacgucc

SEQ ID NO: 12586 - RNA, 20 nt, Artificial Sequence
  MKO10012586_A_Cxcr3
  gRNA
auugaggcgcugaucguagu

SEQ ID NO: 12587 - RNA, 20 nt, Artificial Sequence
  MKO10012587_A_Cxcr3
  gRNA
agcaccucucccuacgauua

SEQ ID NO: 12588 - RNA, 20 nt, Artificial Sequence
  MKO10012588_A_Cxcr3
  gRNA
cagccaagccauguaccuug

SEQ ID NO: 12589 - RNA, 20 nt, Artificial Sequence
  MKO10012589_A_Cxcr4
  gRNA
cgagacccaccauuauaugc

SEQ ID NO: 12590 - RNA, 20 nt, Artificial Sequence
  MKO10012590_A_Cxcr4
  gRNA
ucgagagcaucgugcacaag

SEQ ID NO: 12591 - RNA, 20 nt, Artificial Sequence
  MKO10012591_A_Cxcr4
  gRNA
ggacuuacacucacacugau

SEQ ID NO: 12592 - RNA, 20 nt, Artificial Sequence
  MKO10012592_A_Cxcr5
  gRNA
guuacgugggcgugguccac

SEQ ID NO: 12593 - RNA, 20 nt, Artificial Sequence
  MKO10012593_A_Cxcr5
  gRNA
gcggaacuuuacgccagcga

SEQ ID NO: 12594 - RNA, 20 nt, Artificial Sequence
  MKO10012594_A_Cxcr5
  gRNA
gggcuccaucacauacaaua

SEQ ID NO: 12595 - RNA, 20 nt, Artificial Sequence
  MKO10012595_A_Cxcr6
  gRNA
uaccaaggccuucaaccggc

SEQ ID NO: 12596 - RNA, 20 nt, Artificial Sequence
  MKO10012596_A_Cxcr6
  gRNA
uaaaguuccggaagaacguc

SEQ ID NO: 12597 - RNA, 20 nt, Artificial Sequence
  MKO10012597_A_Cxcr6
  gRNA
uauagccucugucacuacga

SEQ ID NO: 12598 - RNA, 20 nt, Artificial Sequence
  MKO10012598_A_Cxx1a
  gRNA
cgcagcgucauggaaggcca

SEQ ID NO: 12599 - RNA, 20 nt, Artificial Sequence
  MKO10012599_A_Cxx1a
  gRNA
acacccgcuucaucucauuc

SEQ ID NO: 12600 - RNA, 20 nt, Artificial Sequence
  MKO10012600_A_Cxx1a
  gRNA
cuuccugaaugagaugaagc

SEQ ID NO: 12601 - RNA, 20 nt, Artificial Sequence
  MKO10012601_A_Cxx1b
  gRNA
cgcagcgucauggaaggcca

SEQ ID NO: 12602 - RNA, 20 nt, Artificial Sequence
  MKO10012602_A_Cxx1b
  gRNA
acacccgcuucaucucauuc

SEQ ID NO: 12603 - RNA, 20 nt, Artificial Sequence
  MKO10012603_A_Cxx1b
  gRNA
cuuccugaaugagaugaagc

SEQ ID NO: 12604 - RNA, 20 nt, Artificial Sequence
  MKO10012604_A_Cxx1c
  gRNA
cuucgacaccgacaaacgca

SEQ ID NO: 12605 - RNA, 20 nt, Artificial Sequence
  MKO10012605_A_Cxx1c
  gRNA
accucgccgccauggaccgc

SEQ ID NO: 12606 - RNA, 20 nt, Artificial Sequence
  MKO10012606_A_Cxx1c
  gRNA
ccauaaucaacuuaauccgg

SEQ ID NO: 12607 - RNA, 20 nt, Artificial Sequence
  MKO10012607_A_Cxxc1
  gRNA
cgaggccugccgacgcacug

SEQ ID NO: 12608 - RNA, 20 nt, Artificial Sequence
  MKO10012608_A_Cxxc1
  gRNA
guuaccgccacaaaaagugc

SEQ ID NO: 12609 - RNA, 20 nt, Artificial Sequence
  MKO10012609_A_Cxxc1
  gRNA
cgguaacgaaucuccagcuu

SEQ ID NO: 12610 - RNA, 20 nt, Artificial Sequence
  MKO10012610_A_Cxxc4
  gRNA
cgcgcaucggcauguccccg

SEQ ID NO: 12611 - RNA, 20 nt, Artificial Sequence
  MKO10012611_A_Cxxc4
  gRNA
gccgcguugucgcaguucca

SEQ ID NO: 12612 - RNA, 20 nt, Artificial Sequence
  MKO10012612_A_Cxxc4
  gRNA
ccagcgcugaagcguuccga

SEQ ID NO: 12613 - RNA, 20 nt, Artificial Sequence
  MKO10012613_A_Cxxc5
  gRNA
gcucacaguugaugcgccgc

SEQ ID NO: 12614 - RNA, 20 nt, Artificial Sequence
  MKO10012614_A_Cxxc5
  gRNA
gccggcgccgaagcccucaa

SEQ ID NO: 12615 - RNA, 20 nt, Artificial Sequence
  MKO10012615_A_Cxxc5
  gRNA
ccagaaggugaugcuuccgu

SEQ ID NO: 12616 - RNA, 20 nt, Artificial Sequence
  MKO10012616_A_Cyb561a3
  gRNA
uguaccgccugccuucaucg

SEQ ID NO: 12617 - RNA, 20 nt, Artificial Sequence
  MKO10012617_A_Cyb561a3
  gRNA
agaggugugcgauucucgag

SEQ ID NO: 12618 - RNA, 20 nt, Artificial Sequence
  MKO10012618_A_Cyb561a3
  gRNA
ucaggaggcuucgcagccac

SEQ ID NO: 12619 - RNA, 20 nt, Artificial Sequence
  MKO10012619_A_Cyb561d1
  gRNA
gucugguucccgcuccagcg

SEQ ID NO: 12620 - RNA, 20 nt, Artificial Sequence
  MKO10012620_A_Cyb561d1
  gRNA
ggcgagccacccuugagacc

SEQ ID NO: 12621 - RNA, 20 nt, Artificial Sequence
  MKO10012621_A_Cyb561d1
  gRNA
cuggguacaaugguaguccc

SEQ ID NO: 12622 - RNA, 20 nt, Artificial Sequence
  MKO10012622_A_Cyb561d2
  gRNA
gcagcccaccucguggcguu

SEQ ID NO: 12623 - RNA, 20 nt, Artificial Sequence
  MKO10012623_A_Cyb561d2
  gRNA
gugcgcggaccuuccgagag

SEQ ID NO: 12624 - RNA, 20 nt, Artificial Sequence
  MKO10012624_A_Cyb561d2
  gRNA
augccuaccuguaccgcaag

SEQ ID NO: 12625 - RNA, 20 nt, Artificial Sequence
  MKO10012625_A_Cyb561
  gRNA
cgcacgaccaagaucuugca

SEQ ID NO: 12626 - RNA, 20 nt, Artificial Sequence
  MKO10012626_A_Cyb561
  gRNA
guucgacuaccacaagaaga

SEQ ID NO: 12627 - RNA, 20 nt, Artificial Sequence
  MKO10012627_A_Cyb561
  gRNA
guacagcacguuugaaccug

SEQ ID NO: 12628 - RNA, 20 nt, Artificial Sequence
  MKO10012628_A_Cyb5b
  gRNA
uauaagaauagcgcccacga

SEQ ID NO: 12629 - RNA, 20 nt, Artificial Sequence
  MKO10012629_A_Cyb5b
  gRNA
cuuaccuugucaucgccuuu

SEQ ID NO: 12630 - RNA, 20 nt, Artificial Sequence
  MKO10012630_A_Cyb5b
  gRNA
uuuccaguuccugggcguau

SEQ ID NO: 12631 - RNA, 20 nt, Artificial Sequence
  MKO10012631_A_Cyb5d1
  gRNA
gaacuuacgucucuagucug

SEQ ID NO: 12632 - RNA, 20 nt, Artificial Sequence
  MKO10012632_A_Cyb5d1
  gRNA
gcggcgggauauguacgaag

SEQ ID NO: 12633 - RNA, 20 nt, Artificial Sequence
  MKO10012633_A_Cyb5d1
  gRNA
gcaugagauaccguaccccg

SEQ ID NO: 12634 - RNA, 20 nt, Artificial Sequence
  MKO10012634_A_Cyb5d2
  gRNA
aagccgcuauagugcgcccc

SEQ ID NO: 12635 - RNA, 20 nt, Artificial Sequence
  MKO10012635_A_Cyb5d2
  gRNA
ccccugggccgccgcgauag

SEQ ID NO: 12636 - RNA, 20 nt, Artificial Sequence
  MKO10012636_A_Cyb5d2
  gRNA
cuauucugaagccggucuug

SEQ ID NO: 12637 - RNA, 20 nt, Artificial Sequence
  MKO10012637_A_Cyb5r1
  gRNA
ucgaagaucccgccggccgc

SEQ ID NO: 12638 - RNA, 20 nt, Artificial Sequence
  MKO10012638_A_Cyb5r1
  gRNA
gcauaacugagcaacccgcu

SEQ ID NO: 12639 - RNA, 20 nt, Artificial Sequence
  MKO10012639_A_Cyb5r1
  gRNA
ucuugucuagcaaucgcagc

SEQ ID NO: 12640 - RNA, 20 nt, Artificial Sequence
  MKO10012640_A_Cyb5r2
  gRNA
gcccuguuggcccccgaaaa

SEQ ID NO: 12641 - RNA, 20 nt, Artificial Sequence
  MKO10012641_A_Cyb5r2
  gRNA
aaagccuugaucaucgucac

SEQ ID NO: 12642 - RNA, 20 nt, Artificial Sequence
  MKO10012642_A_Cyb5r2
  gRNA
caccaccuggggaugauugc

SEQ ID NO: 12643 - RNA, 20 nt, Artificial Sequence
  MKO10012643_A_Cyb5r3
  gRNA
uugucaucaucgcucgacac

SEQ ID NO: 12644 - RNA, 20 nt, Artificial Sequence
  MKO10012644_A_Cyb5r3
  gRNA
ugccaucgauccuagucgag

SEQ ID NO: 12645 - RNA, 20 nt, Artificial Sequence
  MKO10012645_A_Cyb5r3
  gRNA
gucguugcaguugagccacg

SEQ ID NO: 12646 - RNA, 20 nt, Artificial Sequence
  MKO10012646_A_Cyb5r4
  gRNA
ucccaugcuagguucaucgu

SEQ ID NO: 12647 - RNA, 20 nt, Artificial Sequence
  MKO10012647_A_Cyb5r4
  gRNA
uuacaacgucagcccuuaua

SEQ ID NO: 12648 - RNA, 20 nt, Artificial Sequence
  MKO10012648_A_Cyb5r4
  gRNA
cucuagguaccuuuaaaaca

SEQ ID NO: 12649 - RNA, 20 nt, Artificial Sequence
  MKO10012649_A_Cyb5rl
  gRNA
cggcgagcuccucaugcuag

SEQ ID NO: 12650 - RNA, 20 nt, Artificial Sequence
  MKO10012650_A_Cyb5rl
  gRNA
ugccucaagugcuaccggac

SEQ ID NO: 12651 - RNA, 20 nt, Artificial Sequence
  MKO10012651_A_Cyb5rl
  gRNA
caggccgagccgacuguucc

SEQ ID NO: 12652 - RNA, 20 nt, Artificial Sequence
  MKO10012652_A_Cyb5
  gRNA
ucugauguaucgccucuaca

SEQ ID NO: 12653 - RNA, 20 nt, Artificial Sequence
  MKO10012653_A_Cyb5
  gRNA
cccgacguccucaaaauucu

SEQ ID NO: 12654 - RNA, 20 nt, Artificial Sequence
  MKO10012654_A_Cyb5
  gRNA
ggauacucuuaucacuacug

SEQ ID NO: 12655 - RNA, 20 nt, Artificial Sequence
  MKO10012655_A_Cyba
  gRNA
agcccggacguaguaauucc

SEQ ID NO: 12656 - RNA, 20 nt, Artificial Sequence
  MKO10012656_A_Cyba
  gRNA
ucaagguugucggugccugc

SEQ ID NO: 12657 - RNA, 20 nt, Artificial Sequence
  MKO10012657_A_Cyba
  gRNA
aaugacuuaccaucgcucca

SEQ ID NO: 12658 - RNA, 20 nt, Artificial Sequence
  MKO10012658_A_Cybb
  gRNA
auccaaaguguugcucgaca

SEQ ID NO: 12659 - RNA, 20 nt, Artificial Sequence
  MKO10012659_A_Cybb
  gRNA
cacaucucuucaacguugag

SEQ ID NO: 12660 - RNA, 20 nt, Artificial Sequence
  MKO10012660_A_Cybb
  gRNA
gauuucgacacacuggcagc

SEQ ID NO: 12661 - RNA, 20 nt, Artificial Sequence
  MKO10012661_A_Cybrd1
  gRNA
ucgcaaucacuguuccgaag

SEQ ID NO: 12662 - RNA, 20 nt, Artificial Sequence
  MKO10012662_A_Cybrd1
  gRNA
ugagcacgaagaucaccgac

SEQ ID NO: 12663 - RNA, 20 nt, Artificial Sequence
  MKO10012663_A_Cybrd1
  gRNA
caugacgauugcccggagag

SEQ ID NO: 12664 - RNA, 20 nt, Artificial Sequence
  MKO10012664_A_Cyc1
  gRNA
uuauguggcguaccgccacc

SEQ ID NO: 12665 - RNA, 20 nt, Artificial Sequence
  MKO10012665_A_Cyc1
  gRNA
ucagcuacaucguucgagcu

SEQ ID NO: 12666 - RNA, 20 nt, Artificial Sequence
  MKO10012666_A_Cyc1
  gRNA
uagcucgaacgauguagcug

SEQ ID NO: 12667 - RNA, 20 nt, Artificial Sequence
  MKO10012667_A_Cycs
  gRNA
uuucuguuuaggcaucaccu

SEQ ID NO: 12668 - RNA, 20 nt, Artificial Sequence
  MKO10012668_A_Cycs
  gRNA
cccguuaccuuuguucuugu

SEQ ID NO: 12669 - RNA, 20 nt, Artificial Sequence
  MKO10012669_A_Cycs
  gRNA
aaaaugggugauguugaaaa

SEQ ID NO: 12670 - RNA, 20 nt, Artificial Sequence
  MKO10012670_A_Cycu
  gRNA
guccugucuuucgaccaaag

SEQ ID NO: 12671 - RNA, 20 nt, Artificial Sequence
  MKO10012671_A_Cycu
  gRNA
aacccgaagaaauauauccc

SEQ ID NO: 12672 - RNA, 20 nt, Artificial Sequence
  MKO10012672_A_Cycu
  gRNA
cgaaagacaggacaagcacc

SEQ ID NO: 12673 - RNA, 20 nt, Artificial Sequence
  MKO10012673_A_Cyfip1
  gRNA
accuaccugauagagcagcg

SEQ ID NO: 12674 - RNA, 20 nt, Artificial Sequence
  MKO10012674_A_Cyfip1
  gRNA
accguccucgcugcucuauc

SEQ ID NO: 12675 - RNA, 20 nt, Artificial Sequence
  MKO10012675_A_Cyfip1
  gRNA
uuugcagaacgagaugcuag

SEQ ID NO: 12676 - RNA, 20 nt, Artificial Sequence
  MKO10012676_A_Cyfip2
  gRNA
cgagaucuacgagaagacgg

SEQ ID NO: 12677 - RNA, 20 nt, Artificial Sequence
  MKO10012677_A_Cyfip2
  gRNA
cucguagaucucgacccgau

SEQ ID NO: 12678 - RNA, 20 nt, Artificial Sequence
  MKO10012678_A_Cyfip2
  gRNA
uaacuuugacacgaacuucg

SEQ ID NO: 12679 - RNA, 20 nt, Artificial Sequence
  MKO10012679_A_Cygb
  gRNA
ggggucuuacggcccugaag

SEQ ID NO: 12680 - RNA, 20 nt, Artificial Sequence
  MKO10012680_A_Cygb
  gRNA
agcugcggaagcacgccugc

SEQ ID NO: 12681 - RNA, 20 nt, Artificial Sequence
  MKO10012681_A_Cygb
  gRNA
cugaaguacugcuuggccga

SEQ ID NO: 12682 - RNA, 20 nt, Artificial Sequence
  MKO10012682_A_Cyhr1
  gRNA
aacggucacuugaugugcgc

SEQ ID NO: 12683 - RNA, 20 nt, Artificial Sequence
  MKO10012683_A_Cyhr1
  gRNA
cagugcaaguacaagcguau

SEQ ID NO: 12684 - RNA, 20 nt, Artificial Sequence
  MKO10012684_A_Cyhr1
  gRNA
ggaugucugucguugggccc

SEQ ID NO: 12685 - RNA, 20 nt, Artificial Sequence
  MKO10012685_A_Cylc1
  gRNA
uccgaaucugaagauucguc

SEQ ID NO: 12686 - RNA, 20 nt, Artificial Sequence
  MKO10012686_A_Cylc1
  gRNA
gacucuacugguaguggauc

SEQ ID NO: 12687 - RNA, 20 nt, Artificial Sequence
  MKO10012687_A_Cylc1
  gRNA
aauguaaucaucauauguug

SEQ ID NO: 12688 - RNA, 20 nt, Artificial Sequence
  MKO10012688_A_Cylc2
  gRNA
caagggagagucgaaaagcg

SEQ ID NO: 12689 - RNA, 20 nt, Artificial Sequence
  MKO10012689_A_Cylc2
  gRNA
cauccguuuauuuagcugcc

SEQ ID NO: 12690 - RNA, 20 nt, Artificial Sequence
  MKO10012690_A_Cylc2
  gRNA
gcauacgauaauuacauucc

SEQ ID NO: 12691 - RNA, 20 nt, Artificial Sequence
  MKO10012691_A_Cyld
  gRNA
uguuucagauagcgugacac

SEQ ID NO: 12692 - RNA, 20 nt, Artificial Sequence
  MKO10012692_A_Cyld
  gRNA
ccucugaagcguacaacucc

SEQ ID NO: 12693 - RNA, 20 nt, Artificial Sequence
  MKO10012693_A_Cyld
  gRNA
accguccucuccgcuaauaa

SEQ ID NO: 12694 - RNA, 20 nt, Artificial Sequence
  MKO10012694_A_Cym
  gRNA
agugagaagaacucccgcau

SEQ ID NO: 12695 - RNA, 20 nt, Artificial Sequence
  MKO10012695_A_Cym
  gRNA
uguucuccguuuacaugagc

SEQ ID NO: 12696 - RNA, 20 nt, Artificial Sequence
  MKO10012696_A_Cym
  gRNA
cuacauugggacaccaccgc

SEQ ID NO: 12697 - RNA, 20 nt, Artificial Sequence
  MKO10012697_A_Cyp11a1
  gRNA
ccgaaucguccuaaaccaag

SEQ ID NO: 12698 - RNA, 20 nt, Artificial Sequence
  MKO10012698_A_Cyp11a1
  gRNA
gaagaguaucgacgcauccu

SEQ ID NO: 12699 - RNA, 20 nt, Artificial Sequence
  MKO10012699_A_Cyp11a1
  gRNA
ccucuugguuuaggacgauu

SEQ ID NO: 12700 - RNA, 20 nt, Artificial Sequence
  MKO10012700_A_Cyp11b1
  gRNA
gauuguguuugugacguugc

SEQ ID NO: 12701 - RNA, 20 nt, Artificial Sequence
  MKO10012701_A_Cyp11b1
  gRNA
auuccaagggcaugcggcaa

SEQ ID NO: 12702 - RNA, 20 nt, Artificial Sequence
  MKO10012702_A_Cyp11b1
  gRNA
ugacccgauggacaagcacc

SEQ ID NO: 12703 - RNA, 20 nt, Artificial Sequence
  MKO10012703_A_Cyp11b2
  gRNA
gcuccaggugcauccgacgg

SEQ ID NO: 12704 - RNA, 20 nt, Artificial Sequence
  MKO10012704_A_Cyp11b2
  gRNA
uggagaguaugcucccccgu

SEQ ID NO: 12705 - RNA, 20 nt, Artificial Sequence
  MKO10012705_A_Cyp11b2
  gRNA
uacccaagagcuugacucgc

SEQ ID NO: 12706 - RNA, 20 nt, Artificial Sequence
  MKO10012706_A_Cyp17a1
  gRNA
ggacauauucccgugguuga

SEQ ID NO: 12707 - RNA, 20 nt, Artificial Sequence
  MKO10012707_A_Cyp17a1
  gRNA
ggagcuacuacuauccgcaa

SEQ ID NO: 12708 - RNA, 20 nt, Artificial Sequence
  MKO10012708_A_Cyp17a1
  gRNA
agaugucucccaccgugaca

SEQ ID NO: 12709 - RNA, 20 nt, Artificial Sequence
  MKO10012709_A_Cyp19a1
  gRNA
gcccacgcuugcugccgaau

SEQ ID NO: 12710 - RNA, 20 nt, Artificial Sequence
  MKO10012710_A_Cyp19a1
  gRNA
uccaccauucgaacaagacc

SEQ ID NO: 12711 - RNA, 20 nt, Artificial Sequence
  MKO10012711_A_Cyp19a1
  gRNA
agucacuacaucucccgauu

SEQ ID NO: 12712 - RNA, 20 nt, Artificial Sequence
  MKO10012712_A_Cyp1a1
  gRNA
uacacguaccagcuccaaag

SEQ ID NO: 12713 - RNA, 20 nt, Artificial Sequence
  MKO10012713_A_Cyp1a1
  gRNA
cagucacaacugcuaucucg

SEQ ID NO: 12714 - RNA, 20 nt, Artificial Sequence
  MKO10012714_A_Cyp1a1
  gRNA
uguccugacaaugcucaaug

SEQ ID NO: 12715 - RNA, 20 nt, Artificial Sequence
  MKO10012715_A_Cyp1a2
  gRNA
uauguagauacagcgcuccu

SEQ ID NO: 12716 - RNA, 20 nt, Artificial Sequence
  MKO10012716_A_Cyp1a2
  gRNA
uggggacggucagaaagccg

SEQ ID NO: 12717 - RNA, 20 nt, Artificial Sequence
  MKO10012717_A_Cyp1a2
  gRNA
ugcuuuacagacacgguggu

SEQ ID NO: 12718 - RNA, 20 nt, Artificial Sequence
  MKO10012718_A_Cyp1b1
  gRNA
gccgccgcguuuccgaucag

SEQ ID NO: 12719 - RNA, 20 nt, Artificial Sequence
  MKO10012719_A_Cyp1b1
  gRNA
aucggaaacgcggcggcugu

SEQ ID NO: 12720 - RNA, 20 nt, Artificial Sequence
  MKO10012720_A_Cyp1b1
  gRNA
ucuaaacgacuugggcuuaa

SEQ ID NO: 12721 - RNA, 20 nt, Artificial Sequence
  MKO10012721_A_Cyp20a1
  gRNA
caggcgucuugugguuagcu

SEQ ID NO: 12722 - RNA, 20 nt, Artificial Sequence
  MKO10012722_A_Cyp20a1
  gRNA
auccgauuccaaaagauuca

SEQ ID NO: 12723 - RNA, 20 nt, Artificial Sequence
  MKO10012723_A_Cyp20a1
  gRNA
cauacaguuuccuccucacg

SEQ ID NO: 12724 - RNA, 20 nt, Artificial Sequence
  MKO10012724_A_Cyp21a1
  gRNA
ggccgaccccauaugcuaaa

SEQ ID NO: 12725 - RNA, 20 nt, Artificial Sequence
  MKO10012725_A_Cyp21a1
  gRNA
aacccuuaccauuuagcaua

SEQ ID NO: 12726 - RNA, 20 nt, Artificial Sequence
  MKO10012726_A_Cyp21a1
  gRNA
aggagaugauacuacaagug

SEQ ID NO: 12727 - RNA, 20 nt, Artificial Sequence
  MKO10012727_A_Cyp24a1
  gRNA
uucguugcgauggucccgau

SEQ ID NO: 12728 - RNA, 20 nt, Artificial Sequence
  MKO10012728_A_Cyp24a1
  gRNA
gcccagaugcaccgagucga

SEQ ID NO: 12729 - RNA, 20 nt, Artificial Sequence
  MKO10012729_A_Cyp24a1
  gRNA
aaagaaacucaugaagcccg

SEQ ID NO: 12730 - RNA, 20 nt, Artificial Sequence
  MKO10012730_A_Cyp26a1
  gRNA
cgcgucggugcgcaccaucc

SEQ ID NO: 12731 - RNA, 20 nt, Artificial Sequence
  MKO10012731_A_Cyp26a1
  gRNA
uacccgguacaggccgcuaa

SEQ ID NO: 12732 - RNA, 20 nt, Artificial Sequence
  MKO10012732_A_Cyp26a1
  gRNA
ccucgaugcgcgcguguaua

SEQ ID NO: 12733 - RNA, 20 nt, Artificial Sequence
  MKO10012733_A_Cyp26b1
  gRNA
ccauucggaagguaagucgc

SEQ ID NO: 12734 - RNA, 20 nt, Artificial Sequence
  MKO10012734_A_Cyp26b1
  gRNA
agugcgguagccgccugaga

SEQ ID NO: 12735 - RNA, 20 nt, Artificial Sequence
  MKO10012735_A_Cyp26b1
  gRNA
cauccaccgcaacaagcgca

SEQ ID NO: 12736 - RNA, 20 nt, Artificial Sequence
  MKO10012736_A_Cyp26c1
  gRNA
aguucccgccgcgagcgcua

SEQ ID NO: 12737 - RNA, 20 nt, Artificial Sequence
  MKO10012737_A_Cyp26c1
  gRNA
gguaaacagccaccggucgu

SEQ ID NO: 12738 - RNA, 20 nt, Artificial Sequence
  MKO10012738_A_Cyp26c1
  gRNA
cgcagucgacguagcgcaaa

SEQ ID NO: 12739 - RNA, 20 nt, Artificial Sequence
  MKO10012739_A_Cyp27a1
  gRNA
ugacgaggccgcgcucuaca

SEQ ID NO: 12740 - RNA, 20 nt, Artificial Sequence
  MKO10012740_A_Cyp27a1
  gRNA
guguagagcgcggccucguc

SEQ ID NO: 12741 - RNA, 20 nt, Artificial Sequence
  MKO10012741_A_Cyp27a1
  gRNA
ucacgcgaugaagaucccau

SEQ ID NO: 12742 - RNA, 20 nt, Artificial Sequence
  MKO10012742_A_Cyp27b1
  gRNA
gggcccgccucugccgagac

SEQ ID NO: 12743 - RNA, 20 nt, Artificial Sequence
  MKO10012743_A_Cyp27b1
  gRNA
cuccuggccagguauaggcg

SEQ ID NO: 12744 - RNA, 20 nt, Artificial Sequence
  MKO10012744_A_Cyp27b1
  gRNA
gugaccuugugcgacgacua

SEQ ID NO: 12745 - RNA, 20 nt, Artificial Sequence
  MKO10012745_A_Cyp2a12
  gRNA
guccacugaacuccucagcg

SEQ ID NO: 12746 - RNA, 20 nt, Artificial Sequence
  MKO10012746_A_Cyp2a12
  gRNA
cgccggguuguggugcuuua

SEQ ID NO: 12747 - RNA, 20 nt, Artificial Sequence
  MKO10012747_A_Cyp2a12
  gRNA
caugccgaaaucucucagug

SEQ ID NO: 12748 - RNA, 20 nt, Artificial Sequence
  MKO10012748_A_Cyp2a22
  gRNA
cgccggguuguggugcuaua

SEQ ID NO: 12749 - RNA, 20 nt, Artificial Sequence
  MKO10012749_A_Cyp2a22
  gRNA
caagccgaaauccuucagug

SEQ ID NO: 12750 - RNA, 20 nt, Artificial Sequence
  MKO10012750_A_Cyp2a22
  gRNA
cggcuugggcaagcgaggua

SEQ ID NO: 12751 - RNA, 20 nt, Artificial Sequence
  MKO10012751_A_Cyp2a4
  gRNA
gucauuagcucaaucgucuu

SEQ ID NO: 12752 - RNA, 20 nt, Artificial Sequence
  MKO10012752_A_Cyp2a4
  gRNA
gcaucauucuaagaagugac

SEQ ID NO: 12753 - RNA, 20 nt, Artificial Sequence
  MKO10012753_A_Cyp2a4
  gRNA
cccagauagauggugaauac

SEQ ID NO: 12754 - RNA, 20 nt, Artificial Sequence
  MKO10012754_A_Cyp2a5
  gRNA
uccuguauucaccaucuacc

SEQ ID NO: 12755 - RNA, 20 nt, Artificial Sequence
  MKO10012755_A_Cyp2a5
  gRNA
gcuucuccaucgccacgcug

SEQ ID NO: 12756 - RNA, 20 nt, Artificial Sequence
  MKO10012756_A_Cyp2a5
  gRNA
cccagguagauggugaauac

SEQ ID NO: 12757 - RNA, 20 nt, Artificial Sequence
  MKO10012757_A_Cyp2ab1
  gRNA
aguggugaucgaccuguuuc

SEQ ID NO: 12758 - RNA, 20 nt, Artificial Sequence
  MKO10012758_A_Cyp2ab1
  gRNA
ccacagcuacaacgcugcua

SEQ ID NO: 12759 - RNA, 20 nt, Artificial Sequence
  MKO10012759_A_Cyp2ab1
  gRNA
ccuuagcagcguuguagcug

SEQ ID NO: 12760 - RNA, 20 nt, Artificial Sequence
  MKO10012760_A_Cyp2b10
  gRNA
ccgucaguucuugcgccugc

SEQ ID NO: 12761 - RNA, 20 nt, Artificial Sequence
  MKO10012761_A_Cyp2b10
  gRNA
uggccagagagaaucuacga

SEQ ID NO: 12762 - RNA, 20 nt, Artificial Sequence
  MKO10012762_A_Cyp2b10
  gRNA
ugauauuuaccuucugcgca

SEQ ID NO: 12763 - RNA, 20 nt, Artificial Sequence
  MKO10012763_A_Cyp2b13
  gRNA
caacuucauuacccaucgug

SEQ ID NO: 12764 - RNA, 20 nt, Artificial Sequence
  MKO10012764_A_Cyp2b13
  gRNA
acaucagauucagcaaacgc

SEQ ID NO: 12765 - RNA, 20 nt, Artificial Sequence
  MKO10012765_A_Cyp2b13
  gRNA
ugauauuggcuguaacacac

SEQ ID NO: 12766 - RNA, 20 nt, Artificial Sequence
  MKO10012766_A_Cyp2b19
  gRNA
ugauauuugcuacgaugcac

SEQ ID NO: 12767 - RNA, 20 nt, Artificial Sequence
  MKO10012767_A_Cyp2b19
  gRNA
ugucccgcacaacaugacca

SEQ ID NO: 12768 - RNA, 20 nt, Artificial Sequence
  MKO10012768_A_Cyp2b19
  gRNA
aggcccguggucauguugug

SEQ ID NO: 12769 - RNA, 20 nt, Artificial Sequence
  MKO10012769_A_Cyp2b23
  gRNA
agugauucagccaauuguac

SEQ ID NO: 12770 - RNA, 20 nt, Artificial Sequence
  MKO10012770_A_Cyp2b23
  gRNA
uugcagcuucgugacaaaca

SEQ ID NO: 12771 - RNA, 20 nt, Artificial Sequence
  MKO10012771_A_Cyp2b23
  gRNA
ucugauagaacagaucaagc

SEQ ID NO: 12772 - RNA, 20 nt, Artificial Sequence
  MKO10012772_A_Cyp2b9
  gRNA
ucauccucuaggagugcccc

SEQ ID NO: 12773 - RNA, 20 nt, Artificial Sequence
  MKO10012773_A_Cyp2b9
  gRNA
ggccagaaaaagccucagcg

SEQ ID NO: 12774 - RNA, 20 nt, Artificial Sequence
  MKO10012774_A_Cyp2b9
  gRNA
cgacuacauugcccauagug

SEQ ID NO: 12775 - RNA, 20 nt, Artificial Sequence
  MKO10012775_A_Cyp2c29
  gRNA
uacccaugcaauaugacagu

SEQ ID NO: 12776 - RNA, 20 nt, Artificial Sequence
  MKO10012776_A_Cyp2c29
  gRNA
aagccuacugucauauugca

SEQ ID NO: 12777 - RNA, 20 nt, Artificial Sequence
  MKO10012777_A_Cyp2c29
  gRNA
uaaggaauuucuuauccuca

SEQ ID NO: 12778 - RNA, 20 nt, Artificial Sequence
  MKO10012778_A_Cyp2c37
  gRNA
uuaggccuugcauuuaguaa

SEQ ID NO: 12779 - RNA, 20 nt, Artificial Sequence
  MKO10012779_A_Cyp2c37
  gRNA
guuucucacucaugacgcug

SEQ ID NO: 12780 - RNA, 20 nt, Artificial Sequence
  MKO10012780_A_Cyp2c37
  gRNA
caaagauucugagcagcccu

SEQ ID NO: 12781 - RNA, 20 nt, Artificial Sequence
  MKO10012781_A_Cyp2c38
  gRNA
cggcccauuguuguauugca

SEQ ID NO: 12782 - RNA, 20 nt, Artificial Sequence
  MKO10012782_A_Cyp2c38
  gRNA
guuucacacucaugacccua

SEQ ID NO: 12783 - RNA, 20 nt, Artificial Sequence
  MKO10012783_A_Cyp2c38
  gRNA
auacccaugcaauacaacaa

SEQ ID NO: 12784 - RNA, 20 nt, Artificial Sequence
  MKO10012784_A_Cyp2c39
  gRNA
gaaaagauuaauaacggccu

SEQ ID NO: 12785 - RNA, 20 nt, Artificial Sequence
  MKO10012785_A_Cyp2c39
  gRNA
uucccauucccaaauuucgc

SEQ ID NO: 12786 - RNA, 20 nt, Artificial Sequence
  MKO10012786_A_Cyp2c39
  gRNA
cggcccacuguuguauuaca

SEQ ID NO: 12787 - RNA, 20 nt, Artificial Sequence
  MKO10012787_A_Cyp2c40
  gRNA
guagaaaccuugucaaaaac

SEQ ID NO: 12788 - RNA, 20 nt, Artificial Sequence
  MKO10012788_A_Cyp2c40
  gRNA
aaaaguuuauuaugacuucc

SEQ ID NO: 12789 - RNA, 20 nt, Artificial Sequence
  MKO10012789_A_Cyp2c40
  gRNA
ccuguguucacucuguauuu

SEQ ID NO: 12790 - RNA, 20 nt, Artificial Sequence
  MKO10012790_A_Cyp2c44
  gRNA
acuucaugaucgucggccau

SEQ ID NO: 12791 - RNA, 20 nt, Artificial Sequence
  MKO10012791_A_Cyp2c44
  gRNA
uggccuaccgugguccuaca

SEQ ID NO: 12792 - RNA, 20 nt, Artificial Sequence
  MKO10012792_A_Cyp2c44
  gRNA
aaacagucgauguaaucccg

SEQ ID NO: 12793 - RNA, 20 nt, Artificial Sequence
  MKO10012793_A_Cyp2c50
  gRNA
ccaagauaaugagcaccccu

SEQ ID NO: 12794 - RNA, 20 nt, Artificial Sequence
  MKO10012794_A_Cyp2c50
  gRNA
gcuucucacucacgacucug

SEQ ID NO: 12795 - RNA, 20 nt, Artificial Sequence
  MKO10012795_A_Cyp2c50
  gRNA
uauccuucagaucaauguga

SEQ ID NO: 12796 - RNA, 20 nt, Artificial Sequence
  MKO10012796_A_Cyp2c54
  gRNA
gaccauggggaugucuuugc

SEQ ID NO: 12797 - RNA, 20 nt, Artificial Sequence
  MKO10012797_A_Cyp2c54
  gRNA
ucuaaacuuguuggaaaaac

SEQ ID NO: 12798 - RNA, 20 nt, Artificial Sequence
  MKO10012798_A_Cyp2c54
  gRNA
uuaccugggcuccuuuaauu

SEQ ID NO: 12799 - RNA, 20 nt, Artificial Sequence
  MKO10012799_A_Cyp2c55
  gRNA
acccucaucaauuaucuccc

SEQ ID NO: 12800 - RNA, 20 nt, Artificial Sequence
  MKO10012800_A_Cyp2c55
  gRNA
uuaaaaucuugaacucccca

SEQ ID NO: 12801 - RNA, 20 nt, Artificial Sequence
  MKO10012801_A_Cyp2c55
  gRNA
auuacuuuguuaugacuccc

SEQ ID NO: 12802 - RNA, 20 nt, Artificial Sequence
  MKO10012802_A_Cyp2c65
  gRNA
cucaugacucugcgaaacuu

SEQ ID NO: 12803 - RNA, 20 nt, Artificial Sequence
  MKO10012803_A_Cyp2c65
  gRNA
agcgagccuccucuugaauu

SEQ ID NO: 12804 - RNA, 20 nt, Artificial Sequence
  MKO10012804_A_Cyp2c65
  gRNA
cuccuccccaugaucaguaa

SEQ ID NO: 12805 - RNA, 20 nt, Artificial Sequence
  MKO10012805_A_Cyp2c66
  gRNA
cugauaaacuugucagccac

SEQ ID NO: 12806 - RNA, 20 nt, Artificial Sequence
  MKO10012806_A_Cyp2c66
  gRNA
agcgagccuccucuugaacu

SEQ ID NO: 12807 - RNA, 20 nt, Artificial Sequence
  MKO10012807_A_Cyp2c66
  gRNA
gacaaguuuaucagaagaug

SEQ ID NO: 12808 - RNA, 20 nt, Artificial Sequence
  MKO10012808_A_Cyp2c67
  gRNA
cagccuauuguaguguuaca

SEQ ID NO: 12809 - RNA, 20 nt, Artificial Sequence
  MKO10012809_A_Cyp2c67
  gRNA
uaaccauguaacacuacaau

SEQ ID NO: 12810 - RNA, 20 nt, Artificial Sequence
  MKO10012810_A_Cyp2c67
  gRNA
ucuucacaaucaauaccuug

SEQ ID NO: 12811 - RNA, 20 nt, Artificial Sequence
  MKO10012811_A_Cyp2c68
  gRNA
uaaccauguaauaucacaau

SEQ ID NO: 12812 - RNA, 20 nt, Artificial Sequence
  MKO10012812_A_Cyp2c68
  gRNA
cugugcuuccucuugcacuu

SEQ ID NO: 12813 - RNA, 20 nt, Artificial Sequence
  MKO10012813_A_Cyp2c68
  gRNA
cagccuauugugauauuaca

SEQ ID NO: 12814 - RNA, 20 nt, Artificial Sequence
  MKO10012814_A_Cyp2c69
  gRNA
aaguaaucgaugaagucccg

SEQ ID NO: 12815 - RNA, 20 nt, Artificial Sequence
  MKO10012815_A_Cyp2c69
  gRNA
uuccagagaacacuucucca

SEQ ID NO: 12816 - RNA, 20 nt, Artificial Sequence
  MKO10012816_A_Cyp2c69
  gRNA
ucccauggccaaguuccuca

SEQ ID NO: 12817 - RNA, 20 nt, Artificial Sequence
  MKO10012817_A_Cyp2c70
  gRNA
cauuguagucaaaucgaugc

SEQ ID NO: 12818 - RNA, 20 nt, Artificial Sequence
  MKO10012818_A_Cyp2c70
  gRNA
aacccggcguuucucccuca

SEQ ID NO: 12819 - RNA, 20 nt, Artificial Sequence
  MKO10012819_A_Cyp2c70
  gRNA
agacguaccuaagccuuggc

SEQ ID NO: 12820 - RNA, 20 nt, Artificial Sequence
  MKO10012820_A_Cyp2d10
  gRNA
gaaguccuuacuggccauag

SEQ ID NO: 12821 - RNA, 20 nt, Artificial Sequence
  MKO10012821_A_Cyp2d10
  gRNA
aagaccuucccaggcagucc

SEQ ID NO: 12822 - RNA, 20 nt, Artificial Sequence
  MKO10012822_A_Cyp2d10
  gRNA
gauaguuugacagaaaucuc

SEQ ID NO: 12823 - RNA, 20 nt, Artificial Sequence
  MKO10012823_A_Cyp2d11
  gRNA
ccaauauuccugcgcauccc

SEQ ID NO: 12824 - RNA, 20 nt, Artificial Sequence
  MKO10012824_A_Cyp2d11
  gRNA
ucgccucugcucuugccacu

SEQ ID NO: 12825 - RNA, 20 nt, Artificial Sequence
  MKO10012825_A_Cyp2d11
  gRNA
gaauguuucacagaaaucuc

SEQ ID NO: 12826 - RNA, 20 nt, Artificial Sequence
  MKO10012826_A_Cyp2d12
  gRNA
uugucuucucugcgcaauuu

SEQ ID NO: 12827 - RNA, 20 nt, Artificial Sequence
  MKO10012827_A_Cyp2d12
  gRNA
cccaccagccugaguaguga

SEQ ID NO: 12828 - RNA, 20 nt, Artificial Sequence
  MKO10012828_A_Cyp2d12
  gRNA
gugcccaucuuugagcaucu

SEQ ID NO: 12829 - RNA, 20 nt, Artificial Sequence
  MKO10012829_A_Cyp2d22
  gRNA
cuacagcugcggggucgcua

SEQ ID NO: 12830 - RNA, 20 nt, Artificial Sequence
  MKO10012830_A_Cyp2d22
  gRNA
ccuaccaguauggucagcga

SEQ ID NO: 12831 - RNA, 20 nt, Artificial Sequence
  MKO10012831_A_Cyp2d22
  gRNA
gccgccuucgcugaccauac

SEQ ID NO: 12832 - RNA, 20 nt, Artificial Sequence
  MKO10012832_A_Cyp2d26
  gRNA
uaauugagcacgacucgacc

SEQ ID NO: 12833 - RNA, 20 nt, Artificial Sequence
  MKO10012833_A_Cyp2d26
  gRNA
agacacuggcuucgucggag

SEQ ID NO: 12834 - RNA, 20 nt, Artificial Sequence
  MKO10012834_A_Cyp2d26
  gRNA
caaaucgacgagcauaaaug

SEQ ID NO: 12835 - RNA, 20 nt, Artificial Sequence
  MKO10012835_A_Cyp2d34
  gRNA
ugaccagccaccccgaaauu

SEQ ID NO: 12836 - RNA, 20 nt, Artificial Sequence
  MKO10012836_A_Cyp2d34
  gRNA
ccaauacuccugcgaauccc

SEQ ID NO: 12837 - RNA, 20 nt, Artificial Sequence
  MKO10012837_A_Cyp2d34
  gRNA
guauccacccugcgaaacuu

SEQ ID NO: 12838 - RNA, 20 nt, Artificial Sequence
  MKO10012838_A_Cyp2d40
  gRNA
ccacuucagcuacucugacc

SEQ ID NO: 12839 - RNA, 20 nt, Artificial Sequence
  MKO10012839_A_Cyp2d40
  gRNA
augcagaaucaugaguagca

SEQ ID NO: 12840 - RNA, 20 nt, Artificial Sequence
  MKO10012840_A_Cyp2d40
  gRNA
acaagccuaccuuagggaua

SEQ ID NO: 12841 - RNA, 20 nt, Artificial Sequence
  MKO10012841_A_Cyp2d9
  gRNA
cgauacucuugcguauccca

SEQ ID NO: 12842 - RNA, 20 nt, Artificial Sequence
  MKO10012842_A_Cyp2d9
  gRNA
cuggcugacaaggcccucca

SEQ ID NO: 12843 - RNA, 20 nt, Artificial Sequence
  MKO10012843_A_Cyp2d9
  gRNA
caaaguuugacagaagucuc

SEQ ID NO: 12844 - RNA, 20 nt, Artificial Sequence
  MKO10012844_A_Cyp2e1
  gRNA
ccacauggaaggacgugcgg

SEQ ID NO: 12845 - RNA, 20 nt, Artificial Sequence
  MKO10012845_A_Cyp2e1
  gRNA
ccacgaugcgccucugaccc

SEQ ID NO: 12846 - RNA, 20 nt, Artificial Sequence
  MKO10012846_A_Cyp2e1
  gRNA
cccuaaguauccuccgugac

SEQ ID NO: 12847 - RNA, 20 nt, Artificial Sequence
  MKO10012847_A_Cyp2f2
  gRNA
ccgcagcguccgcgaacacc

SEQ ID NO: 12848 - RNA, 20 nt, Artificial Sequence
  MKO10012848_A_Cyp2f2
  gRNA
aaaagacgggguaugcgccu

SEQ ID NO: 12849 - RNA, 20 nt, Artificial Sequence
  MKO10012849_A_Cyp2f2
  gRNA
cgagugcuuaccucgcccca

SEQ ID NO: 12850 - RNA, 20 nt, Artificial Sequence
  MKO10012850_A_Cyp2g1
  gRNA
cggaaaacgcuucgacuauc

SEQ ID NO: 12851 - RNA, 20 nt, Artificial Sequence
  MKO10012851_A_Cyp2g1
  gRNA
guccaacgucaucuguuccg

SEQ ID NO: 12852 - RNA, 20 nt, Artificial Sequence
  MKO10012852_A_Cyp2g1
  gRNA
cugaccguccuucgaaacuu

SEQ ID NO: 12853 - RNA, 20 nt, Artificial Sequence
  MKO10012853_A_Cyp2j11
  gRNA
auuguuuguuucccguauga

SEQ ID NO: 12854 - RNA, 20 nt, Artificial Sequence
  MKO10012854_A_Cyp2j11
  gRNA
aacguaauuagcgugaauuu

SEQ ID NO: 12855 - RNA, 20 nt, Artificial Sequence
  MKO10012855_A_Cyp2j11
  gRNA
auguugccuugcagcuaaac

SEQ ID NO: 12856 - RNA, 20 nt, Artificial Sequence
  MKO10012856_A_Cyp2j12
  gRNA
auuagaugaagccacguguu

SEQ ID NO: 12857 - RNA, 20 nt, Artificial Sequence
  MKO10012857_A_Cyp2j12
  gRNA
cuuggagcagcgcauacaga

SEQ ID NO: 12858 - RNA, 20 nt, Artificial Sequence
  MKO10012858_A_Cyp2j12
  gRNA
aaccuaacuagccuggacuu

SEQ ID NO: 12859 - RNA, 20 nt, Artificial Sequence
  MKO10012859_A_Cyp2j13
  gRNA
gagcuuagagcaucgaauuc

SEQ ID NO: 12860 - RNA, 20 nt, Artificial Sequence
  MKO10012860_A_Cyp2j13
  gRNA
gaaugcuuacauggaccauu

SEQ ID NO: 12861 - RNA, 20 nt, Artificial Sequence
  MKO10012861_A_Cyp2j13
  gRNA
agcucuacaacaucuuccca

SEQ ID NO: 12862 - RNA, 20 nt, Artificial Sequence
  MKO10012862_A_Cyp2j5
  gRNA
ugugaaucgcuuuaugacac

SEQ ID NO: 12863 - RNA, 20 nt, Artificial Sequence
  MKO10012863_A_Cyp2j5
  gRNA
guaggauuagucguaucuaa

SEQ ID NO: 12864 - RNA, 20 nt, Artificial Sequence
  MKO10012864_A_Cyp2j5
  gRNA
ucaggaggagacccaucacc

SEQ ID NO: 12865 - RNA, 20 nt, Artificial Sequence
  MKO10012865_A_Cyp2j6
  gRNA
ggagacaacaaugauuaguc

SEQ ID NO: 12866 - RNA, 20 nt, Artificial Sequence
  MKO10012866_A_Cyp2j6
  gRNA
cguucuugcauaacacuuag

SEQ ID NO: 12867 - RNA, 20 nt, Artificial Sequence
  MKO10012867_A_Cyp2j6
  gRNA
gaugcugagguuacuggacg

SEQ ID NO: 12868 - RNA, 20 nt, Artificial Sequence
  MKO10012868_A_Cyp2j8
  gRNA
auguugccuugccgcuaaaa

SEQ ID NO: 12869 - RNA, 20 nt, Artificial Sequence
  MKO10012869_A_Cyp2j8
  gRNA
aaaacguuccccaauaguga

SEQ ID NO: 12870 - RNA, 20 nt, Artificial Sequence
  MKO10012870_A_Cyp2j8
  gRNA
aagcuuagaacaacgcauac

SEQ ID NO: 12871 - RNA, 20 nt, Artificial Sequence
  MKO10012871_A_Cyp2j9
  gRNA
agaggaggcucacuaccuug

SEQ ID NO: 12872 - RNA, 20 nt, Artificial Sequence
  MKO10012872_A_Cyp2j9
  gRNA
gguaauagagcaaauuaugu

SEQ ID NO: 12873 - RNA, 20 nt, Artificial Sequence
  MKO10012873_A_Cyp2j9
  gRNA
ccgauauuguuaacaaucac

SEQ ID NO: 12874 - RNA, 20 nt, Artificial Sequence
  MKO10012874_A_Cyp2r1
  gRNA
cuacaaccaaugugcuccgc

SEQ ID NO: 12875 - RNA, 20 nt, Artificial Sequence
  MKO10012875_A_Cyp2r1
  gRNA
guucuauccugagcgauuuc

SEQ ID NO: 12876 - RNA, 20 nt, Artificial Sequence
  MKO10012876_A_Cyp2r1
  gRNA
cugcaucuuccgaaguugca

SEQ ID NO: 12877 - RNA, 20 nt, Artificial Sequence
  MKO10012877_A_Cyp2s1
  gRNA
gcgucaacgacaucacgugc

SEQ ID NO: 12878 - RNA, 20 nt, Artificial Sequence
  MKO10012878_A_Cyp2s1
  gRNA
gcguggaacauuggcaacgc

SEQ ID NO: 12879 - RNA, 20 nt, Artificial Sequence
  MKO10012879_A_Cyp2s1
  gRNA
cuggcgccgcgugguggucc

SEQ ID NO: 12880 - RNA, 20 nt, Artificial Sequence
  MKO10012880_A_Cyp2t4
  gRNA
uaccauugaggaucgcaucc

SEQ ID NO: 12881 - RNA, 20 nt, Artificial Sequence
  MKO10012881_A_Cyp2t4
  gRNA
uugcgaagcgagugccaacg

SEQ ID NO: 12882 - RNA, 20 nt, Artificial Sequence
  MKO10012882_A_Cyp2t4
  gRNA
gucuucgaucgcuucaccug

SEQ ID NO: 12883 - RNA, 20 nt, Artificial Sequence
  MKO10012883_A_Cyp2u1
  gRNA
cacucgacgcuucgucauuu

SEQ ID NO: 12884 - RNA, 20 nt, Artificial Sequence
  MKO10012884_A_Cyp2u1
  gRNA
cgaaaugacgaagcgucgag

SEQ ID NO: 12885 - RNA, 20 nt, Artificial Sequence
  MKO10012885_A_Cyp2u1
  gRNA
ggaacccucagguaacgcaa

SEQ ID NO: 12886 - RNA, 20 nt, Artificial Sequence
  MKO10012886_A_Cyp2w1
  gRNA
gcagugugcgcaccgugaau

SEQ ID NO: 12887 - RNA, 20 nt, Artificial Sequence
  MKO10012887_A_Cyp2w1
  gRNA
ccggucggcuagcucaugcc

SEQ ID NO: 12888 - RNA, 20 nt, Artificial Sequence
  MKO10012888_A_Cyp2w1
  gRNA
ccgggcaugagcuagccgac

SEQ ID NO: 12889 - RNA, 20 nt, Artificial Sequence
  MKO10012889_A_Cyp39a1
  gRNA
gcgcuguuugagaaaaauau

SEQ ID NO: 12890 - RNA, 20 nt, Artificial Sequence
  MKO10012890_A_Cyp39a1
  gRNA
auaaaagcucacggaucugc

SEQ ID NO: 12891 - RNA, 20 nt, Artificial Sequence
  MKO10012891_A_Cyp39a1
  gRNA
gcaguuuaaaaccuaugaug

SEQ ID NO: 12892 - RNA, 20 nt, Artificial Sequence
  MKO10012892_A_Cyp3a11
  gRNA
ggguuuauggaaauucgaca

SEQ ID NO: 12893 - RNA, 20 nt, Artificial Sequence
  MKO10012893_A_Cyp3a11
  gRNA
auaaaaaguauggaaaaaca

SEQ ID NO: 12894 - RNA, 20 nt, Artificial Sequence
  MKO10012894_A_Cyp3a11
  gRNA
uucagcacagugccuaaaaa

SEQ ID NO: 12895 - RNA, 20 nt, Artificial Sequence
  MKO10012895_A_Cyp3a13
  gRNA
gccuacccgccgguuuguga

SEQ ID NO: 12896 - RNA, 20 nt, Artificial Sequence
  MKO10012896_A_Cyp3a13
  gRNA
gacgauucuugcuuaccaga

SEQ ID NO: 12897 - RNA, 20 nt, Artificial Sequence
  MKO10012897_A_Cyp3a13
  gRNA
auucuagcgcuuugguccag

SEQ ID NO: 12898 - RNA, 20 nt, Artificial Sequence
  MKO10012898_A_Cyp3a16
  gRNA
cacucaccuuguaauaauuc

SEQ ID NO: 12899 - RNA, 20 nt, Artificial Sequence
  MKO10012899_A_Cyp3a16
  gRNA
caucucucuagcuaaagaug

SEQ ID NO: 12900 - RNA, 20 nt, Artificial Sequence
  MKO10012900_A_Cyp3a16
  gRNA
caccuccuugagauuuccac

SEQ ID NO: 12901 - RNA, 20 nt, Artificial Sequence
  MKO10012901_A_Cyp3a25
  gRNA
ccaaaaccucuaccguuacu

SEQ ID NO: 12902 - RNA, 20 nt, Artificial Sequence
  MKO10012902_A_Cyp3a25
  gRNA
ccaaguaacgguagagguuu

SEQ ID NO: 12903 - RNA, 20 nt, Artificial Sequence
  MKO10012903_A_Cyp3a25
  gRNA
aaaggccauuaccauaucug

SEQ ID NO: 12904 - RNA, 20 nt, Artificial Sequence
  MKO10012904_A_Cyp3a41a
  gRNA
agauaugggacccguacaca

SEQ ID NO: 12905 - RNA, 20 nt, Artificial Sequence
  MKO10012905_A_Cyp3a41a
  gRNA
uucagcacagugccuaaaaa

SEQ ID NO: 12906 - RNA, 20 nt, Artificial Sequence
  MKO10012906_A_Cyp3a41a
  gRNA
ggguuuauggaaauuugaca

SEQ ID NO: 12907 - RNA, 20 nt, Artificial Sequence
  MKO10012907_A_Cyp3a41b
  gRNA
gcuuuacucauuauacccac

SEQ ID NO: 12908 - RNA, 20 nt, Artificial Sequence
  MKO10012908_A_Cyp3a41b
  gRNA
agauaugggacccguacaca

SEQ ID NO: 12909 - RNA, 20 nt, Artificial Sequence
  MKO10012909_A_Cyp3a41b
  gRNA
uucagcacagugccuaaaaa

SEQ ID NO: 12910 - RNA, 20 nt, Artificial Sequence
  MKO10012910_A_Cyp3a44
  gRNA
aacaccucuccuugucauca

SEQ ID NO: 12911 - RNA, 20 nt, Artificial Sequence
  MKO10012911_A_Cyp3a44
  gRNA
ggguauauggaaauuugaca

SEQ ID NO: 12912 - RNA, 20 nt, Artificial Sequence
  MKO10012912_A_Cyp3a44
  gRNA
guuuaucugucuucacaaac

SEQ ID NO: 12913 - RNA, 20 nt, Artificial Sequence
  MKO10012913_A_Cyp3a57
  gRNA
caccuccuugaguuugcuac

SEQ ID NO: 12914 - RNA, 20 nt, Artificial Sequence
  MKO10012914_A_Cyp3a57
  gRNA
cuuaaagagaccaugagaau

SEQ ID NO: 12915 - RNA, 20 nt, Artificial Sequence
  MKO10012915_A_Cyp3a57
  gRNA
agagaucaucaaaauugugc

SEQ ID NO: 12916 - RNA, 20 nt, Artificial Sequence
  MKO10012916_A_Cyp3a59
  gRNA
acccuagacucuugggccag

SEQ ID NO: 12917 - RNA, 20 nt, Artificial Sequence
  MKO10012917_A_Cyp3a59
  gRNA
ccaaaaccucuaccuuuauu

SEQ ID NO: 12918 - RNA, 20 nt, Artificial Sequence
  MKO10012918_A_Cyp3a59
  gRNA
augauagccaauauaggcuu

SEQ ID NO: 12919 - RNA, 20 nt, Artificial Sequence
  MKO10012919_A_Cyp46a1
  gRNA
caaacacagucugaagcgcg

SEQ ID NO: 12920 - RNA, 20 nt, Artificial Sequence
  MKO10012920_A_Cyp46a1
  gRNA
acacgcucaccugcggcuga

SEQ ID NO: 12921 - RNA, 20 nt, Artificial Sequence
  MKO10012921_A_Cyp46a1
  gRNA
cgcgcgcuucagacuguguu

SEQ ID NO: 12922 - RNA, 20 nt, Artificial Sequence
  MKO10012922_A_Cyp4a10
  gRNA
ucccaagugccuuuccuaga

SEQ ID NO: 12923 - RNA, 20 nt, Artificial Sequence
  MKO10012923_A_Cyp4a10
  gRNA
ggguuagcauccuccugugc

SEQ ID NO: 12924 - RNA, 20 nt, Artificial Sequence
  MKO10012924_A_Cyp4a10
  gRNA
uugcuuccccagaaccaucu

SEQ ID NO: 12925 - RNA, 20 nt, Artificial Sequence
  MKO10012925_A_Cyp4a12a
  gRNA
agacucuguucguguaaugc

SEQ ID NO: 12926 - RNA, 20 nt, Artificial Sequence
  MKO10012926_A_Cyp4a12a
  gRNA
ugaugugucgaaagaucucc

SEQ ID NO: 12927 - RNA, 20 nt, Artificial Sequence
  MKO10012927_A_Cyp4a12a
  gRNA
ucugccaugauuuccguaua

SEQ ID NO: 12928 - RNA, 20 nt, Artificial Sequence
  MKO10012928_A_Cyp4a12b
  gRNA
ucugccaugauuuccgugua

SEQ ID NO: 12929 - RNA, 20 nt, Artificial Sequence
  MKO10012929_A_Cyp4a12b
  gRNA
aggucaucaaggugaugugu

SEQ ID NO: 12930 - RNA, 20 nt, Artificial Sequence
  MKO10012930_A_Cyp4a12b
  gRNA
agggcgugguuugcuucugc

SEQ ID NO: 12931 - RNA, 20 nt, Artificial Sequence
  MKO10012931_A_Cyp4a14
  gRNA
agaaccaccuucacauaguc

SEQ ID NO: 12932 - RNA, 20 nt, Artificial Sequence
  MKO10012932_A_Cyp4a14
  gRNA
ccccgagagacacuguaagc

SEQ ID NO: 12933 - RNA, 20 nt, Artificial Sequence
  MKO10012933_A_Cyp4a14
  gRNA
gagucaacauccgccgaugc

SEQ ID NO: 12934 - RNA, 20 nt, Artificial Sequence
  MKO10012934_A_Cyp4a29-ps
  gRNA
aaucgguagaggcuagccuu

SEQ ID NO: 12935 - RNA, 20 nt, Artificial Sequence
  MKO10012935_A_Cyp4a29-ps
  gRNA
ugacauccucaaacccuaug

SEQ ID NO: 12936 - RNA, 20 nt, Artificial Sequence
  MKO10012936_A_Cyp4a29-ps
  gRNA
caugacuuccccauauccag

SEQ ID NO: 12937 - RNA, 20 nt, Artificial Sequence
  MKO10012937_A_Cyp4a30b-ps
  gRNA
cauagaucacgacacgugca

SEQ ID NO: 12938 - RNA, 20 nt, Artificial Sequence
  MKO10012938_A_Cyp4a30b-ps
  gRNA
gaguuaacauucgccgaugc

SEQ ID NO: 12939 - RNA, 20 nt, Artificial Sequence
  MKO10012939_A_Cyp4a30b-ps
  gRNA
cccccagagccaccguacau

SEQ ID NO: 12940 - RNA, 20 nt, Artificial Sequence
  MKO10012940_A_Cyp4a31
  gRNA
cuaagccugacccgauuugc

SEQ ID NO: 12941 - RNA, 20 nt, Artificial Sequence
  MKO10012941_A_Cyp4a31
  gRNA
accaugacuguccguuuaac

SEQ ID NO: 12942 - RNA, 20 nt, Artificial Sequence
  MKO10012942_A_Cyp4a31
  gRNA
ucccaucaccgcccuuucac

SEQ ID NO: 12943 - RNA, 20 nt, Artificial Sequence
  MKO10012943_A_Cyp4a32
  gRNA
caaaggcgaacaagaacuaa

SEQ ID NO: 12944 - RNA, 20 nt, Artificial Sequence
  MKO10012944_A_Cyp4a32
  gRNA
cuguagauaccauuagccuu

SEQ ID NO: 12945 - RNA, 20 nt, Artificial Sequence
  MKO10012945_A_Cyp4a32
  gRNA
agccaugguuccagcaccgg

SEQ ID NO: 12946 - RNA, 20 nt, Artificial Sequence
  MKO10012946_A_Cyp4b1
  gRNA
acccucaugaagugcaccuu

SEQ ID NO: 12947 - RNA, 20 nt, Artificial Sequence
  MKO10012947_A_Cyp4b1
  gRNA
gccuggacaaggugguaacu

SEQ ID NO: 12948 - RNA, 20 nt, Artificial Sequence
  MKO10012948_A_Cyp4b1
  gRNA
gagacagcggccuaagccac

SEQ ID NO: 12949 - RNA, 20 nt, Artificial Sequence
  MKO10012949_A_Cyp4f13
  gRNA
aguucggguggacgagucgc

SEQ ID NO: 12950 - RNA, 20 nt, Artificial Sequence
  MKO10012950_A_Cyp4f13
  gRNA
cuccaagggcacuucccguc

SEQ ID NO: 12951 - RNA, 20 nt, Artificial Sequence
  MKO10012951_A_Cyp4f13
  gRNA
gucagcugcuguugcaccca

SEQ ID NO: 12952 - RNA, 20 nt, Artificial Sequence
  MKO10012952_A_Cyp4f14
  gRNA
uagaucggacgaugucagaa

SEQ ID NO: 12953 - RNA, 20 nt, Artificial Sequence
  MKO10012953_A_Cyp4f14
  gRNA
cuugaaggaauugacucguu

SEQ ID NO: 12954 - RNA, 20 nt, Artificial Sequence
  MKO10012954_A_Cyp4f14
  gRNA
ugaaaucaaccguugccacu

SEQ ID NO: 12955 - RNA, 20 nt, Artificial Sequence
  MKO10012955_A_Cyp4f15
  gRNA
gucagcuucgguagcccuaa

SEQ ID NO: 12956 - RNA, 20 nt, Artificial Sequence
  MKO10012956_A_Cyp4f15
  gRNA
agaacagaucgaaugauguc

SEQ ID NO: 12957 - RNA, 20 nt, Artificial Sequence
  MKO10012957_A_Cyp4f15
  gRNA
ucugaaggaggugacuaacc

SEQ ID NO: 12958 - RNA, 20 nt, Artificial Sequence
  MKO10012958_A_Cyp4f16
  gRNA
caugcagcugguuaccgaaa

SEQ ID NO: 12959 - RNA, 20 nt, Artificial Sequence
  MKO10012959_A_Cyp4f16
  gRNA
caggugucagcagucgacga

SEQ ID NO: 12960 - RNA, 20 nt, Artificial Sequence
  MKO10012960_A_Cyp4f16
  gRNA
uccaagauguccaucucuuu

SEQ ID NO: 12961 - RNA, 20 nt, Artificial Sequence
  MKO10012961_A_Cyp4f17
  gRNA
gacagcugcgguggccccua

SEQ ID NO: 12962 - RNA, 20 nt, Artificial Sequence
  MKO10012962_A_Cyp4f17
  gRNA
agaagggcccaauccaacag

SEQ ID NO: 12963 - RNA, 20 nt, Artificial Sequence
  MKO10012963_A_Cyp4f17
  gRNA
acuugggguggauaagccuc

SEQ ID NO: 12964 - RNA, 20 nt, Artificial Sequence
  MKO10012964_A_Cyp4f18
  gRNA
ucuaccguuuccugaagccg

SEQ ID NO: 12965 - RNA, 20 nt, Artificial Sequence
  MKO10012965_A_Cyp4f18
  gRNA
gauggccucuugaugaguac

SEQ ID NO: 12966 - RNA, 20 nt, Artificial Sequence
  MKO10012966_A_Cyp4f18
  gRNA
cagcuuugacagcaauugcc

SEQ ID NO: 12967 - RNA, 20 nt, Artificial Sequence
  MKO10012967_A_Cyp4f37
  gRNA
uauggaaagucguguccuuu

SEQ ID NO: 12968 - RNA, 20 nt, Artificial Sequence
  MKO10012968_A_Cyp4f37
  gRNA
accgagauguccaucucugu

SEQ ID NO: 12969 - RNA, 20 nt, Artificial Sequence
  MKO10012969_A_Cyp4f37
  gRNA
uccauaccuuugugaagccc

SEQ ID NO: 12970 - RNA, 20 nt, Artificial Sequence
  MKO10012970_A_Cyp4f39
  gRNA
cgugcaugauguucgugcac

SEQ ID NO: 12971 - RNA, 20 nt, Artificial Sequence
  MKO10012971_A_Cyp4f39
  gRNA
gaugugcucgaacaugucaa

SEQ ID NO: 12972 - RNA, 20 nt, Artificial Sequence
  MKO10012972_A_Cyp4f39
  gRNA
ugauuacaucaagccugugu

SEQ ID NO: 12973 - RNA, 20 nt, Artificial Sequence
  MKO10012973_A_Cyp4f40
  gRNA
cagaucggaugauaucaggg

SEQ ID NO: 12974 - RNA, 20 nt, Artificial Sequence
  MKO10012974_A_Cyp4f40
  gRNA
gucagcugcgguugccccaa

SEQ ID NO: 12975 - RNA, 20 nt, Artificial Sequence
  MKO10012975_A_Cyp4f40
  gRNA
aaaggccaaguggcugcgcc

SEQ ID NO: 12976 - RNA, 20 nt, Artificial Sequence
  MKO10012976_A_Cyp4v3
  gRNA
accugccgaucauuaaacuu

SEQ ID NO: 12977 - RNA, 20 nt, Artificial Sequence
  MKO10012977_A_Cyp4v3
  gRNA
aguauguccguacaguguau

SEQ ID NO: 12978 - RNA, 20 nt, Artificial Sequence
  MKO10012978_A_Cyp4v3
  gRNA
cuugcaguacggggagcaaa

SEQ ID NO: 12979 - RNA, 20 nt, Artificial Sequence
  MKO10012979_A_Cyp4x1
  gRNA
ucaucacugacccguuuauc

SEQ ID NO: 12980 - RNA, 20 nt, Artificial Sequence
  MKO10012980_A_Cyp4x1
  gRNA
cacucaggaaacaaccaucg

SEQ ID NO: 12981 - RNA, 20 nt, Artificial Sequence
  MKO10012981_A_Cyp4x1
  gRNA
agaaauaucuucgcauaguc

SEQ ID NO: 12982 - RNA, 20 nt, Artificial Sequence
  MKO10012982_A_Cyp51
  gRNA
gcuuaaagugggcuauguua

SEQ ID NO: 12983 - RNA, 20 nt, Artificial Sequence
  MKO10012983_A_Cyp51
  gRNA
cggcugacaacaccuguguu

SEQ ID NO: 12984 - RNA, 20 nt, Artificial Sequence
  MKO10012984_A_Cyp51
  gRNA
ggcucagcuguacgcagacc

SEQ ID NO: 12985 - RNA, 20 nt, Artificial Sequence
  MKO10012985_A_Cyp7a1
  gRNA
cguugagaaacaugcguaga

SEQ ID NO: 12986 - RNA, 20 nt, Artificial Sequence
  MKO10012986_A_Cyp7a1
  gRNA
ccacuagugccggaaauacu

SEQ ID NO: 12987 - RNA, 20 nt, Artificial Sequence
  MKO10012987_A_Cyp7a1
  gRNA
caacggguugauuccauacc

SEQ ID NO: 12988 - RNA, 20 nt, Artificial Sequence
  MKO10012988_A_Cyp7b1
  gRNA
aacugucaauuucgucacgc

SEQ ID NO: 12989 - RNA, 20 nt, Artificial Sequence
  MKO10012989_A_Cyp7b1
  gRNA
aucacauuugcgacucuaua

SEQ ID NO: 12990 - RNA, 20 nt, Artificial Sequence
  MKO10012990_A_Cyp7b1
  gRNA
cgugaaccacccuugauaaa

SEQ ID NO: 12991 - RNA, 20 nt, Artificial Sequence
  MKO10012991_A_Cyp8b1
  gRNA
agggccuaaagguucgaguc

SEQ ID NO: 12992 - RNA, 20 nt, Artificial Sequence
  MKO10012992_A_Cyp8b1
  gRNA
caagaguaccagauccgucg

SEQ ID NO: 12993 - RNA, 20 nt, Artificial Sequence
  MKO10012993_A_Cyp8b1
  gRNA
uauguacuucgacuucaagc

SEQ ID NO: 12994 - RNA, 20 nt, Artificial Sequence
  MKO10012994_A_Cypt10
  gRNA
accauaccucgacagagacc

SEQ ID NO: 12995 - RNA, 20 nt, Artificial Sequence
  MKO10012995_A_Cypt10
  gRNA
uccaaagguucagucgguuc

SEQ ID NO: 12996 - RNA, 20 nt, Artificial Sequence
  MKO10012996_A_Cypt10
  gRNA
ucgauugaugcgaagucaaa

SEQ ID NO: 12997 - RNA, 20 nt, Artificial Sequence
  MKO10012997_A_Cypt12
  gRNA
gggcgucaacaggcaucgaa

SEQ ID NO: 12998 - RNA, 20 nt, Artificial Sequence
  MKO10012998_A_Cypt12
  gRNA
guucuugcaccuucgaccau

SEQ ID NO: 12999 - RNA, 20 nt, Artificial Sequence
  MKO10012999_A_Cypt12
  gRNA
agcucuacgauuccgcugcu

SEQ ID NO: 13000 - RNA, 20 nt, Artificial Sequence
  MKO10013000_A_Cypt14
  gRNA
gcuuuaugcugcaaaaguug

SEQ ID NO: 13001 - RNA, 20 nt, Artificial Sequence
  MKO10013001_A_Cypt14
  gRNA
auccaagccaaagaaaugua

SEQ ID NO: 13002 - RNA, 20 nt, Artificial Sequence
  MKO10013002_A_Cypt14
  gRNA
ucaacuggcaucaaaaguga

SEQ ID NO: 13003 - RNA, 20 nt, Artificial Sequence
  MKO10013003_A_Cypt15
  gRNA
cuaagccuacugccuaugca

SEQ ID NO: 13004 - RNA, 20 nt, Artificial Sequence
  MKO10013004_A_Cypt15
  gRNA
augcuacaaauguugugaug

SEQ ID NO: 13005 - RNA, 20 nt, Artificial Sequence
  MKO10013005_A_Cypt15
  gRNA
ucgacuggcaucaaaaguga

SEQ ID NO: 13006 - RNA, 20 nt, Artificial Sequence
  MKO10013006_A_Cypt1
  gRNA
acaauugacgcggagccaac

SEQ ID NO: 13007 - RNA, 20 nt, Artificial Sequence
  MKO10013007_A_Cypt1
  gRNA
cacuggucuagcgcagcagc

SEQ ID NO: 13008 - RNA, 20 nt, Artificial Sequence
  MKO10013008_A_Cypt1
  gRNA
gacagugacccauuuccgaa

SEQ ID NO: 13009 - RNA, 20 nt, Artificial Sequence
  MKO10013009_A_Cypt2
  gRNA
ccaacuaaagcucaucgaac

SEQ ID NO: 13010 - RNA, 20 nt, Artificial Sequence
  MKO10013010_A_Cypt2
  gRNA
ccaguucgaugagcuuuagu

SEQ ID NO: 13011 - RNA, 20 nt, Artificial Sequence
  MKO10013011_A_Cypt2
  gRNA
gagcuccgcuauggcucggg

SEQ ID NO: 13012 - RNA, 20 nt, Artificial Sequence
  MKO10013012_A_Cypt3
  gRNA
cugccgcagcucuagacccg

SEQ ID NO: 13013 - RNA, 20 nt, Artificial Sequence
  MKO10013013_A_Cypt3
  gRNA
accaugcauugacagugacc

SEQ ID NO: 13014 - RNA, 20 nt, Artificial Sequence
  MKO10013014_A_Cypt3
  gRNA
aauguaauucugcuacgaga

SEQ ID NO: 13015 - RNA, 20 nt, Artificial Sequence
  MKO10013015_A_Cypt4
  gRNA
accauaccucgacagagacc

SEQ ID NO: 13016 - RNA, 20 nt, Artificial Sequence
  MKO10013016_A_Cypt4
  gRNA
uccaaagguucagucgguuc

SEQ ID NO: 13017 - RNA, 20 nt, Artificial Sequence
  MKO10013017_A_Cypt4
  gRNA
ucgauugaugcgaagucaaa

SEQ ID NO: 13018 - RNA, 20 nt, Artificial Sequence
  MKO10013018_A_Cypt7
  gRNA
uuuggacccguucggggucu

SEQ ID NO: 13019 - RNA, 20 nt, Artificial Sequence
  MKO10013019_A_Cypt7
  gRNA
acaauugacgcggagccaac

SEQ ID NO: 13020 - RNA, 20 nt, Artificial Sequence
  MKO10013020_A_Cypt7
  gRNA
cuucucaagcuucgaaauuu

SEQ ID NO: 13021 - RNA, 20 nt, Artificial Sequence
  MKO10013021_A_Cypt8
  gRNA
uuuggacccguucggggucu

SEQ ID NO: 13022 - RNA, 20 nt, Artificial Sequence
  MKO10013022_A_Cypt8
  gRNA
acaauugacgcggagccaac

SEQ ID NO: 13023 - RNA, 20 nt, Artificial Sequence
  MKO10013023_A_Cypt8
  gRNA
cuucucaagcuucgaaauuu

SEQ ID NO: 13024 - RNA, 20 nt, Artificial Sequence
  MKO10013024_A_Cypt9
  gRNA
accauaccucgacagagacc

SEQ ID NO: 13025 - RNA, 20 nt, Artificial Sequence
  MKO10013025_A_Cypt9
  gRNA
uccaaagguucagucgguuc

SEQ ID NO: 13026 - RNA, 20 nt, Artificial Sequence
  MKO10013026_A_Cypt9
  gRNA
ucgauugaugcgaagucaaa

SEQ ID NO: 13027 - RNA, 20 nt, Artificial Sequence
  MKO10013027_A_Cyr61
  gRNA
uacugcggcuccugcguaga

SEQ ID NO: 13028 - RNA, 20 nt, Artificial Sequence
  MKO10013028_A_Cyr61
  gRNA
cccgacucccggggcgcacu

SEQ ID NO: 13029 - RNA, 20 nt, Artificial Sequence
  MKO10013029_A_Cyr61
  gRNA
gcagcaccggccaucuacgc

SEQ ID NO: 13030 - RNA, 20 nt, Artificial Sequence
  MKO10013030_A_Cys1
  gRNA
uacucaccgcgggugcgagc

SEQ ID NO: 13031 - RNA, 20 nt, Artificial Sequence
  MKO10013031_A_Cys1
  gRNA
ugcgucgccgccucgggauc

SEQ ID NO: 13032 - RNA, 20 nt, Artificial Sequence
  MKO10013032_A_Cys1
  gRNA
agcucauggcgagcauugag

SEQ ID NO: 13033 - RNA, 20 nt, Artificial Sequence
  MKO10013033_A_Cysltr1
  gRNA
auaguucguugaauaugaua

SEQ ID NO: 13034 - RNA, 20 nt, Artificial Sequence
  MKO10013034_A_Cysltr1
  gRNA
uccaguccagaacauuaauu

SEQ ID NO: 13035 - RNA, 20 nt, Artificial Sequence
  MKO10013035_A_Cysltr1
  gRNA
auugcagaaauguaccucca

SEQ ID NO: 13036 - RNA, 20 nt, Artificial Sequence
  MKO10013036_A_Cysltr2
  gRNA
agccuaccgcuacugcaaug

SEQ ID NO: 13037 - RNA, 20 nt, Artificial Sequence
  MKO10013037_A_Cysltr2
  gRNA
aggguccgcagugcauggua

SEQ ID NO: 13038 - RNA, 20 nt, Artificial Sequence
  MKO10013038_A_Cysltr2
  gRNA
caugaaccacauugcaguag

SEQ ID NO: 13039 - RNA, 20 nt, Artificial Sequence
  MKO10013039_A_Cystm1
  gRNA
agagaacccuccaccguauc

SEQ ID NO: 13040 - RNA, 20 nt, Artificial Sequence
  MKO10013040_A_Cystm1
  gRNA
ccuugauagggguaccccug

SEQ ID NO: 13041 - RNA, 20 nt, Artificial Sequence
  MKO10013041_A_Cystm1
  gRNA
ugccgggugucaggcagucc

SEQ ID NO: 13042 - RNA, 20 nt, Artificial Sequence
  MKO10013042_A_Cyth1
  gRNA
gaacauccggcggaggaagc

SEQ ID NO: 13043 - RNA, 20 nt, Artificial Sequence
  MKO10013043_A_Cyth1
  gRNA
auccaguucuuaaucgagaa

SEQ ID NO: 13044 - RNA, 20 nt, Artificial Sequence
  MKO10013044_A_Cyth1
  gRNA
ugagccccuccccuuuauac

SEQ ID NO: 13045 - RNA, 20 nt, Artificial Sequence
  MKO10013045_A_Cyth2
  gRNA
gcuaagugaagcuaugagcg

SEQ ID NO: 13046 - RNA, 20 nt, Artificial Sequence
  MKO10013046_A_Cyth2
  gRNA
aauugcccgcuuccuguaca

SEQ ID NO: 13047 - RNA, 20 nt, Artificial Sequence
  MKO10013047_A_Cyth2
  gRNA
uccaacuccaugcgcuccuc

SEQ ID NO: 13048 - RNA, 20 nt, Artificial Sequence
  MKO10013048_A_Cyth3
  gRNA
cuccgaugacggucuuguuc

SEQ ID NO: 13049 - RNA, 20 nt, Artificial Sequence
  MKO10013049_A_Cyth3
  gRNA
ggccugaacaagaccgucau

SEQ ID NO: 13050 - RNA, 20 nt, Artificial Sequence
  MKO10013050_A_Cyth3
  gRNA
caagcacucaccuuaaggcc

SEQ ID NO: 13051 - RNA, 20 nt, Artificial Sequence
  MKO10013051_A_Cyth4
  gRNA
ugagaccgucacccuuguac

SEQ ID NO: 13052 - RNA, 20 nt, Artificial Sequence
  MKO10013052_A_Cyth4
  gRNA
cgacugcuuugaaagcaccg

SEQ ID NO: 13053 - RNA, 20 nt, Artificial Sequence
  MKO10013053_A_Cyth4
  gRNA
ugcuuucaaagcagucgauu

SEQ ID NO: 13054 - RNA, 20 nt, Artificial Sequence
  MKO10013054_A_Cytip
  gRNA
gacagccccgcucacugugc

SEQ ID NO: 13055 - RNA, 20 nt, Artificial Sequence
  MKO10013055_A_Cytip
  gRNA
guuggccagaucaagcucuu

SEQ ID NO: 13056 - RNA, 20 nt, Artificial Sequence
  MKO10013056_A_Cytip
  gRNA
aucacccaaagagcuugauc

SEQ ID NO: 13057 - RNA, 20 nt, Artificial Sequence
  MKO10013057_A_Cytl1
  gRNA
cuuagaagacccaauucccg

SEQ ID NO: 13058 - RNA, 20 nt, Artificial Sequence
  MKO10013058_A_Cytl1
  gRNA
ggacccguggccucgggaau

SEQ ID NO: 13059 - RNA, 20 nt, Artificial Sequence
  MKO10013059_A_Cytl1
  gRNA
ggcgcggacuguacugccag

SEQ ID NO: 13060 - RNA, 20 nt, Artificial Sequence
  MKO10013060_A_Cyyr1
  gRNA
cugcucugaugacccccacg

SEQ ID NO: 13061 - RNA, 20 nt, Artificial Sequence
  MKO10013061_A_Cyyr1
  gRNA
cugugcgauauuccaucucg

SEQ ID NO: 13062 - RNA, 20 nt, Artificial Sequence
  MKO10013062_A_Cyyr1
  gRNA
cucaggggcacggcgauugc

SEQ ID NO: 13063 - RNA, 20 nt, Artificial Sequence
  MKO10013063_A_D030056L22Rik
  gRNA
ucugcgccccgcaagcgacg

SEQ ID NO: 13064 - RNA, 20 nt, Artificial Sequence
  MKO10013064_A_D030056L22Rik
  gRNA
cggcgacagaguagaaagcg

SEQ ID NO: 13065 - RNA, 20 nt, Artificial Sequence
  MKO10013065_A_D030056L22Rik
  gRNA
ucaagagcugccagaucaag

SEQ ID NO: 13066 - RNA, 20 nt, Artificial Sequence
  MKO10013066_A_D10Bwg1379e
  gRNA
accccgacauuugacaugaa

SEQ ID NO: 13067 - RNA, 20 nt, Artificial Sequence
  MKO10013067_A_D10Bwg1379e
  gRNA
ugccguucugaagaucgcag

SEQ ID NO: 13068 - RNA, 20 nt, Artificial Sequence
  MKO10013068_A_D10Bwg1379e
  gRNA
agugacaccgucacucaaug

SEQ ID NO: 13069 - RNA, 20 nt, Artificial Sequence
  MKO10013069_A_D10Jhu81e
  gRNA
ugacggaaccgagauccaug

SEQ ID NO: 13070 - RNA, 20 nt, Artificial Sequence
  MKO10013070_A_D10Jhu81e
  gRNA
cggcaggagcacauucgccg

SEQ ID NO: 13071 - RNA, 20 nt, Artificial Sequence
  MKO10013071_A_D10Jhu81e
  gRNA
gcacgugauugaccacacca

SEQ ID NO: 13072 - RNA, 20 nt, Artificial Sequence
  MKO10013072_A_D10Wsu102e
  gRNA
gaaaacaucgacgagacguc

SEQ ID NO: 13073 - RNA, 20 nt, Artificial Sequence
  MKO10013073_A_D10Wsu102e
  gRNA
auuaagcuuccgaaugcaga

SEQ ID NO: 13074 - RNA, 20 nt, Artificial Sequence
  MKO10013074_A_D10Wsu102e
  gRNA
guucucgauggugacuucag

SEQ ID NO: 13075 - RNA, 20 nt, Artificial Sequence
  MKO10013075_A_D11Wsu47e
  gRNA
gacgaaguucggcugauagc

SEQ ID NO: 13076 - RNA, 20 nt, Artificial Sequence
  MKO10013076_A_D11Wsu47e
  gRNA
aacguguucaugccggaguc

SEQ ID NO: 13077 - RNA, 20 nt, Artificial Sequence
  MKO10013077_A_D11Wsu47e
  gRNA
ggcuggaaguuguaagcguc

SEQ ID NO: 13078 - RNA, 20 nt, Artificial Sequence
  MKO10013078_A_D130040H23Rik
  gRNA
uaugaauuauguaagcaaua

SEQ ID NO: 13079 - RNA, 20 nt, Artificial Sequence
  MKO10013079_A_D130040H23Rik
  gRNA
auauucuacagaauauaauc

SEQ ID NO: 13080 - RNA, 20 nt, Artificial Sequence
  MKO10013080_A_D130040H23Rik
  gRNA
aaaauucuagaauacauaga

SEQ ID NO: 13081 - RNA, 20 nt, Artificial Sequence
  MKO10013081_A_D130043K22Rik
  gRNA
gggaccaagucgacucauuc

SEQ ID NO: 13082 - RNA, 20 nt, Artificial Sequence
  MKO10013082_A_D130043K22Rik
  gRNA
gcucggagaauugcgagccc

SEQ ID NO: 13083 - RNA, 20 nt, Artificial Sequence
  MKO10013083_A_D130043K22Rik
  gRNA
uaaccuaguacuaaccuuac

SEQ ID NO: 13084 - RNA, 20 nt, Artificial Sequence
  MKO10013084_A_D14Abb1e
  gRNA
ucuucaaauucucgagaccc

SEQ ID NO: 13085 - RNA, 20 nt, Artificial Sequence
  MKO10013085_A_D14Abb1e
  gRNA
ucucuuacaggcuaauccuu

SEQ ID NO: 13086 - RNA, 20 nt, Artificial Sequence
  MKO10013086_A_D14Abb1e
  gRNA
acugccaagaacuguuauuu

SEQ ID NO: 13087 - RNA, 20 nt, Artificial Sequence
  MKO10013087_A_D15Ertd621e
  gRNA
cuuucaggucugcgacuucu

SEQ ID NO: 13088 - RNA, 20 nt, Artificial Sequence
  MKO10013088_A_D15Ertd621e
  gRNA
uuaccacuuauccgacauca

SEQ ID NO: 13089 - RNA, 20 nt, Artificial Sequence
  MKO10013089_A_D15Ertd621e
  gRNA
accccauucucauacuaugc

SEQ ID NO: 13090 - RNA, 20 nt, Artificial Sequence
  MKO10013090_A_D16Ertd472e
  gRNA
cuuuaccuuggauucgcugu

SEQ ID NO: 13091 - RNA, 20 nt, Artificial Sequence
  MKO10013091_A_D16Ertd472e
  gRNA
agagcuccauguccgucacg

SEQ ID NO: 13092 - RNA, 20 nt, Artificial Sequence
  MKO10013092_A_D16Ertd472e
  gRNA
guugcucgauagccacguga

SEQ ID NO: 13093 - RNA, 20 nt, Artificial Sequence
  MKO10013093_A_D17H6S53E
  gRNA
gccagccaccaagccgucga

SEQ ID NO: 13094 - RNA, 20 nt, Artificial Sequence
  MKO10013094_A_D17H6S53E
  gRNA
aggcagucuugucccgcuug

SEQ ID NO: 13095 - RNA, 20 nt, Artificial Sequence
  MKO10013095_A_D17H6S53E
  gRNA
gggccauucccaaacuagac

SEQ ID NO: 13096 - RNA, 20 nt, Artificial Sequence
  MKO10013096_A_D17Wsu104e
  gRNA
uuaccucguuggucccuccu

SEQ ID NO: 13097 - RNA, 20 nt, Artificial Sequence
  MKO10013097_A_D17Wsu104e
  gRNA
acauucaccuacgcuuccca

SEQ ID NO: 13098 - RNA, 20 nt, Artificial Sequence
  MKO10013098_A_D17Wsu104e
  gRNA
agcucaccuccagaugguac

SEQ ID NO: 13099 - RNA, 20 nt, Artificial Sequence
  MKO10013099_A_D17Wsu92e
  gRNA
cgcagccggccggguugagc

SEQ ID NO: 13100 - RNA, 20 nt, Artificial Sequence
  MKO10013100_A_D17Wsu92e
  gRNA
gccgaguagccgcuggaacu

SEQ ID NO: 13101 - RNA, 20 nt, Artificial Sequence
  MKO10013101_A_D17Wsu92e
  gRNA
ugggcucucgaagucauaau

SEQ ID NO: 13102 - RNA, 20 nt, Artificial Sequence
  MKO10013102_A_D19Bwg1357e
  gRNA
gcgcgucgagucaugugcaa

SEQ ID NO: 13103 - RNA, 20 nt, Artificial Sequence
  MKO10013103_A_D19Bwg1357e
  gRNA
ucgaaccacgaugucauagu

SEQ ID NO: 13104 - RNA, 20 nt, Artificial Sequence
  MKO10013104_A_D19Bwg1357e
  gRNA
uaacaauaccuugcaacucu

SEQ ID NO: 13105 - RNA, 20 nt, Artificial Sequence
  MKO10013105_A_D19Ertd737e
  gRNA
uuaccucucgaguagccagc

SEQ ID NO: 13106 - RNA, 20 nt, Artificial Sequence
  MKO10013106_A_D19Ertd737e
  gRNA
uguagucaggccuugagaag

SEQ ID NO: 13107 - RNA, 20 nt, Artificial Sequence
  MKO10013107_A_D19Ertd737e
  gRNA
acugaguaagcucuucccac

SEQ ID NO: 13108 - RNA, 20 nt, Artificial Sequence
  MKO10013108_A_D1Ertd622e
  gRNA
guccagcuguuuagcgcgca

SEQ ID NO: 13109 - RNA, 20 nt, Artificial Sequence
  MKO10013109_A_D1Ertd622e
  gRNA
cgccuugcgcgcuaaacagc

SEQ ID NO: 13110 - RNA, 20 nt, Artificial Sequence
  MKO10013110_A_D1Ertd622e
  gRNA
ccaaguaguuagaguccaug

SEQ ID NO: 13111 - RNA, 20 nt, Artificial Sequence
  MKO10013111_A_D1Pas1
  gRNA
acuuggcucucgugucgcug

SEQ ID NO: 13112 - RNA, 20 nt, Artificial Sequence
  MKO10013112_A_D1Pas1
  gRNA
uuugucguagaacgccuucg

SEQ ID NO: 13113 - RNA, 20 nt, Artificial Sequence
  MKO10013113_A_D1Pas1
  gRNA
uccuguuccaagcguucgcu

SEQ ID NO: 13114 - RNA, 20 nt, Artificial Sequence
  MKO10013114_A_D230025D16Rik
  gRNA
ucgcaucaucagaaacgucc

SEQ ID NO: 13115 - RNA, 20 nt, Artificial Sequence
  MKO10013115_A_D230025D16Rik
  gRNA
gugugaucccguccugaguc

SEQ ID NO: 13116 - RNA, 20 nt, Artificial Sequence
  MKO10013116_A_D230025D16Rik
  gRNA
ccucauccuuaaccugacuc

SEQ ID NO: 13117 - RNA, 20 nt, Artificial Sequence
  MKO10013117_A_D2Wsu81e
  gRNA
ggcccgcauccuacaguacc

SEQ ID NO: 13118 - RNA, 20 nt, Artificial Sequence
  MKO10013118_A_D2Wsu81e
  gRNA
accugagcuccgcaccuacc

SEQ ID NO: 13119 - RNA, 20 nt, Artificial Sequence
  MKO10013119_A_D2Wsu81e
  gRNA
ugagauugugguguucgaug

SEQ ID NO: 13120 - RNA, 20 nt, Artificial Sequence
  MKO10013120_A_D2hgdh
  gRNA
ucuugccagguacucgcuga

SEQ ID NO: 13121 - RNA, 20 nt, Artificial Sequence
  MKO10013121_A_D2hgdh
  gRNA
acccaaugaacaucugcuuc

SEQ ID NO: 13122 - RNA, 20 nt, Artificial Sequence
  MKO10013122_A_D2hgdh
  gRNA
aucagcuuucaugauguauc

SEQ ID NO: 13123 - RNA, 20 nt, Artificial Sequence
  MKO10013123_A_D330045A20Rik
  gRNA
aaaucaaaacugcgauacua

SEQ ID NO: 13124 - RNA, 20 nt, Artificial Sequence
  MKO10013124_A_D330045A20Rik
  gRNA
uaauuaaccgauucaucaca

SEQ ID NO: 13125 - RNA, 20 nt, Artificial Sequence
  MKO10013125_A_D330045A20Rik
  gRNA
ccguugcacccucccuacaa

SEQ ID NO: 13126 - RNA, 20 nt, Artificial Sequence
  MKO10013126_A_D3Bwg0562e
  gRNA
ucacccgcaguugccuauau

SEQ ID NO: 13127 - RNA, 20 nt, Artificial Sequence
  MKO10013127_A_D3Bwg0562e
  gRNA
caaagaaaacuccuacaucg

SEQ ID NO: 13128 - RNA, 20 nt, Artificial Sequence
  MKO10013128_A_D3Bwg0562e
  gRNA
uuggagccuaacaucaacgc

SEQ ID NO: 13129 - RNA, 20 nt, Artificial Sequence
  MKO10013129_A_D3Ertd254e
  gRNA
auuccccguauauagcuuac

SEQ ID NO: 13130 - RNA, 20 nt, Artificial Sequence
  MKO10013130_A_D3Ertd254e
  gRNA
gaacaccagugcaccucauu

SEQ ID NO: 13131 - RNA, 20 nt, Artificial Sequence
  MKO10013131_A_D3Ertd254e
  gRNA
uccgcguagucaagccacaa

SEQ ID NO: 13132 - RNA, 20 nt, Artificial Sequence
  MKO10013132_A_D3Ertd751e
  gRNA
uuauuagauuaccacagguc

SEQ ID NO: 13133 - RNA, 20 nt, Artificial Sequence
  MKO10013133_A_D3Ertd751e
  gRNA
cuuuccugguucuccgagag

SEQ ID NO: 13134 - RNA, 20 nt, Artificial Sequence
  MKO10013134_A_D3Ertd751e
  gRNA
ggcagccagaaccagaccug

SEQ ID NO: 13135 - RNA, 20 nt, Artificial Sequence
  MKO10013135_A_D430019H16Rik
  gRNA
cguggccguuggacgucgag

SEQ ID NO: 13136 - RNA, 20 nt, Artificial Sequence
  MKO10013136_A_D430019H16Rik
  gRNA
aauguccacucgacguccaa

SEQ ID NO: 13137 - RNA, 20 nt, Artificial Sequence
  MKO10013137_A_D430019H16Rik
  gRNA
ggccauaaaagacagaucca

SEQ ID NO: 13138 - RNA, 20 nt, Artificial Sequence
  MKO10013138_A_D430041D05Rik
  gRNA
cgugagcggagacgucguuc

SEQ ID NO: 13139 - RNA, 20 nt, Artificial Sequence
  MKO10013139_A_D430041D05Rik
  gRNA
ggccuuuacugaugccguca

SEQ ID NO: 13140 - RNA, 20 nt, Artificial Sequence
  MKO10013140_A_D430041D05Rik
  gRNA
aaguggacauagcgccuccc

SEQ ID NO: 13141 - RNA, 20 nt, Artificial Sequence
  MKO10013141_A_D430042O09Rik
  gRNA
ccaggaaaaguccagcgccg

SEQ ID NO: 13142 - RNA, 20 nt, Artificial Sequence
  MKO10013142_A_D430042O09Rik
  gRNA
ugaugucuucagcuccgagu

SEQ ID NO: 13143 - RNA, 20 nt, Artificial Sequence
  MKO10013143_A_D430042O09Rik
  gRNA
aagucuuaagacgcagcucc

SEQ ID NO: 13144 - RNA, 20 nt, Artificial Sequence
  MKO10013144_A_D4Wsu53e
  gRNA
ucguacuacgcgaucacuag

SEQ ID NO: 13145 - RNA, 20 nt, Artificial Sequence
  MKO10013145_A_D4Wsu53e
  gRNA
ggcgcuacuacggcuucggc

SEQ ID NO: 13146 - RNA, 20 nt, Artificial Sequence
  MKO10013146_A_D4Wsu53e
  gRNA
acagguauccacaguccgua

SEQ ID NO: 13147 - RNA, 20 nt, Artificial Sequence
  MKO10013147_A_D5Ertd577e
  gRNA
uccaucuagcagagcuugca

SEQ ID NO: 13148 - RNA, 20 nt, Artificial Sequence
  MKO10013148_A_D5Ertd577e
  gRNA
ccacacuccagaagcuagca

SEQ ID NO: 13149 - RNA, 20 nt, Artificial Sequence
  MKO10013149_A_D5Ertd577e
  gRNA
cuuacccuaguaucugaugc

SEQ ID NO: 13150 - RNA, 20 nt, Artificial Sequence
  MKO10013150_A_D5Ertd579e
  gRNA
gaaguguucugaucuaacgc

SEQ ID NO: 13151 - RNA, 20 nt, Artificial Sequence
  MKO10013151_A_D5Ertd579e
  gRNA
gcucaccuugcucgcucugu

SEQ ID NO: 13152 - RNA, 20 nt, Artificial Sequence
  MKO10013152_A_D5Ertd579e
  gRNA
aaagaccuacagagcgagca

SEQ ID NO: 13153 - RNA, 20 nt, Artificial Sequence
  MKO10013153_A_D630003M21Rik
  gRNA
caauccacuccugcuacguc

SEQ ID NO: 13154 - RNA, 20 nt, Artificial Sequence
  MKO10013154_A_D630003M21Rik
  gRNA
ggaaggaggcguucuuauug

SEQ ID NO: 13155 - RNA, 20 nt, Artificial Sequence
  MKO10013155_A_D630003M21Rik
  gRNA
caguccaucuccccggaagu

SEQ ID NO: 13156 - RNA, 20 nt, Artificial Sequence
  MKO10013156_A_D630023F18Rik
  gRNA
ggaaucgcaccagcgugacu

SEQ ID NO: 13157 - RNA, 20 nt, Artificial Sequence
  MKO10013157_A_D630023F18Rik
  gRNA
augaucuuaucaucauacgc

SEQ ID NO: 13158 - RNA, 20 nt, Artificial Sequence
  MKO10013158_A_D630023F18Rik
  gRNA
uacgcaggucugacaugaag

SEQ ID NO: 13159 - RNA, 20 nt, Artificial Sequence
  MKO10013159_A_D630033O11Rik
  gRNA
acuuggaccaacauucaacc

SEQ ID NO: 13160 - RNA, 20 nt, Artificial Sequence
  MKO10013160_A_D630033O11Rik
  gRNA
ccucauucgcaugacuggaa

SEQ ID NO: 13161 - RNA, 20 nt, Artificial Sequence
  MKO10013161_A_D630033O11Rik
  gRNA
aagaggugacaccgaugccg

SEQ ID NO: 13162 - RNA, 20 nt, Artificial Sequence
  MKO10013162_A_D630039A03Rik
  gRNA
cgauucagccggaguaggca

SEQ ID NO: 13163 - RNA, 20 nt, Artificial Sequence
  MKO10013163_A_D630039A03Rik
  gRNA
uucucccggaugcggaugaa

SEQ ID NO: 13164 - RNA, 20 nt, Artificial Sequence
  MKO10013164_A_D630039A03Rik
  gRNA
auacuuagagcugcaucgcu

SEQ ID NO: 13165 - RNA, 20 nt, Artificial Sequence
  MKO10013165_A_D630045J12Rik
  gRNA
ucgacucugacaccuuccga

SEQ ID NO: 13166 - RNA, 20 nt, Artificial Sequence
  MKO10013166_A_D630045J12Rik
  gRNA
cucggugugauauaccgcau

SEQ ID NO: 13167 - RNA, 20 nt, Artificial Sequence
  MKO10013167_A_D630045J12Rik
  gRNA
gugccuccgagugucgauac

SEQ ID NO: 13168 - RNA, 20 nt, Artificial Sequence
  MKO10013168_A_D6Ertd527e
  gRNA
ggccccagacccaguaaaac

SEQ ID NO: 13169 - RNA, 20 nt, Artificial Sequence
  MKO10013169_A_D6Ertd527e
  gRNA
guugcugauguugccacuag

SEQ ID NO: 13170 - RNA, 20 nt, Artificial Sequence
  MKO10013170_A_D6Ertd527e
  gRNA
gcagccacagucgcacacca

SEQ ID NO: 13171 - RNA, 20 nt, Artificial Sequence
  MKO10013171_A_D6Wsu163e
  gRNA
gcaaagucuucgucccaguc

SEQ ID NO: 13172 - RNA, 20 nt, Artificial Sequence
  MKO10013172_A_D6Wsu163e
  gRNA
ucuuaccucagcguaagcuu

SEQ ID NO: 13173 - RNA, 20 nt, Artificial Sequence
  MKO10013173_A_D6Wsu163e
  gRNA
agcugaaaaaguuacgagag

SEQ ID NO: 13174 - RNA, 20 nt, Artificial Sequence
  MKO10013174_A_D730048I06Rik
  gRNA
cggaucauacacguuucacc

SEQ ID NO: 13175 - RNA, 20 nt, Artificial Sequence
  MKO10013175_A_D730048I06Rik
  gRNA
cguguaugauccgcagaacc

SEQ ID NO: 13176 - RNA, 20 nt, Artificial Sequence
  MKO10013176_A_D730048I06Rik
  gRNA
auuaugcuaagucaucacga

SEQ ID NO: 13177 - RNA, 20 nt, Artificial Sequence
  MKO10013177_A_D7Ertd443e
  gRNA
caugcucacuccaucgcgcc

SEQ ID NO: 13178 - RNA, 20 nt, Artificial Sequence
  MKO10013178_A_D7Ertd443e
  gRNA
caccauuacugcccgacgug

SEQ ID NO: 13179 - RNA, 20 nt, Artificial Sequence
  MKO10013179_A_D7Ertd443e
  gRNA
agauuacacgugcugugacu

SEQ ID NO: 13180 - RNA, 20 nt, Artificial Sequence
  MKO10013180_A_D830030K20Rik
  gRNA
ccucauauauguaaaguucc

SEQ ID NO: 13181 - RNA, 20 nt, Artificial Sequence
  MKO10013181_A_D830030K20Rik
  gRNA
gaggaagaucagcaaugaca

SEQ ID NO: 13182 - RNA, 20 nt, Artificial Sequence
  MKO10013182_A_D830030K20Rik
  gRNA
guuaucuucuaucaguuccu

SEQ ID NO: 13183 - RNA, 20 nt, Artificial Sequence
  MKO10013183_A_D830031N03Rik
  gRNA
guaucguauauagaccgcug

SEQ ID NO: 13184 - RNA, 20 nt, Artificial Sequence
  MKO10013184_A_D830031N03Rik
  gRNA
uugucaugcagcccacgacg

SEQ ID NO: 13185 - RNA, 20 nt, Artificial Sequence
  MKO10013185_A_D830031N03Rik
  gRNA
ccgcaaaacaaggcgagugg

SEQ ID NO: 13186 - RNA, 20 nt, Artificial Sequence
  MKO10013186_A_D8Ertd738e
  gRNA
cugaacaacgcgcgccuucu

SEQ ID NO: 13187 - RNA, 20 nt, Artificial Sequence
  MKO10013187_A_D8Ertd738e
  gRNA
ucgagucaucgcucccaaga

SEQ ID NO: 13188 - RNA, 20 nt, Artificial Sequence
  MKO10013188_A_D8Ertd738e
  gRNA
cauuccuuaccgccuuuccg

SEQ ID NO: 13189 - RNA, 20 nt, Artificial Sequence
  MKO10013189_A_D8Ertd82e
  gRNA
cccaucaagcgcauccgcau

SEQ ID NO: 13190 - RNA, 20 nt, Artificial Sequence
  MKO10013190_A_D8Ertd82e
  gRNA
agccugagguuuacgagcgc

SEQ ID NO: 13191 - RNA, 20 nt, Artificial Sequence
  MKO10013191_A_D8Ertd82e
  gRNA
gccacgugggccuucgaacc

SEQ ID NO: 13192 - RNA, 20 nt, Artificial Sequence
  MKO10013192_A_D930015E06Rik
  gRNA
gcauagagaagcuucgccgc

SEQ ID NO: 13193 - RNA, 20 nt, Artificial Sequence
  MKO10013193_A_D930015E06Rik
  gRNA
guuugagcccuugccgaacg

SEQ ID NO: 13194 - RNA, 20 nt, Artificial Sequence
  MKO10013194_A_D930015E06Rik
  gRNA
ugccacagcuccaccacguu

SEQ ID NO: 13195 - RNA, 20 nt, Artificial Sequence
  MKO10013195_A_D930020B18Rik
  gRNA
aauagacaauccgaaugugc

SEQ ID NO: 13196 - RNA, 20 nt, Artificial Sequence
  MKO10013196_A_D930020B18Rik
  gRNA
cgcggaaaaucgaaaggggu

SEQ ID NO: 13197 - RNA, 20 nt, Artificial Sequence
  MKO10013197_A_D930020B18Rik
  gRNA
aguuguuccacgagcucuuu

SEQ ID NO: 13198 - RNA, 20 nt, Artificial Sequence
  MKO10013198_A_DXBay18
  gRNA
agccaggcacauccaagcuc

SEQ ID NO: 13199 - RNA, 20 nt, Artificial Sequence
  MKO10013199_A_DXBay18
  gRNA
gaccccaaagccagacucaa

SEQ ID NO: 13200 - RNA, 20 nt, Artificial Sequence
  MKO10013200_A_DXBay18
  gRNA
uugggguccccgggccagga

SEQ ID NO: 13201 - RNA, 20 nt, Artificial Sequence
  MKO10013201_A_Daam1
  gRNA
cuggaagcggguucucucgc

SEQ ID NO: 13202 - RNA, 20 nt, Artificial Sequence
  MKO10013202_A_Daam1
  gRNA
gguguguauccgagacucag

SEQ ID NO: 13203 - RNA, 20 nt, Artificial Sequence
  MKO10013203_A_Daam1
  gRNA
cauugaucagcucaauucca

SEQ ID NO: 13204 - RNA, 20 nt, Artificial Sequence
  MKO10013204_A_Daam2
  gRNA
ugugacccgcuucaucgauc

SEQ ID NO: 13205 - RNA, 20 nt, Artificial Sequence
  MKO10013205_A_Daam2
  gRNA
auacgccugauaguguagca

SEQ ID NO: 13206 - RNA, 20 nt, Artificial Sequence
  MKO10013206_A_Daam2
  gRNA
auacgaucaauguaguacuc

SEQ ID NO: 13207 - RNA, 20 nt, Artificial Sequence
  MKO10013207_A_Dab1
  gRNA
uaacuugucuccccgagcug

SEQ ID NO: 13208 - RNA, 20 nt, Artificial Sequence
  MKO10013208_A_Dab1
  gRNA
ugaaauuuccuacauugcga

SEQ ID NO: 13209 - RNA, 20 nt, Artificial Sequence
  MKO10013209_A_Dab1
  gRNA
cgguacaaagccaagcugau

SEQ ID NO: 13210 - RNA, 20 nt, Artificial Sequence
  MKO10013210_A_Dab2ip
  gRNA
ugggcccaugauccgaauca

SEQ ID NO: 13211 - RNA, 20 nt, Artificial Sequence
  MKO10013211_A_Dab2ip
  gRNA
cagccgcugagcgcgauaag

SEQ ID NO: 13212 - RNA, 20 nt, Artificial Sequence
  MKO10013212_A_Dab2ip
  gRNA
cacuaccuagugcguccugc

SEQ ID NO: 13213 - RNA, 20 nt, Artificial Sequence
  MKO10013213_A_Dab2
  gRNA
uucggggcagccuguugguc

SEQ ID NO: 13214 - RNA, 20 nt, Artificial Sequence
  MKO10013214_A_Dab2
  gRNA
cccgaaagcgccaucaaaga

SEQ ID NO: 13215 - RNA, 20 nt, Artificial Sequence
  MKO10013215_A_Dab2
  gRNA
aucaucaauaccgauuagcu

SEQ ID NO: 13216 - RNA, 20 nt, Artificial Sequence
  MKO10013216_A_Dach1
  gRNA
agacgacgccggggguccga

SEQ ID NO: 13217 - RNA, 20 nt, Artificial Sequence
  MKO10013217_A_Dach1
  gRNA
agccggagacgaggucgccg

SEQ ID NO: 13218 - RNA, 20 nt, Artificial Sequence
  MKO10013218_A_Dach1
  gRNA
ugccgccgccauauuugcaa

SEQ ID NO: 13219 - RNA, 20 nt, Artificial Sequence
  MKO10013219_A_Dach2
  gRNA
uauacguacgauugcuuagc

SEQ ID NO: 13220 - RNA, 20 nt, Artificial Sequence
  MKO10013220_A_Dach2
  gRNA
cgucccgggggguuuauucc

SEQ ID NO: 13221 - RNA, 20 nt, Artificial Sequence
  MKO10013221_A_Dach2
  gRNA
gaugaccuuaauucuacgac

SEQ ID NO: 13222 - RNA, 20 nt, Artificial Sequence
  MKO10013222_A_Dacu1
  gRNA
gcggccaucgggcggguagc

SEQ ID NO: 13223 - RNA, 20 nt, Artificial Sequence
  MKO10013223_A_Dacu1
  gRNA
gggaccgucgcgccgcgcuc

SEQ ID NO: 13224 - RNA, 20 nt, Artificial Sequence
  MKO10013224_A_Dacu1
  gRNA
ggggccgugaccguuugaau

SEQ ID NO: 13225 - RNA, 20 nt, Artificial Sequence
  MKO10013225_A_Dacu2
  gRNA
aggcggcgcugaccgcgcua

SEQ ID NO: 13226 - RNA, 20 nt, Artificial Sequence
  MKO10013226_A_Dacu2
  gRNA
guagucgcgcgcccacccug

SEQ ID NO: 13227 - RNA, 20 nt, Artificial Sequence
  MKO10013227_A_Dacu2
  gRNA
ccccacguaccagcgugacc

SEQ ID NO: 13228 - RNA, 20 nt, Artificial Sequence
  MKO10013228_A_Dacu3
  gRNA
cugcgcaaccguacaacagc

SEQ ID NO: 13229 - RNA, 20 nt, Artificial Sequence
  MKO10013229_A_Dacu3
  gRNA
acacugcgaccucgcguaag

SEQ ID NO: 13230 - RNA, 20 nt, Artificial Sequence
  MKO10013230_A_Dacu3
  gRNA
cgagggacccaggcguccau

SEQ ID NO: 13231 - RNA, 20 nt, Artificial Sequence
  MKO10013231_A_Dad1
  gRNA
guucgucaugucggcgucug

SEQ ID NO: 13232 - RNA, 20 nt, Artificial Sequence
  MKO10013232_A_Dad1
  gRNA
cuugucgucaugaacuucgu

SEQ ID NO: 13233 - RNA, 20 nt, Artificial Sequence
  MKO10013233_A_Dad1
  gRNA
guagccgaacugcagcgccc

SEQ ID NO: 13234 - RNA, 20 nt, Artificial Sequence
  MKO10013234_A_Daf2
  gRNA
cgaaaacaaccuucacucuc

SEQ ID NO: 13235 - RNA, 20 nt, Artificial Sequence
  MKO10013235_A_Daf2
  gRNA
uauaauaguacauaaaauag

SEQ ID NO: 13236 - RNA, 20 nt, Artificial Sequence
  MKO10013236_A_Daf2
  gRNA
ggaaacauaccugugcacac

SEQ ID NO: 13237 - RNA, 20 nt, Artificial Sequence
  MKO10013237_A_Dag1
  gRNA
acggucaccauucggacgcg

SEQ ID NO: 13238 - RNA, 20 nt, Artificial Sequence
  MKO10013238_A_Dag1
  gRNA
cgaauccguacuaccaccag

SEQ ID NO: 13239 - RNA, 20 nt, Artificial Sequence
  MKO10013239_A_Dag1
  gRNA
ccgacaacagccguaccguc

SEQ ID NO: 13240 - RNA, 20 nt, Artificial Sequence
  MKO10013240_A_Dagla
  gRNA
ugaguucaucuacgcuaucg

SEQ ID NO: 13241 - RNA, 20 nt, Artificial Sequence
  MKO10013241_A_Dagla
  gRNA
guacgugcucuacgugcgcc

SEQ ID NO: 13242 - RNA, 20 nt, Artificial Sequence
  MKO10013242_A_Dagla
  gRNA
cacguagagcacguacugca

SEQ ID NO: 13243 - RNA, 20 nt, Artificial Sequence
  MKO10013243_A_Daglb
  gRNA
agacggcugcgaagagcgug

SEQ ID NO: 13244 - RNA, 20 nt, Artificial Sequence
  MKO10013244_A_Daglb
  gRNA
cguuguaucucacgcacaga

SEQ ID NO: 13245 - RNA, 20 nt, Artificial Sequence
  MKO10013245_A_Daglb
  gRNA
cgcucuucgcagccgucuuc

SEQ ID NO: 13246 - RNA, 20 nt, Artificial Sequence
  MKO10013246_A_Dak
  gRNA
ggccggguagcacuucuguc

SEQ ID NO: 13247 - RNA, 20 nt, Artificial Sequence
  MKO10013247_A_Dak
  gRNA
agauacucaccggcaugggc

SEQ ID NO: 13248 - RNA, 20 nt, Artificial Sequence
  MKO10013248_A_Dak
  gRNA
augcuaacaggugucaucgc

SEQ ID NO: 13249 - RNA, 20 nt, Artificial Sequence
  MKO10013249_A_Dalrd3
  gRNA
gucggcgcgcagcgcaguac

SEQ ID NO: 13250 - RNA, 20 nt, Artificial Sequence
  MKO10013250_A_Dalrd3
  gRNA
uguaggacaacucgcgggcc

SEQ ID NO: 13251 - RNA, 20 nt, Artificial Sequence
  MKO10013251_A_Dalrd3
  gRNA
ucgcuuccuuagaaccauua

SEQ ID NO: 13252 - RNA, 20 nt, Artificial Sequence
  MKO10013252_A_Dand5
  gRNA
aauccucacccgccgagggg

SEQ ID NO: 13253 - RNA, 20 nt, Artificial Sequence
  MKO10013253_A_Dand5
  gRNA
gauguccagcgcuuucgagc

SEQ ID NO: 13254 - RNA, 20 nt, Artificial Sequence
  MKO10013254_A_Dand5
  gRNA
uagccaguucaccacgcugc

SEQ ID NO: 13255 - RNA, 20 nt, Artificial Sequence
  MKO10013255_A_Dao
  gRNA
agugaagcuuauccaucgga

SEQ ID NO: 13256 - RNA, 20 nt, Artificial Sequence
  MKO10013256_A_Dao
  gRNA
accugccauggcuaacugag

SEQ ID NO: 13257 - RNA, 20 nt, Artificial Sequence
  MKO10013257_A_Dao
  gRNA
gguagcucuuccccucuaga

SEQ ID NO: 13258 - RNA, 20 nt, Artificial Sequence
  MKO10013258_A_Dap3
  gRNA
aguaccugcaucauguaccg

SEQ ID NO: 13259 - RNA, 20 nt, Artificial Sequence
  MKO10013259_A_Dap3
  gRNA
ucaagcgacucagaacaguc

SEQ ID NO: 13260 - RNA, 20 nt, Artificial Sequence
  MKO10013260_A_Dap3
  gRNA
gccuccucgguacaugaugc

SEQ ID NO: 13261 - RNA, 20 nt, Artificial Sequence
  MKO10013261_A_Dapk1
  gRNA
cacgccccgccggcuggacu

SEQ ID NO: 13262 - RNA, 20 nt, Artificial Sequence
  MKO10013262_A_Dapk1
  gRNA
aggaccaaguccagccggcg

SEQ ID NO: 13263 - RNA, 20 nt, Artificial Sequence
  MKO10013263_A_Dapk1
  gRNA
aagucuaugaucuugauccg

SEQ ID NO: 13264 - RNA, 20 nt, Artificial Sequence
  MKO10013264_A_Dapk2
  gRNA
cuaugagaaccgcaccgacg

SEQ ID NO: 13265 - RNA, 20 nt, Artificial Sequence
  MKO10013265_A_Dapk2
  gRNA
cucaaggaugagcaccacgu

SEQ ID NO: 13266 - RNA, 20 nt, Artificial Sequence
  MKO10013266_A_Dapk2
  gRNA
ccucacuuaacgacuccuuc

SEQ ID NO: 13267 - RNA, 20 nt, Artificial Sequence
  MKO10013267_A_Dapk3
  gRNA
aucgcgcacaggaucgaggc

SEQ ID NO: 13268 - RNA, 20 nt, Artificial Sequence
  MKO10013268_A_Dapk3
  gRNA
cgcauuaagcucaucgacuu

SEQ ID NO: 13269 - RNA, 20 nt, Artificial Sequence
  MKO10013269_A_Dapk3
  gRNA
gucaaagugugcgaugcgcu

SEQ ID NO: 13270 - RNA, 20 nt, Artificial Sequence
  MKO10013270_A_Dapl1
  gRNA
guucugccguccccgcugaa

SEQ ID NO: 13271 - RNA, 20 nt, Artificial Sequence
  MKO10013271_A_Dapl1
  gRNA
ugugccgugugaacugucgc

SEQ ID NO: 13272 - RNA, 20 nt, Artificial Sequence
  MKO10013272_A_Dapl1
  gRNA
agccuucuccagagcgggug

SEQ ID NO: 13273 - RNA, 20 nt, Artificial Sequence
  MKO10013273_A_Dapp1
  gRNA
cuugcauuuacgaaucaguc

SEQ ID NO: 13274 - RNA, 20 nt, Artificial Sequence
  MKO10013274_A_Dapp1
  gRNA
gcucauugcugucccgcagc

SEQ ID NO: 13275 - RNA, 20 nt, Artificial Sequence
  MKO10013275_A_Dapp1
  gRNA
cuucggcagcauggcgggug

SEQ ID NO: 13276 - RNA, 20 nt, Artificial Sequence
  MKO10013276_A_Dap
  gRNA
cugcacaauccgcaucccgc

SEQ ID NO: 13277 - RNA, 20 nt, Artificial Sequence
  MKO10013277_A_Dap
  gRNA
aaagcuggacacccgcccgc

SEQ ID NO: 13278 - RNA, 20 nt, Artificial Sequence
  MKO10013278_A_Dap
  gRNA
cugggcgccggucacuugcg

SEQ ID NO: 13279 - RNA, 20 nt, Artificial Sequence
  MKO10013279_A_Darc
  gRNA
aaggucugagaaucgcgaag

SEQ ID NO: 13280 - RNA, 20 nt, Artificial Sequence
  MKO10013280_A_Darc
  gRNA
cucaguuuacuuucgacagc

SEQ ID NO: 13281 - RNA, 20 nt, Artificial Sequence
  MKO10013281_A_Darc
  gRNA
cauggggaacugucuguauc

SEQ ID NO: 13282 - RNA, 20 nt, Artificial Sequence
  MKO10013282_A_Dars2
  gRNA
gaguugcguucgucccacuu

SEQ ID NO: 13283 - RNA, 20 nt, Artificial Sequence
  MKO10013283_A_Dars2
  gRNA
uugauuucaaucucacccgu

SEQ ID NO: 13284 - RNA, 20 nt, Artificial Sequence
  MKO10013284_A_Dars2
  gRNA
ugagaaucugaacaaggccg

SEQ ID NO: 13285 - RNA, 20 nt, Artificial Sequence
  MKO10013285_A_Dars
  gRNA
gccgcguccacgaucucccg

SEQ ID NO: 13286 - RNA, 20 nt, Artificial Sequence
  MKO10013286_A_Dars
  gRNA
cagcaccaacgccagccgua

SEQ ID NO: 13287 - RNA, 20 nt, Artificial Sequence
  MKO10013287_A_Dars
  gRNA
ugcuuguaugaacucuugca

SEQ ID NO: 13288 - RNA, 20 nt, Artificial Sequence
  MKO10013288_A_Daw1
  gRNA
guccgggacgcugugaucag

SEQ ID NO: 13289 - RNA, 20 nt, Artificial Sequence
  MKO10013289_A_Daw1
  gRNA
cauauugccauugaccaacg

SEQ ID NO: 13290 - RNA, 20 nt, Artificial Sequence
  MKO10013290_A_Daw1
  gRNA
gugggacacggcgucuggag

SEQ ID NO: 13291 - RNA, 20 nt, Artificial Sequence
  MKO10013291_A_Daxx
  gRNA
gagcagcgaauuccguaccg

SEQ ID NO: 13292 - RNA, 20 nt, Artificial Sequence
  MKO10013292_A_Daxx
  gRNA
acucacacaaccgcccgaag

SEQ ID NO: 13293 - RNA, 20 nt, Artificial Sequence
  MKO10013293_A_Daxx
  gRNA
gaccucauccagccgguuca

SEQ ID NO: 13294 - RNA, 20 nt, Artificial Sequence
  MKO10013294_A_Dazap1
  gRNA
acagccucacccgauuucgu

SEQ ID NO: 13295 - RNA, 20 nt, Artificial Sequence
  MKO10013295_A_Dazap1
  gRNA
acggggcgccaugaacagcg

SEQ ID NO: 13296 - RNA, 20 nt, Artificial Sequence
  MKO10013296_A_Dazap1
  gRNA
ggaugcagccagagcgaaca

SEQ ID NO: 13297 - RNA, 20 nt, Artificial Sequence
  MKO10013297_A_Dazap2
  gRNA
ugcaguaccucugaauaugc

SEQ ID NO: 13298 - RNA, 20 nt, Artificial Sequence
  MKO10013298_A_Dazap2
  gRNA
cccauggcuuauuauccagu

SEQ ID NO: 13299 - RNA, 20 nt, Artificial Sequence
  MKO10013299_A_Dazap2
  gRNA
gacugcgagcugagcagcgu

SEQ ID NO: 13300 - RNA, 20 nt, Artificial Sequence
  MKO10013300_A_Dazl
  gRNA
aagauaaucacugaucgaac

SEQ ID NO: 13301 - RNA, 20 nt, Artificial Sequence
  MKO10013301_A_Dazl
  gRNA
ugaaacugggcccugcaauc

SEQ ID NO: 13302 - RNA, 20 nt, Artificial Sequence
  MKO10013302_A_Dazl
  gRNA
ucagucugccacaacuucug

SEQ ID NO: 13303 - RNA, 20 nt, Artificial Sequence
  MKO10013303_A_Dbf4
  gRNA
uuacagguauguuugagccg

SEQ ID NO: 13304 - RNA, 20 nt, Artificial Sequence
  MKO10013304_A_Dbf4
  gRNA
ccucauggucucgagguuca

SEQ ID NO: 13305 - RNA, 20 nt, Artificial Sequence
  MKO10013305_A_Dbf4
  gRNA
ccaugaaccucgagaccaug

SEQ ID NO: 13306 - RNA, 20 nt, Artificial Sequence
  MKO10013306_A_Dbh
  gRNA
agucacaggguccguugaac

SEQ ID NO: 13307 - RNA, 20 nt, Artificial Sequence
  MKO10013307_A_Dbh
  gRNA
ccgacaaugagaccacguac

SEQ ID NO: 13308 - RNA, 20 nt, Artificial Sequence
  MKO10013308_A_Dbh
  gRNA
ccccguuuaccaugaugaug

SEQ ID NO: 13309 - RNA, 20 nt, Artificial Sequence
  MKO10013309_A_Dbil5
  gRNA
cagggauguuacagucgccc

SEQ ID NO: 13310 - RNA, 20 nt, Artificial Sequence
  MKO10013310_A_Dbil5
  gRNA
ugguauaccaaugagccaag

SEQ ID NO: 13311 - RNA, 20 nt, Artificial Sequence
  MKO10013311_A_Dbil5
  gRNA
aguuucuccugaucacucac

SEQ ID NO: 13312 - RNA, 20 nt, Artificial Sequence
  MKO10013312_A_Dbi
  gRNA
ugcagaucggccggggcucu

SEQ ID NO: 13313 - RNA, 20 nt, Artificial Sequence
  MKO10013313_A_Dbi
  gRNA
cagauaucccgcagcucuuc

SEQ ID NO: 13314 - RNA, 20 nt, Artificial Sequence
  MKO10013314_A_Dbi
  gRNA
uguaaaacugccacccacgc

SEQ ID NO: 13315 - RNA, 20 nt, Artificial Sequence
  MKO10013315_A_Dbn1
  gRNA
cguacgccgccagcagcucc

SEQ ID NO: 13316 - RNA, 20 nt, Artificial Sequence
  MKO10013316_A_Dbn1
  gRNA
gaccucaagcuugcagcguc

SEQ ID NO: 13317 - RNA, 20 nt, Artificial Sequence
  MKO10013317_A_Dbn1
  gRNA
guggccgcugaagcugacgc

SEQ ID NO: 13318 - RNA, 20 nt, Artificial Sequence
  MKO10013318_A_Dbndd1
  gRNA
gaugcgcugugcccgaagcc

SEQ ID NO: 13319 - RNA, 20 nt, Artificial Sequence
  MKO10013319_A_Dbndd1
  gRNA
acaauugucccuugccgcuc

SEQ ID NO: 13320 - RNA, 20 nt, Artificial Sequence
  MKO10013320_A_Dbndd1
  gRNA
aucgaaguggaccuccagag

SEQ ID NO: 13321 - RNA, 20 nt, Artificial Sequence
  MKO10013321_A_Dbndd2
  gRNA
cauagguagcaucucgucua

SEQ ID NO: 13322 - RNA, 20 nt, Artificial Sequence
  MKO10013322_A_Dbndd2
  gRNA
guuuauugaucuugcggauc

SEQ ID NO: 13323 - RNA, 20 nt, Artificial Sequence
  MKO10013323_A_Dbndd2
  gRNA
gaugugguccugucagacgu

SEQ ID NO: 13324 - RNA, 20 nt, Artificial Sequence
  MKO10013324_A_Dbnl
  gRNA
ccgagaaauccccgaccgac

SEQ ID NO: 13325 - RNA, 20 nt, Artificial Sequence
  MKO10013325_A_Dbnl
  gRNA
uugcugccuaccagucgguc

SEQ ID NO: 13326 - RNA, 20 nt, Artificial Sequence
  MKO10013326_A_Dbnl
  gRNA
aaacuugggcaggccggagu

SEQ ID NO: 13327 - RNA, 20 nt, Artificial Sequence
  MKO10013327_A_Dbpht2
  gRNA
cccgccugucaccacucccc

SEQ ID NO: 13328 - RNA, 20 nt, Artificial Sequence
  MKO10013328_A_Dbpht2
  gRNA
ucuguguguucuucauugcc

SEQ ID NO: 13329 - RNA, 20 nt, Artificial Sequence
  MKO10013329_A_Dbpht2
  gRNA
augaagaacacacagacacu

SEQ ID NO: 13330 - RNA, 20 nt, Artificial Sequence
  MKO10013330_A_Dbp
  gRNA
acguauuccacguccccgaa

SEQ ID NO: 13331 - RNA, 20 nt, Artificial Sequence
  MKO10013331_A_Dbp
  gRNA
gccguuuccaggccgggucc

SEQ ID NO: 13332 - RNA, 20 nt, Artificial Sequence
  MKO10013332_A_Dbp
  gRNA
uggcgcggccucugagcgac

SEQ ID NO: 13333 - RNA, 20 nt, Artificial Sequence
  MKO10013333_A_Dbr1
  gRNA
cauuugcaagaguuacccua

SEQ ID NO: 13334 - RNA, 20 nt, Artificial Sequence
  MKO10013334_A_Dbr1
  gRNA
cauaggguaacucuugcaaa

SEQ ID NO: 13335 - RNA, 20 nt, Artificial Sequence
  MKO10013335_A_Dbr1
  gRNA
agcaccuacagccugcguac

SEQ ID NO: 13336 - RNA, 20 nt, Artificial Sequence
  MKO10013336_A_Dbt
  gRNA
accaucaccagccguuacga

SEQ ID NO: 13337 - RNA, 20 nt, Artificial Sequence
  MKO10013337_A_Dbt
  gRNA
caguucaaacucuccgacau

SEQ ID NO: 13338 - RNA, 20 nt, Artificial Sequence
  MKO10013338_A_Dbt
  gRNA
ucuagaugauaucgcuuaug

SEQ ID NO: 13339 - RNA, 20 nt, Artificial Sequence
  MKO10013339_A_Dbx1
  gRNA
cgcagacccgcgacauuugc

SEQ ID NO: 13340 - RNA, 20 nt, Artificial Sequence
  MKO10013340_A_Dbx1
  gRNA
cucggcagcccccgcuagac

SEQ ID NO: 13341 - RNA, 20 nt, Artificial Sequence
  MKO10013341_A_Dbx1
  gRNA
cugagguccccgagucggcg

SEQ ID NO: 13342 - RNA, 20 nt, Artificial Sequence
  MKO10013342_A_Dbx2
  gRNA
cgcgcagcaaguucucgauc

SEQ ID NO: 13343 - RNA, 20 nt, Artificial Sequence
  MKO10013343_A_Dbx2
  gRNA
aucgagaacuugcugcgcgc

SEQ ID NO: 13344 - RNA, 20 nt, Artificial Sequence
  MKO10013344_A_Dbx2
  gRNA
cuccgcagugcccgucaaua

SEQ ID NO: 13345 - RNA, 20 nt, Artificial Sequence
  MKO10013345_A_Dcaf10
  gRNA
ucucgagccucucaacgaga

SEQ ID NO: 13346 - RNA, 20 nt, Artificial Sequence
  MKO10013346_A_Dcaf10
  gRNA
uaaccuaccuucucguugag

SEQ ID NO: 13347 - RNA, 20 nt, Artificial Sequence
  MKO10013347_A_Dcaf10
  gRNA
auguugaucucaacauccuc

SEQ ID NO: 13348 - RNA, 20 nt, Artificial Sequence
  MKO10013348_A_Dcaf11
  gRNA
guggguuauaucgaucucca

SEQ ID NO: 13349 - RNA, 20 nt, Artificial Sequence
  MKO10013349_A_Dcaf11
  gRNA
ggagaucgauauaacccacc

SEQ ID NO: 13350 - RNA, 20 nt, Artificial Sequence
  MKO10013350_A_Dcaf11
  gRNA
uggaugcgacccccgacacc

SEQ ID NO: 13351 - RNA, 20 nt, Artificial Sequence
  MKO10013351_A_Dcaf12l1
  gRNA
cauggugggcggcgagcggu

SEQ ID NO: 13352 - RNA, 20 nt, Artificial Sequence
  MKO10013352_A_Dcaf12l1
  gRNA
cuaccugaagggccgagcgc

SEQ ID NO: 13353 - RNA, 20 nt, Artificial Sequence
  MKO10013353_A_Dcaf12l1
  gRNA
gaaagccgccgaggucgauc

SEQ ID NO: 13354 - RNA, 20 nt, Artificial Sequence
  MKO10013354_A_Dcaf12l2
  gRNA
ggacgaaugugugaauaccg

SEQ ID NO: 13355 - RNA, 20 nt, Artificial Sequence
  MKO10013355_A_Dcaf12l2
  gRNA
ugcgagugauccggccaguc

SEQ ID NO: 13356 - RNA, 20 nt, Artificial Sequence
  MKO10013356_A_Dcaf12l2
  gRNA
gcagcaauggcccauccgcu

SEQ ID NO: 13357 - RNA, 20 nt, Artificial Sequence
  MKO10013357_A_Dcaf12
  gRNA
accugaagaaccgcgaaguc

SEQ ID NO: 13358 - RNA, 20 nt, Artificial Sequence
  MKO10013358_A_Dcaf12
  gRNA
gccugacuucgcgguucuuc

SEQ ID NO: 13359 - RNA, 20 nt, Artificial Sequence
  MKO10013359_A_Dcaf12
  gRNA
gcccgcaccuugcaguuguc

SEQ ID NO: 13360 - RNA, 20 nt, Artificial Sequence
  MKO10013360_A_Dcaf13
  gRNA
ccgugauggagucaauugcc

SEQ ID NO: 13361 - RNA, 20 nt, Artificial Sequence
  MKO10013361_A_Dcaf13
  gRNA
aaagcucucacauauucucg

SEQ ID NO: 13362 - RNA, 20 nt, Artificial Sequence
  MKO10013362_A_Dcaf13
  gRNA
gagccguuguacacaguauu

SEQ ID NO: 13363 - RNA, 20 nt, Artificial Sequence
  MKO10013363_A_Dcaf15
  gRNA
ccgcuuagguccggcaggug

SEQ ID NO: 13364 - RNA, 20 nt, Artificial Sequence
  MKO10013364_A_Dcaf15
  gRNA
cucaccugggugggcacgac

SEQ ID NO: 13365 - RNA, 20 nt, Artificial Sequence
  MKO10013365_A_Dcaf15
  gRNA
ccuagcacccgcucggccaa

SEQ ID NO: 13366 - RNA, 20 nt, Artificial Sequence
  MKO10013366_A_Dcaf17
  gRNA
cuucguauauccgcaacuac

SEQ ID NO: 13367 - RNA, 20 nt, Artificial Sequence
  MKO10013367_A_Dcaf17
  gRNA
ggcuucuaugcacgcgacgc

SEQ ID NO: 13368 - RNA, 20 nt, Artificial Sequence
  MKO10013368_A_Dcaf17
  gRNA
uagucuccaugggccggacc

SEQ ID NO: 13369 - RNA, 20 nt, Artificial Sequence
  MKO10013369_A_Dcaf4
  gRNA
gaugucuuaccggcaauaac

SEQ ID NO: 13370 - RNA, 20 nt, Artificial Sequence
  MKO10013370_A_Dcaf4
  gRNA
cauccuacgaaaaaaccagc

SEQ ID NO: 13371 - RNA, 20 nt, Artificial Sequence
  MKO10013371_A_Dcaf4
  gRNA
ccgauacuuccguuugcucc

SEQ ID NO: 13372 - RNA, 20 nt, Artificial Sequence
  MKO10013372_A_Dcaf5
  gRNA
cagcgucauguuuaaccccg

SEQ ID NO: 13373 - RNA, 20 nt, Artificial Sequence
  MKO10013373_A_Dcaf5
  gRNA
acgaccgccgaguucugcua

SEQ ID NO: 13374 - RNA, 20 nt, Artificial Sequence
  MKO10013374_A_Dcaf5
  gRNA
ggccaauagccggggcucca

SEQ ID NO: 13375 - RNA, 20 nt, Artificial Sequence
  MKO10013375_A_Dcaf6
  gRNA
ugccaauuuacgugccauua

SEQ ID NO: 13376 - RNA, 20 nt, Artificial Sequence
  MKO10013376_A_Dcaf6
  gRNA
uauuugcucgaugcccugaa

SEQ ID NO: 13377 - RNA, 20 nt, Artificial Sequence
  MKO10013377_A_Dcaf6
  gRNA
agaaagguguaagggucguu

SEQ ID NO: 13378 - RNA, 20 nt, Artificial Sequence
  MKO10013378_A_Dcaf7
  gRNA
gacaucgccuucagccgcgc

SEQ ID NO: 13379 - RNA, 20 nt, Artificial Sequence
  MKO10013379_A_Dcaf7
  gRNA
guggugacuaucuccgugug

SEQ ID NO: 13380 - RNA, 20 nt, Artificial Sequence
  MKO10013380_A_Dcaf7
  gRNA
caagcaggacccuaacuacc

SEQ ID NO: 13381 - RNA, 20 nt, Artificial Sequence
  MKO10013381_A_Dcaf8
  gRNA
gaggaacaaccucggcaccg

SEQ ID NO: 13382 - RNA, 20 nt, Artificial Sequence
  MKO10013382_A_Dcaf8
  gRNA
cagccuuaccccgaccucgc

SEQ ID NO: 13383 - RNA, 20 nt, Artificial Sequence
  MKO10013383_A_Dcaf8
  gRNA
accagcugacaggaacgugc

SEQ ID NO: 13384 - RNA, 20 nt, Artificial Sequence
  MKO10013384_A_Dcakd
  gRNA
ucgacguggacgucauugcg

SEQ ID NO: 13385 - RNA, 20 nt, Artificial Sequence
  MKO10013385_A_Dcakd
  gRNA
ucuacuauacgccggugggc

SEQ ID NO: 13386 - RNA, 20 nt, Artificial Sequence
  MKO10013386_A_Dcakd
  gRNA
cugacgggaggcaucgccuc

SEQ ID NO: 13387 - RNA, 20 nt, Artificial Sequence
  MKO10013387_A_Dcbld1
  gRNA
acgaggcagccauuauuucg

SEQ ID NO: 13388 - RNA, 20 nt, Artificial Sequence
  MKO10013388_A_Dcbld1
  gRNA
uacgccagcagugaccaucc

SEQ ID NO: 13389 - RNA, 20 nt, Artificial Sequence
  MKO10013389_A_Dcbld1
  gRNA
agcagugcaacagaucagua

SEQ ID NO: 13390 - RNA, 20 nt, Artificial Sequence
  MKO10013390_A_Dcbld2
  gRNA
uucgagucaggacgggagaa

SEQ ID NO: 13391 - RNA, 20 nt, Artificial Sequence
  MKO10013391_A_Dcbld2
  gRNA
ggagucagcagaacggaaau

SEQ ID NO: 13392 - RNA, 20 nt, Artificial Sequence
  MKO10013392_A_Dcbld2
  gRNA
aaucagucaauugaguccaa

SEQ ID NO: 13393 - RNA, 20 nt, Artificial Sequence
  MKO10013393_A_Dcc
  gRNA
gaccuccucgccucguaacc

SEQ ID NO: 13394 - RNA, 20 nt, Artificial Sequence
  MKO10013394_A_Dcc
  gRNA
gcgaggaggucauccaacuc

SEQ ID NO: 13395 - RNA, 20 nt, Artificial Sequence
  MKO10013395_A_Dcc
  gRNA
ugaaggacuuuaccaaugcg

SEQ ID NO: 13396 - RNA, 20 nt, Artificial Sequence
  MKO10013396_A_Dcdc2a
  gRNA
gugaaugacgacacgccgcc

SEQ ID NO: 13397 - RNA, 20 nt, Artificial Sequence
  MKO10013397_A_Dcdc2a
  gRNA
ucaacguguccgcccgcuuc

SEQ ID NO: 13398 - RNA, 20 nt, Artificial Sequence
  MKO10013398_A_Dcdc2a
  gRNA
cggaugcgguggcccguccu

SEQ ID NO: 13399 - RNA, 20 nt, Artificial Sequence
  MKO10013399_A_Dcdc2b
  gRNA
cuccaacagccacguaguaa

SEQ ID NO: 13400 - RNA, 20 nt, Artificial Sequence
  MKO10013400_A_Dcdc2b
  gRNA
ggccauuacuacguggcugu

SEQ ID NO: 13401 - RNA, 20 nt, Artificial Sequence
  MKO10013401_A_Dcdc2b
  gRNA
ucaacaccgugucccagucc

SEQ ID NO: 13402 - RNA, 20 nt, Artificial Sequence
  MKO10013402_A_Dcdc2c
  gRNA
gcacgcuauuccaaucugac

SEQ ID NO: 13403 - RNA, 20 nt, Artificial Sequence
  MKO10013403_A_Dcdc2c
  gRNA
uacuuucgaacuccuccuag

SEQ ID NO: 13404 - RNA, 20 nt, Artificial Sequence
  MKO10013404_A_Dcdc2c
  gRNA
acccaugaggacuuccagua

SEQ ID NO: 13405 - RNA, 20 nt, Artificial Sequence
  MKO10013405_A_Dchs1
  gRNA
uagguagggcuaucaaaucg

SEQ ID NO: 13406 - RNA, 20 nt, Artificial Sequence
  MKO10013406_A_Dchs1
  gRNA
uguguguaccacccggaccc

SEQ ID NO: 13407 - RNA, 20 nt, Artificial Sequence
  MKO10013407_A_Dchs1
  gRNA
uagagcgcgcaguguauaga

SEQ ID NO: 13408 - RNA, 20 nt, Artificial Sequence
  MKO10013408_A_Dck
  gRNA
uauaucaagacuggcacgac

SEQ ID NO: 13409 - RNA, 20 nt, Artificial Sequence
  MKO10013409_A_Dck
  gRNA
gucgugccagucuugauaua

SEQ ID NO: 13410 - RNA, 20 nt, Artificial Sequence
  MKO10013410_A_Dck
  gRNA
cuuacuucagaguccgauga

SEQ ID NO: 13411 - RNA, 20 nt, Artificial Sequence
  MKO10013411_A_Dclk1
  gRNA
cauuaccgacgcuaucaagc

SEQ ID NO: 13412 - RNA, 20 nt, Artificial Sequence
  MKO10013412_A_Dclk1
  gRNA
cucccgcgcagugucuucuu

SEQ ID NO: 13413 - RNA, 20 nt, Artificial Sequence
  MKO10013413_A_Dclk1
  gRNA
accagagaaguuccguuacc

SEQ ID NO: 13414 - RNA, 20 nt, Artificial Sequence
  MKO10013414_A_Dclk2
  gRNA
ccaaaaacguuaauccgaac

SEQ ID NO: 13415 - RNA, 20 nt, Artificial Sequence
  MKO10013415_A_Dclk2
  gRNA
cucgagaguaggacgauuuc

SEQ ID NO: 13416 - RNA, 20 nt, Artificial Sequence
  MKO10013416_A_Dclk2
  gRNA
gggcggaaccacccgcaccc

SEQ ID NO: 13417 - RNA, 20 nt, Artificial Sequence
  MKO10013417_A_Dclk3
  gRNA
agcggcaugacggcaccacg

SEQ ID NO: 13418 - RNA, 20 nt, Artificial Sequence
  MKO10013418_A_Dclk3
  gRNA
uuccggccacugggucguuc

SEQ ID NO: 13419 - RNA, 20 nt, Artificial Sequence
  MKO10013419_A_Dclk3
  gRNA
ucggccguguaccgcuucuu

SEQ ID NO: 13420 - RNA, 20 nt, Artificial Sequence
  MKO10013420_A_Dclre1a
  gRNA
agguguagugcaccgaguga

SEQ ID NO: 13421 - RNA, 20 nt, Artificial Sequence
  MKO10013421_A_Dclre1a
  gRNA
uaucucgacuuugagcgagc

SEQ ID NO: 13422 - RNA, 20 nt, Artificial Sequence
  MKO10013422_A_Dclre1a
  gRNA
auacauccgucaguugccga

SEQ ID NO: 13423 - RNA, 20 nt, Artificial Sequence
  MKO10013423_A_Dclre1b
  gRNA
ggggauuacgaccccguuca

SEQ ID NO: 13424 - RNA, 20 nt, Artificial Sequence
  MKO10013424_A_Dclre1b
  gRNA
gaagaagagccgcgccgaac

SEQ ID NO: 13425 - RNA, 20 nt, Artificial Sequence
  MKO10013425_A_Dclre1b
  gRNA
gcugcgcacuuuccggcuug

SEQ ID NO: 13426 - RNA, 20 nt, Artificial Sequence
  MKO10013426_A_Dclre1c
  gRNA
ucuccauugaccgcuucgac

SEQ ID NO: 13427 - RNA, 20 nt, Artificial Sequence
  MKO10013427_A_Dclre1c
  gRNA
ucaacuaaagauaucugcgu

SEQ ID NO: 13428 - RNA, 20 nt, Artificial Sequence
  MKO10013428_A_Dclre1c
  gRNA
ucagguucucccugucgaag

SEQ ID NO: 13429 - RNA, 20 nt, Artificial Sequence
  MKO10013429_A_Dcn
  gRNA
ucuagcaagguugugucggg

SEQ ID NO: 13430 - RNA, 20 nt, Artificial Sequence
  MKO10013430_A_Dcn
  gRNA
aacauaacugcgaucccuca

SEQ ID NO: 13431 - RNA, 20 nt, Artificial Sequence
  MKO10013431_A_Dcn
  gRNA
agccuuuccaacuucacgag

SEQ ID NO: 13432 - RNA, 20 nt, Artificial Sequence
  MKO10013432_A_Dcp1a
  gRNA
guuuaucucgagcagccugc

SEQ ID NO: 13433 - RNA, 20 nt, Artificial Sequence
  MKO10013433_A_Dcp1a
  gRNA
uacccucucauacucauccu

SEQ ID NO: 13434 - RNA, 20 nt, Artificial Sequence
  MKO10013434_A_Dcp1a
  gRNA
aagugucaauauacaguauc

SEQ ID NO: 13435 - RNA, 20 nt, Artificial Sequence
  MKO10013435_A_Dcp1b
  gRNA
ggaggauccggcuccaugac

SEQ ID NO: 13436 - RNA, 20 nt, Artificial Sequence
  MKO10013436_A_Dcp1b
  gRNA
gaaccuuguuuguuuauacg

SEQ ID NO: 13437 - RNA, 20 nt, Artificial Sequence
  MKO10013437_A_Dcp1b
  gRNA
uuaccucguauaaacaaaca

SEQ ID NO: 13438 - RNA, 20 nt, Artificial Sequence
  MKO10013438_A_Dcp2
  gRNA
ucucucgccgcacagucaug

SEQ ID NO: 13439 - RNA, 20 nt, Artificial Sequence
  MKO10013439_A_Dcp2
  gRNA
agaauaauugcaccguaagu

SEQ ID NO: 13440 - RNA, 20 nt, Artificial Sequence
  MKO10013440_A_Dcp2
  gRNA
ucaugacugugcggcgagag

SEQ ID NO: 13441 - RNA, 20 nt, Artificial Sequence
  MKO10013441_A_Dcpp1
  gRNA
cauaauaccccaccauuagc

SEQ ID NO: 13442 - RNA, 20 nt, Artificial Sequence
  MKO10013442_A_Dcpp1
  gRNA
cuuaaggguagauugauugu

SEQ ID NO: 13443 - RNA, 20 nt, Artificial Sequence
  MKO10013443_A_Dcpp1
  gRNA
agagcacaucauugcagccc

SEQ ID NO: 13444 - RNA, 20 nt, Artificial Sequence
  MKO10013444_A_Dcpp2
  gRNA
cacucagccgcgccugcuaa

SEQ ID NO: 13445 - RNA, 20 nt, Artificial Sequence
  MKO10013445_A_Dcpp2
  gRNA
gcucaacuauaaugacaacg

SEQ ID NO: 13446 - RNA, 20 nt, Artificial Sequence
  MKO10013446_A_Dcpp2
  gRNA
cuuaccuugugucaaaaccg

SEQ ID NO: 13447 - RNA, 20 nt, Artificial Sequence
  MKO10013447_A_Dcpp3
  gRNA
cuucaggcuagaucgauugu

SEQ ID NO: 13448 - RNA, 20 nt, Artificial Sequence
  MKO10013448_A_Dcpp3
  gRNA
ucaguucaacuaugaugaca

SEQ ID NO: 13449 - RNA, 20 nt, Artificial Sequence
  MKO10013449_A_Dcpp3
  gRNA
gagcacaucacuggggucga

SEQ ID NO: 13450 - RNA, 20 nt, Artificial Sequence
  MKO10013450_A_Dcps
  gRNA
ggcagauggcgaucaaauac

SEQ ID NO: 13451 - RNA, 20 nt, Artificial Sequence
  MKO10013451_A_Dcps
  gRNA
ugaucgccaucugccaucgc

SEQ ID NO: 13452 - RNA, 20 nt, Artificial Sequence
  MKO10013452_A_Dcps
  gRNA
cuccgccugauccgagagac

SEQ ID NO: 13453 - RNA, 20 nt, Artificial Sequence
  MKO10013453_A_Dcst1
  gRNA
uagggccggcggccaaucua

SEQ ID NO: 13454 - RNA, 20 nt, Artificial Sequence
  MKO10013454_A_Dcst1
  gRNA
ucaacaacacccgauccgcc

SEQ ID NO: 13455 - RNA, 20 nt, Artificial Sequence
  MKO10013455_A_Dcst1
  gRNA
ggugguggcguuauacugcu

SEQ ID NO: 13456 - RNA, 20 nt, Artificial Sequence
  MKO10013456_A_Dcsuamp
  gRNA
ugucauucauaugagccucc

SEQ ID NO: 13457 - RNA, 20 nt, Artificial Sequence
  MKO10013457_A_Dcsuamp
  gRNA
aaugaagcaucgugcgcgcu

SEQ ID NO: 13458 - RNA, 20 nt, Artificial Sequence
  MKO10013458_A_Dcsuamp
  gRNA
ucucaaggagcuucgcaugc

SEQ ID NO: 13459 - RNA, 20 nt, Artificial Sequence
  MKO10013459_A_Dcud
  gRNA
cugucgucuccucgcugucg

SEQ ID NO: 13460 - RNA, 20 nt, Artificial Sequence
  MKO10013460_A_Dcud
  gRNA
ggauaaauaccacgacagcg

SEQ ID NO: 13461 - RNA, 20 nt, Artificial Sequence
  MKO10013461_A_Dcud
  gRNA
augugcuaaacucaucaucc

SEQ ID NO: 13462 - RNA, 20 nt, Artificial Sequence
  MKO10013462_A_Dcun1
  gRNA
acuggcguacaaagaugccg

SEQ ID NO: 13463 - RNA, 20 nt, Artificial Sequence
  MKO10013463_A_Dcun1
  gRNA
uggcagcaggaugaguacgg

SEQ ID NO: 13464 - RNA, 20 nt, Artificial Sequence
  MKO10013464_A_Dcun1
  gRNA
caccccagcucagacuccgc

SEQ ID NO: 13465 - RNA, 20 nt, Artificial Sequence
  MKO10013465_A_Dcun2
  gRNA
ucgcugguuucauaaacguc

SEQ ID NO: 13466 - RNA, 20 nt, Artificial Sequence
  MKO10013466_A_Dcun2
  gRNA
ugaaaccagcgaccuaccug

SEQ ID NO: 13467 - RNA, 20 nt, Artificial Sequence
  MKO10013467_A_Dcun2
  gRNA
cgcugccuacgacaaguuca

SEQ ID NO: 13468 - RNA, 20 nt, Artificial Sequence
  MKO10013468_A_Dcun3
  gRNA
ugaucgcauugccauaccug

SEQ ID NO: 13469 - RNA, 20 nt, Artificial Sequence
  MKO10013469_A_Dcun3
  gRNA
ccuggaacaagugaacgccc

SEQ ID NO: 13470 - RNA, 20 nt, Artificial Sequence
  MKO10013470_A_Dcun3
  gRNA
cuggacagcgcuucuaucaa

SEQ ID NO: 13471 - RNA, 20 nt, Artificial Sequence
  MKO10013471_A_Dcun4
  gRNA
cgaacgagaucgcaagaagc

SEQ ID NO: 13472 - RNA, 20 nt, Artificial Sequence
  MKO10013472_A_Dcun4
  gRNA
ugcuuguugcacggguagaa

SEQ ID NO: 13473 - RNA, 20 nt, Artificial Sequence
  MKO10013473_A_Dcun4
  gRNA
uguccaucgacaaaauccac

SEQ ID NO: 13474 - RNA, 20 nt, Artificial Sequence
  MKO10013474_A_Dcun5
  gRNA
ccguucaaaaaauucagcaa

SEQ ID NO: 13475 - RNA, 20 nt, Artificial Sequence
  MKO10013475_A_Dcun5
  gRNA
guccaacucuuacauuugcc

SEQ ID NO: 13476 - RNA, 20 nt, Artificial Sequence
  MKO10013476_A_Dcun5
  gRNA
agccagaacaucguccucaa

SEQ ID NO: 13477 - RNA, 20 nt, Artificial Sequence
  MKO10013477_A_Dcun6
  gRNA
cccuaaagcacgaauuaucg

SEQ ID NO: 13478 - RNA, 20 nt, Artificial Sequence
  MKO10013478_A_Dcun6
  gRNA
uccgcgauaauucgugcuuu

SEQ ID NO: 13479 - RNA, 20 nt, Artificial Sequence
  MKO10013479_A_Dcun6
  gRNA
gcccacuucaaauacguugu

SEQ ID NO: 13480 - RNA, 20 nt, Artificial Sequence
  MKO10013480_A_Dcupp1
  gRNA
ccgcccguucagauucaguc

SEQ ID NO: 13481 - RNA, 20 nt, Artificial Sequence
  MKO10013481_A_Dcupp1
  gRNA
ugacggugagcgcgguacug

SEQ ID NO: 13482 - RNA, 20 nt, Artificial Sequence
  MKO10013482_A_Dcupp1
  gRNA
acagguggacuggguaacgu

SEQ ID NO: 13483 - RNA, 20 nt, Artificial Sequence
  MKO10013483_A_Dcu
  gRNA
ggaccggccccgacuguaau

SEQ ID NO: 13484 - RNA, 20 nt, Artificial Sequence
  MKO10013484_A_Dcu
  gRNA
acgugaucaccacgcaacac

SEQ ID NO: 13485 - RNA, 20 nt, Artificial Sequence
  MKO10013485_A_Dcu
  gRNA
gaguuccgacuaaucagcgu

SEQ ID NO: 13486 - RNA, 20 nt, Artificial Sequence
  MKO10013486_A_Dcun1d1
  gRNA
caacuguacacuagauacaa

SEQ ID NO: 13487 - RNA, 20 nt, Artificial Sequence
  MKO10013487_A_Dcun1d1
  gRNA
acagugcgaguucuccaaac

SEQ ID NO: 13488 - RNA, 20 nt, Artificial Sequence
  MKO10013488_A_Dcun1d1
  gRNA
uaauauuacagaucuagaaa

SEQ ID NO: 13489 - RNA, 20 nt, Artificial Sequence
  MKO10013489_A_Dcun1d2
  gRNA
gcaggugugauagcaccgag

SEQ ID NO: 13490 - RNA, 20 nt, Artificial Sequence
  MKO10013490_A_Dcun1d2
  gRNA
uaaagguccuugaacuuggc

SEQ ID NO: 13491 - RNA, 20 nt, Artificial Sequence
  MKO10013491_A_Dcun1d2
  gRNA
uguggauggcaugacggagc

SEQ ID NO: 13492 - RNA, 20 nt, Artificial Sequence
  MKO10013492_A_Dcun1d3
  gRNA
gagaugcccuugauucccga

SEQ ID NO: 13493 - RNA, 20 nt, Artificial Sequence
  MKO10013493_A_Dcun1d3
  gRNA
ccaccuuguggcaaaccagc

SEQ ID NO: 13494 - RNA, 20 nt, Artificial Sequence
  MKO10013494_A_Dcun1d3
  gRNA
uugacaagaauauccccagc

SEQ ID NO: 13495 - RNA, 20 nt, Artificial Sequence
  MKO10013495_A_Dcun1d4
  gRNA
ccgaagaacugcaagagcgc

SEQ ID NO: 13496 - RNA, 20 nt, Artificial Sequence
  MKO10013496_A_Dcun1d4
  gRNA
uuucuccaguaagcggugcc

SEQ ID NO: 13497 - RNA, 20 nt, Artificial Sequence
  MKO10013497_A_Dcun1d4
  gRNA
uaccuguuuggugaucgucu

SEQ ID NO: 13498 - RNA, 20 nt, Artificial Sequence
  MKO10013498_A_Dcun1d5
  gRNA
ccuccugcuagacucaucag

SEQ ID NO: 13499 - RNA, 20 nt, Artificial Sequence
  MKO10013499_A_Dcun1d5
  gRNA
ucuccacugaugagucuagc

SEQ ID NO: 13500 - RNA, 20 nt, Artificial Sequence
  MKO10013500_A_Dcun1d5
  gRNA
acucacccuugcaaaaucaa

SEQ ID NO: 13501 - RNA, 20 nt, Artificial Sequence
  MKO10013501_A_Dcxr
  gRNA
ccuggacgaccugguccgcg

SEQ ID NO: 13502 - RNA, 20 nt, Artificial Sequence
  MKO10013502_A_Dcxr
  gRNA
ggcggugagucggacgcgag

SEQ ID NO: 13503 - RNA, 20 nt, Artificial Sequence
  MKO10013503_A_Dcxr
  gRNA
ccacgggucccacauugcuu

SEQ ID NO: 13504 - RNA, 20 nt, Artificial Sequence
  MKO10013504_A_Dcx
  gRNA
cuucaccccgcugcgaauga

SEQ ID NO: 13505 - RNA, 20 nt, Artificial Sequence
  MKO10013505_A_Dcx
  gRNA
uugcugcggcgcauugggcc

SEQ ID NO: 13506 - RNA, 20 nt, Artificial Sequence
  MKO10013506_A_Dcx
  gRNA
cuugugaccaucauucgcag

SEQ ID NO: 13507 - RNA, 20 nt, Artificial Sequence
  MKO10013507_A_Dda1
  gRNA
ccuugcacacagaguccgcg

SEQ ID NO: 13508 - RNA, 20 nt, Artificial Sequence
  MKO10013508_A_Dda1
  gRNA
ucgggucggcagguauacug

SEQ ID NO: 13509 - RNA, 20 nt, Artificial Sequence
  MKO10013509_A_Dda1
  gRNA
gagcucagcgccaccucgca

SEQ ID NO: 13510 - RNA, 20 nt, Artificial Sequence
  MKO10013510_A_Ddah1
  gRNA
gcucacuguacccgacgaca

SEQ ID NO: 13511 - RNA, 20 nt, Artificial Sequence
  MKO10013511_A_Ddah1
  gRNA
gguggggacguccuauucac

SEQ ID NO: 13512 - RNA, 20 nt, Artificial Sequence
  MKO10013512_A_Ddah1
  gRNA
cagugagcuugucauaacga

SEQ ID NO: 13513 - RNA, 20 nt, Artificial Sequence
  MKO10013513_A_Ddah2
  gRNA
cauggggggaccucgcaccg

SEQ ID NO: 13514 - RNA, 20 nt, Artificial Sequence
  MKO10013514_A_Ddah2
  gRNA
uccaaguggaccaaucaucg

SEQ ID NO: 13515 - RNA, 20 nt, Artificial Sequence
  MKO10013515_A_Ddah2
  gRNA
gaucucagcuccucgaugau

SEQ ID NO: 13516 - RNA, 20 nt, Artificial Sequence
  MKO10013516_A_Ddb1
  gRNA
ggaccgcauuggucgccccu

SEQ ID NO: 13517 - RNA, 20 nt, Artificial Sequence
  MKO10013517_A_Ddb1
  gRNA
gacccugagugccguaugau

SEQ ID NO: 13518 - RNA, 20 nt, Artificial Sequence
  MKO10013518_A_Ddb1
  gRNA
cacaagauuagagaucuaug

SEQ ID NO: 13519 - RNA, 20 nt, Artificial Sequence
  MKO10013519_A_Ddb2
  gRNA
ggaucuuuaccagcauaagu

SEQ ID NO: 13520 - RNA, 20 nt, Artificial Sequence
  MKO10013520_A_Ddb2
  gRNA
caccuggucaucacuacagc

SEQ ID NO: 13521 - RNA, 20 nt, Artificial Sequence
  MKO10013521_A_Ddb2
  gRNA
cuuaccccuuuaaggaagau

SEQ ID NO: 13522 - RNA, 20 nt, Artificial Sequence
  MKO10013522_A_Ddc
  gRNA
uaaaguuauccgccagcugc

SEQ ID NO: 13523 - RNA, 20 nt, Artificial Sequence
  MKO10013523_A_Ddc
  gRNA
cagcugccuugucccgcucc

SEQ ID NO: 13524 - RNA, 20 nt, Artificial Sequence
  MKO10013524_A_Ddc
  gRNA
gaccgugaugauggacuggc

SEQ ID NO: 13525 - RNA, 20 nt, Artificial Sequence
  MKO10013525_A_Ddhd1
  gRNA
cgccggcggcaugaacuacc

SEQ ID NO: 13526 - RNA, 20 nt, Artificial Sequence
  MKO10013526_A_Ddhd1
  gRNA
guaguagcgcaacgacgagc

SEQ ID NO: 13527 - RNA, 20 nt, Artificial Sequence
  MKO10013527_A_Ddhd1
  gRNA
gauaaaauaccaguaaugcg

SEQ ID NO: 13528 - RNA, 20 nt, Artificial Sequence
  MKO10013528_A_Ddhd2
  gRNA
caauaaguauguccccuacu

SEQ ID NO: 13529 - RNA, 20 nt, Artificial Sequence
  MKO10013529_A_Ddhd2
  gRNA
cgaaaacgaagaucgcaagc

SEQ ID NO: 13530 - RNA, 20 nt, Artificial Sequence
  MKO10013530_A_Ddhd2
  gRNA
guacaugcuugcaguaacuc

SEQ ID NO: 13531 - RNA, 20 nt, Artificial Sequence
  MKO10013531_A_Ddi1
  gRNA
gcuguuccauguaaacgauc

SEQ ID NO: 13532 - RNA, 20 nt, Artificial Sequence
  MKO10013532_A_Ddi1
  gRNA
gacccagugaaaucugcucg

SEQ ID NO: 13533 - RNA, 20 nt, Artificial Sequence
  MKO10013533_A_Ddi1
  gRNA
ggaggcccagaucguuuaca

SEQ ID NO: 13534 - RNA, 20 nt, Artificial Sequence
  MKO10013534_A_Ddi2
  gRNA
gugaaagccuuugucgacuc

SEQ ID NO: 13535 - RNA, 20 nt, Artificial Sequence
  MKO10013535_A_Ddi2
  gRNA
gaacaugacgauagcuaugg

SEQ ID NO: 13536 - RNA, 20 nt, Artificial Sequence
  MKO10013536_A_Ddi2
  gRNA
uguugugauucuacgacaga

SEQ ID NO: 13537 - RNA, 20 nt, Artificial Sequence
  MKO10013537_A_Ddit3
  gRNA
gcgggcucugaucgaccgca

SEQ ID NO: 13538 - RNA, 20 nt, Artificial Sequence
  MKO10013538_A_Ddit3
  gRNA
aggaaaucgagcgccugacc

SEQ ID NO: 13539 - RNA, 20 nt, Artificial Sequence
  MKO10013539_A_Ddit3
  gRNA
ggcaccuauaucucaucccc

SEQ ID NO: 13540 - RNA, 20 nt, Artificial Sequence
  MKO10013540_A_Ddit4l
  gRNA
gaucgugugugaugcuagcg

SEQ ID NO: 13541 - RNA, 20 nt, Artificial Sequence
  MKO10013541_A_Ddit4l
  gRNA
cgugcauaacacaaccccga

SEQ ID NO: 13542 - RNA, 20 nt, Artificial Sequence
  MKO10013542_A_Ddit4l
  gRNA
gccguugaccaugguugcaa

SEQ ID NO: 13543 - RNA, 20 nt, Artificial Sequence
  MKO10013543_A_Ddit4
  gRNA
agcggccggaguucgagacg

SEQ ID NO: 13544 - RNA, 20 nt, Artificial Sequence
  MKO10013544_A_Ddit4
  gRNA
cucggcaugagcaaacgcgc

SEQ ID NO: 13545 - RNA, 20 nt, Artificial Sequence
  MKO10013545_A_Ddit4
  gRNA
gagccugucccaggcgcgau

SEQ ID NO: 13546 - RNA, 20 nt, Artificial Sequence
  MKO10013546_A_Ddn
  gRNA
agcgcgacgacuauaaugac

SEQ ID NO: 13547 - RNA, 20 nt, Artificial Sequence
  MKO10013547_A_Ddn
  gRNA
cgcggguucacuucuccgac

SEQ ID NO: 13548 - RNA, 20 nt, Artificial Sequence
  MKO10013548_A_Ddn
  gRNA
cacggcuucucgcaacgccc

SEQ ID NO: 13549 - RNA, 20 nt, Artificial Sequence
  MKO10013549_A_Ddost
  gRNA
gcgcccuuaccuuccaccga

SEQ ID NO: 13550 - RNA, 20 nt, Artificial Sequence
  MKO10013550_A_Ddost
  gRNA
guacuuaaugagggacaagc

SEQ ID NO: 13551 - RNA, 20 nt, Artificial Sequence
  MKO10013551_A_Ddost
  gRNA
gcugccgccaccaucaauga

SEQ ID NO: 13552 - RNA, 20 nt, Artificial Sequence
  MKO10013552_A_Ddo
  gRNA
cuacaagucgccggcuuccc

SEQ ID NO: 13553 - RNA, 20 nt, Artificial Sequence
  MKO10013553_A_Ddo
  gRNA
ucguuggagcuggcgugaua

SEQ ID NO: 13554 - RNA, 20 nt, Artificial Sequence
  MKO10013554_A_Ddo
  gRNA
caucccagccgcuacauuac

SEQ ID NO: 13555 - RNA, 20 nt, Artificial Sequence
  MKO10013555_A_Ddr1
  gRNA
acaggugauuucggguaacg

SEQ ID NO: 13556 - RNA, 20 nt, Artificial Sequence
  MKO10013556_A_Ddr1
  gRNA
aguaacgcaaccgauagcuu

SEQ ID NO: 13557 - RNA, 20 nt, Artificial Sequence
  MKO10013557_A_Ddr1
  gRNA
aagaguucucccgaagcuau

SEQ ID NO: 13558 - RNA, 20 nt, Artificial Sequence
  MKO10013558_A_Ddr2
  gRNA
cgaacaaaucuggcgacgau

SEQ ID NO: 13559 - RNA, 20 nt, Artificial Sequence
  MKO10013559_A_Ddr2
  gRNA
ggacccaggggcgccaugca

SEQ ID NO: 13560 - RNA, 20 nt, Artificial Sequence
  MKO10013560_A_Ddr2
  gRNA
agugcaacccgaugaccuga

SEQ ID NO: 13561 - RNA, 20 nt, Artificial Sequence
  MKO10013561_A_Ddrgk1
  gRNA
ccacucgcugggcucgacgc

SEQ ID NO: 13562 - RNA, 20 nt, Artificial Sequence
  MKO10013562_A_Ddrgk1
  gRNA
ugcccaagucccuccgacgc

SEQ ID NO: 13563 - RNA, 20 nt, Artificial Sequence
  MKO10013563_A_Ddrgk1
  gRNA
gguacuccucgugcucccgc

SEQ ID NO: 13564 - RNA, 20 nt, Artificial Sequence
  MKO10013564_A_Ddt
  gRNA
gugagcguuacgauacgacc

SEQ ID NO: 13565 - RNA, 20 nt, Artificial Sequence
  MKO10013565_A_Ddt
  gRNA
ucuccagccccgcggguaug

SEQ ID NO: 13566 - RNA, 20 nt, Artificial Sequence
  MKO10013566_A_Ddt
  gRNA
gccggcuagccgcauacccg

SEQ ID NO: 13567 - RNA, 20 nt, Artificial Sequence
  MKO10013567_A_Ddx10
  gRNA
uuugagguucuacgcaaagu

SEQ ID NO: 13568 - RNA, 20 nt, Artificial Sequence
  MKO10013568_A_Ddx10
  gRNA
aauaucaccuacucgagaac

SEQ ID NO: 13569 - RNA, 20 nt, Artificial Sequence
  MKO10013569_A_Ddx10
  gRNA
cccaccuaacaucugaagau

SEQ ID NO: 13570 - RNA, 20 nt, Artificial Sequence
  MKO10013570_A_Ddx11
  gRNA
ucgggguguccguagguucu

SEQ ID NO: 13571 - RNA, 20 nt, Artificial Sequence
  MKO10013571_A_Ddx11
  gRNA
agcgaguucuucucacuacu

SEQ ID NO: 13572 - RNA, 20 nt, Artificial Sequence
  MKO10013572_A_Ddx11
  gRNA
ucucauauucugccagaacc

SEQ ID NO: 13573 - RNA, 20 nt, Artificial Sequence
  MKO10013573_A_Ddx17
  gRNA
ugguuuauaugaacaaucgc

SEQ ID NO: 13574 - RNA, 20 nt, Artificial Sequence
  MKO10013574_A_Ddx17
  gRNA
gggcuucccccuaagaaguu

SEQ ID NO: 13575 - RNA, 20 nt, Artificial Sequence
  MKO10013575_A_Ddx17
  gRNA
aguaugagguugaugagcua

SEQ ID NO: 13576 - RNA, 20 nt, Artificial Sequence
  MKO10013576_A_Ddx18
  gRNA
auggcaaaugaugccgggcc

SEQ ID NO: 13577 - RNA, 20 nt, Artificial Sequence
  MKO10013577_A_Ddx18
  gRNA
aaugggcuucaagcgcauga

SEQ ID NO: 13578 - RNA, 20 nt, Artificial Sequence
  MKO10013578_A_Ddx18
  gRNA
ggccaucaccugucaguccu

SEQ ID NO: 13579 - RNA, 20 nt, Artificial Sequence
  MKO10013579_A_Ddx19a
  gRNA
gaugagcaguuugcagauca

SEQ ID NO: 13580 - RNA, 20 nt, Artificial Sequence
  MKO10013580_A_Ddx19a
  gRNA
cagagcauucuccuggaucu

SEQ ID NO: 13581 - RNA, 20 nt, Artificial Sequence
  MKO10013581_A_Ddx19a
  gRNA
caccacugcagaaaagacag

SEQ ID NO: 13582 - RNA, 20 nt, Artificial Sequence
  MKO10013582_A_Ddx19b
  gRNA
caaccgcccuuccaaaauac

SEQ ID NO: 13583 - RNA, 20 nt, Artificial Sequence
  MKO10013583_A_Ddx19b
  gRNA
aacccauagcauagacuccc

SEQ ID NO: 13584 - RNA, 20 nt, Artificial Sequence
  MKO10013584_A_Ddx19b
  gRNA
agcuacucaccauuggcauc

SEQ ID NO: 13585 - RNA, 20 nt, Artificial Sequence
  MKO10013585_A_Ddx1
  gRNA
uccagaaauggguguuaugc

SEQ ID NO: 13586 - RNA, 20 nt, Artificial Sequence
  MKO10013586_A_Ddx1
  gRNA
ucagaguuucauacacuauc

SEQ ID NO: 13587 - RNA, 20 nt, Artificial Sequence
  MKO10013587_A_Ddx1
  gRNA
uagucuaccaacugauaucc

SEQ ID NO: 13588 - RNA, 20 nt, Artificial Sequence
  MKO10013588_A_Ddx20
  gRNA
uuccagugcccgacuuagcu

SEQ ID NO: 13589 - RNA, 20 nt, Artificial Sequence
  MKO10013589_A_Ddx20
  gRNA
cccagcgauccaagucucau

SEQ ID NO: 13590 - RNA, 20 nt, Artificial Sequence
  MKO10013590_A_Ddx20
  gRNA
ucuugaaaacuauaguacuc

SEQ ID NO: 13591 - RNA, 20 nt, Artificial Sequence
  MKO10013591_A_Ddx21
  gRNA
gcacuuacucugaccaccgu

SEQ ID NO: 13592 - RNA, 20 nt, Artificial Sequence
  MKO10013592_A_Ddx21
  gRNA
ucgcuacuacuuuccucacc

SEQ ID NO: 13593 - RNA, 20 nt, Artificial Sequence
  MKO10013593_A_Ddx21
  gRNA
auguggaucccccuaaaucc

SEQ ID NO: 13594 - RNA, 20 nt, Artificial Sequence
  MKO10013594_A_Ddx23
  gRNA
acauggagacaagcgaccua

SEQ ID NO: 13595 - RNA, 20 nt, Artificial Sequence
  MKO10013595_A_Ddx23
  gRNA
gcgccagaagaugcucgaag

SEQ ID NO: 13596 - RNA, 20 nt, Artificial Sequence
  MKO10013596_A_Ddx23
  gRNA
ccucccgcucugcuuuagag

SEQ ID NO: 13597 - RNA, 20 nt, Artificial Sequence
  MKO10013597_A_Ddx24
  gRNA
agucaaagcguccgagccag

SEQ ID NO: 13598 - RNA, 20 nt, Artificial Sequence
  MKO10013598_A_Ddx24
  gRNA
acuaacucccagagccgacc

SEQ ID NO: 13599 - RNA, 20 nt, Artificial Sequence
  MKO10013599_A_Ddx24
  gRNA
cauagaugaagcugaucgca

SEQ ID NO: 13600 - RNA, 20 nt, Artificial Sequence
  MKO10013600_A_Ddx25
  gRNA
cauagacggcucucuuaaca

SEQ ID NO: 13601 - RNA, 20 nt, Artificial Sequence
  MKO10013601_A_Ddx25
  gRNA
uuucaaaucucguccauccc

SEQ ID NO: 13602 - RNA, 20 nt, Artificial Sequence
  MKO10013602_A_Ddx25
  gRNA
aauaccacgaagguucuucc

SEQ ID NO: 13603 - RNA, 20 nt, Artificial Sequence
  MKO10013603_A_Ddx26b
  gRNA
gcccugguguugcguuugcc

SEQ ID NO: 13604 - RNA, 20 nt, Artificial Sequence
  MKO10013604_A_Ddx26b
  gRNA
cuccaggcaaacgcaacacc

SEQ ID NO: 13605 - RNA, 20 nt, Artificial Sequence
  MKO10013605_A_Ddx26b
  gRNA
acccagccagccgcggagac

SEQ ID NO: 13606 - RNA, 20 nt, Artificial Sequence
  MKO10013606_A_Ddx27
  gRNA
ccggauucuccugccccuuc

SEQ ID NO: 13607 - RNA, 20 nt, Artificial Sequence
  MKO10013607_A_Ddx27
  gRNA
uuuguagggacccauugugc

SEQ ID NO: 13608 - RNA, 20 nt, Artificial Sequence
  MKO10013608_A_Ddx27
  gRNA
agggcauguaugauggcagc

SEQ ID NO: 13609 - RNA, 20 nt, Artificial Sequence
  MKO10013609_A_Ddx28
  gRNA
uucccgagaacuagccgaac

SEQ ID NO: 13610 - RNA, 20 nt, Artificial Sequence
  MKO10013610_A_Ddx28
  gRNA
gcuaacgccagcagccgcga

SEQ ID NO: 13611 - RNA, 20 nt, Artificial Sequence
  MKO10013611_A_Ddx28
  gRNA
cgcaccacuagguuccgucg

SEQ ID NO: 13612 - RNA, 20 nt, Artificial Sequence
  MKO10013612_A_Ddx31
  gRNA
gcuacugaccugagcccguc

SEQ ID NO: 13613 - RNA, 20 nt, Artificial Sequence
  MKO10013613_A_Ddx31
  gRNA
agcgaugaagucuugaugca

SEQ ID NO: 13614 - RNA, 20 nt, Artificial Sequence
  MKO10013614_A_Ddx31
  gRNA
aaccucuuaccuggucauac

SEQ ID NO: 13615 - RNA, 20 nt, Artificial Sequence
  MKO10013615_A_Ddx39b
  gRNA
ccagcaugagugcaucccgc

SEQ ID NO: 13616 - RNA, 20 nt, Artificial Sequence
  MKO10013616_A_Ddx39b
  gRNA
ggaguccccacgacgaugug

SEQ ID NO: 13617 - RNA, 20 nt, Artificial Sequence
  MKO10013617_A_Ddx39b
  gRNA
gaacugcccacacaucgucg

SEQ ID NO: 13618 - RNA, 20 nt, Artificial Sequence
  MKO10013618_A_Ddx39
  gRNA
aucccauccagacaugcgcc

SEQ ID NO: 13619 - RNA, 20 nt, Artificial Sequence
  MKO10013619_A_Ddx39
  gRNA
ggggacaccaggccggaucc

SEQ ID NO: 13620 - RNA, 20 nt, Artificial Sequence
  MKO10013620_A_Ddx39
  gRNA
uccugcuccgcacaagugcc

SEQ ID NO: 13621 - RNA, 20 nt, Artificial Sequence
  MKO10013621_A_Ddx3x
  gRNA
guuauaucccaccucauuua

SEQ ID NO: 13622 - RNA, 20 nt, Artificial Sequence
  MKO10013622_A_Ddx3x
  gRNA
uacuguuccaaucguucacu

SEQ ID NO: 13623 - RNA, 20 nt, Artificial Sequence
  MKO10013623_A_Ddx3x
  gRNA
auacucagguuugaugaucg

SEQ ID NO: 13624 - RNA, 20 nt, Artificial Sequence
  MKO10013624_A_Ddx3y
  gRNA
aacggaguggucauagucgu

SEQ ID NO: 13625 - RNA, 20 nt, Artificial Sequence
  MKO10013625_A_Ddx3y
  gRNA
ggucgugaccgaacuggauu

SEQ ID NO: 13626 - RNA, 20 nt, Artificial Sequence
  MKO10013626_A_Ddx3y
  gRNA
cccaauuauuucagugaucg

SEQ ID NO: 13627 - RNA, 20 nt, Artificial Sequence
  MKO10013627_A_Ddx41
  gRNA
cgcugccgcaacggcacaua

SEQ ID NO: 13628 - RNA, 20 nt, Artificial Sequence
  MKO10013628_A_Ddx41
  gRNA
acguacccuaugugccguug

SEQ ID NO: 13629 - RNA, 20 nt, Artificial Sequence
  MKO10013629_A_Ddx41
  gRNA
aucgucauaggugaugccuu

SEQ ID NO: 13630 - RNA, 20 nt, Artificial Sequence
  MKO10013630_A_Ddx42
  gRNA
uaauaccuccgaaugaucaa

SEQ ID NO: 13631 - RNA, 20 nt, Artificial Sequence
  MKO10013631_A_Ddx42
  gRNA
uauucgagaugacauugaag

SEQ ID NO: 13632 - RNA, 20 nt, Artificial Sequence
  MKO10013632_A_Ddx42
  gRNA
uccugaaccaccccagcagu

SEQ ID NO: 13633 - RNA, 20 nt, Artificial Sequence
  MKO10013633_A_Ddx43
  gRNA
uaucugcuccaacgguaggu

SEQ ID NO: 13634 - RNA, 20 nt, Artificial Sequence
  MKO10013634_A_Ddx43
  gRNA
auugcauuccaaccuaccgu

SEQ ID NO: 13635 - RNA, 20 nt, Artificial Sequence
  MKO10013635_A_Ddx43
  gRNA
uacuuaccaacucuuugucc

SEQ ID NO: 13636 - RNA, 20 nt, Artificial Sequence
  MKO10013636_A_Ddx46
  gRNA
uccgagaucuucuccgcucu

SEQ ID NO: 13637 - RNA, 20 nt, Artificial Sequence
  MKO10013637_A_Ddx46
  gRNA
cgcucaaggagucgaagccg

SEQ ID NO: 13638 - RNA, 20 nt, Artificial Sequence
  MKO10013638_A_Ddx46
  gRNA
cgaaaacgcucagcaucucg

SEQ ID NO: 13639 - RNA, 20 nt, Artificial Sequence
  MKO10013639_A_Ddx47
  gRNA
ccucaccccuacucgagagu

SEQ ID NO: 13640 - RNA, 20 nt, Artificial Sequence
  MKO10013640_A_Ddx47
  gRNA
accagggcgaacagucgcug

SEQ ID NO: 13641 - RNA, 20 nt, Artificial Sequence
  MKO10013641_A_Ddx47
  gRNA
gacucaccuauuacuauaug

SEQ ID NO: 13642 - RNA, 20 nt, Artificial Sequence
  MKO10013642_A_Ddx49
  gRNA
agcagcguuugccuucgugc

SEQ ID NO: 13643 - RNA, 20 nt, Artificial Sequence
  MKO10013643_A_Ddx49
  gRNA
ccaccaacgagcccuucuuu

SEQ ID NO: 13644 - RNA, 20 nt, Artificial Sequence
  MKO10013644_A_Ddx49
  gRNA
cccggaacugcucagcgauc

SEQ ID NO: 13645 - RNA, 20 nt, Artificial Sequence
  MKO10013645_A_Ddx4
  gRNA
aaagagaacacaucuacaac

SEQ ID NO: 13646 - RNA, 20 nt, Artificial Sequence
  MKO10013646_A_Ddx4
  gRNA
cuaucaugggagaugaagau

SEQ ID NO: 13647 - RNA, 20 nt, Artificial Sequence
  MKO10013647_A_Ddx4
  gRNA
uguauuaccuucucaaauac

SEQ ID NO: 13648 - RNA, 20 nt, Artificial Sequence
  MKO10013648_A_Ddx50
  gRNA
ucuugcucagguacucguuu

SEQ ID NO: 13649 - RNA, 20 nt, Artificial Sequence
  MKO10013649_A_Ddx50
  gRNA
uaaccguuaccuuuggugag

SEQ ID NO: 13650 - RNA, 20 nt, Artificial Sequence
  MKO10013650_A_Ddx50
  gRNA
gacucuaacacgugaacaaa

SEQ ID NO: 13651 - RNA, 20 nt, Artificial Sequence
  MKO10013651_A_Ddx51
  gRNA
gcaggcccuguugcaucgag

SEQ ID NO: 13652 - RNA, 20 nt, Artificial Sequence
  MKO10013652_A_Ddx51
  gRNA
ggacccgggugcgaacccuc

SEQ ID NO: 13653 - RNA, 20 nt, Artificial Sequence
  MKO10013653_A_Ddx51
  gRNA
cgaagaucucacucccauug

SEQ ID NO: 13654 - RNA, 20 nt, Artificial Sequence
  MKO10013654_A_Ddx52
  gRNA
cuucugcuccaaccggaucu

SEQ ID NO: 13655 - RNA, 20 nt, Artificial Sequence
  MKO10013655_A_Ddx52
  gRNA
cgaagaagucuagucccuuc

SEQ ID NO: 13656 - RNA, 20 nt, Artificial Sequence
  MKO10013656_A_Ddx52
  gRNA
aaguccgucucagaugaaug

SEQ ID NO: 13657 - RNA, 20 nt, Artificial Sequence
  MKO10013657_A_Ddx54
  gRNA
uccuccucccgauguuugag

SEQ ID NO: 13658 - RNA, 20 nt, Artificial Sequence
  MKO10013658_A_Ddx54
  gRNA
gccgacgcccauccagagga

SEQ ID NO: 13659 - RNA, 20 nt, Artificial Sequence
  MKO10013659_A_Ddx54
  gRNA
acagaccauccccgugaucu

SEQ ID NO: 13660 - RNA, 20 nt, Artificial Sequence
  MKO10013660_A_Ddx55
  gRNA
caucaccccgacucgcgagc

SEQ ID NO: 13661 - RNA, 20 nt, Artificial Sequence
  MKO10013661_A_Ddx55
  gRNA
cgcagugcaccgagcacccg

SEQ ID NO: 13662 - RNA, 20 nt, Artificial Sequence
  MKO10013662_A_Ddx55
  gRNA
gggcuucccgcacaugacgc

SEQ ID NO: 13663 - RNA, 20 nt, Artificial Sequence
  MKO10013663_A_Ddx56
  gRNA
gucgcgaccuacguugaucc

SEQ ID NO: 13664 - RNA, 20 nt, Artificial Sequence
  MKO10013664_A_Ddx56
  gRNA
uucuuaggcugucaccgauu

SEQ ID NO: 13665 - RNA, 20 nt, Artificial Sequence
  MKO10013665_A_Ddx56
  gRNA
ccaguugcuggaucauggcc

SEQ ID NO: 13666 - RNA, 20 nt, Artificial Sequence
  MKO10013666_A_Ddx58
  gRNA
augucuuaucagauccgaca

SEQ ID NO: 13667 - RNA, 20 nt, Artificial Sequence
  MKO10013667_A_Ddx58
  gRNA
auccgaauguuugauuaauc

SEQ ID NO: 13668 - RNA, 20 nt, Artificial Sequence
  MKO10013668_A_Ddx58
  gRNA
uuugugaagccaucgaaagu

SEQ ID NO: 13669 - RNA, 20 nt, Artificial Sequence
  MKO10013669_A_Ddx59
  gRNA
ccccacagcucuaucgcuua

SEQ ID NO: 13670 - RNA, 20 nt, Artificial Sequence
  MKO10013670_A_Ddx59
  gRNA
gccuccaguguuaguauucg

SEQ ID NO: 13671 - RNA, 20 nt, Artificial Sequence
  MKO10013671_A_Ddx59
  gRNA
caggaugaucugccgcacac

SEQ ID NO: 13672 - RNA, 20 nt, Artificial Sequence
  MKO10013672_A_Ddx5
  gRNA
guugguugcagcgaauguca

SEQ ID NO: 13673 - RNA, 20 nt, Artificial Sequence
  MKO10013673_A_Ddx5
  gRNA
agguuuggugcaccucgauu

SEQ ID NO: 13674 - RNA, 20 nt, Artificial Sequence
  MKO10013674_A_Ddx5
  gRNA
gcuucauaaaaauucagaac

SEQ ID NO: 13675 - RNA, 20 nt, Artificial Sequence
  MKO10013675_A_Ddx60
  gRNA
uaaaguaugcauaaagacga

SEQ ID NO: 13676 - RNA, 20 nt, Artificial Sequence
  MKO10013676_A_Ddx60
  gRNA
cuuaguccaaacuucaacag

SEQ ID NO: 13677 - RNA, 20 nt, Artificial Sequence
  MKO10013677_A_Ddx60
  gRNA
ucaucacgugugcgugugag

SEQ ID NO: 13678 - RNA, 20 nt, Artificial Sequence
  MKO10013678_A_Ddx6
  gRNA
ucucuagaccuggugaugac

SEQ ID NO: 13679 - RNA, 20 nt, Artificial Sequence
  MKO10013679_A_Ddx6
  gRNA
cauuaugucaucucguaaau

SEQ ID NO: 13680 - RNA, 20 nt, Artificial Sequence
  MKO10013680_A_Ddx6
  gRNA
auuuacgagaugacauaaug

SEQ ID NO: 13681 - RNA, 20 nt, Artificial Sequence
  MKO10013681_A_Deaf1
  gRNA
aacucgcugucauacaccga

SEQ ID NO: 13682 - RNA, 20 nt, Artificial Sequence
  MKO10013682_A_Deaf1
  gRNA
cugauguuccgacagcgcac

SEQ ID NO: 13683 - RNA, 20 nt, Artificial Sequence
  MKO10013683_A_Deaf1
  gRNA
ucaggcugucaccgaucugc

SEQ ID NO: 13684 - RNA, 20 nt, Artificial Sequence
  MKO10013684_A_Dear1
  gRNA
ggcugucaaccgcaucccgc

SEQ ID NO: 13685 - RNA, 20 nt, Artificial Sequence
  MKO10013685_A_Dear1
  gRNA
ccgcuccagcucuaccaaag

SEQ ID NO: 13686 - RNA, 20 nt, Artificial Sequence
  MKO10013686_A_Dear1
  gRNA
gaagccacugaagcgacugc

SEQ ID NO: 13687 - RNA, 20 nt, Artificial Sequence
  MKO10013687_A_Deb1
  gRNA
ccagcugauccgcuguaucg

SEQ ID NO: 13688 - RNA, 20 nt, Artificial Sequence
  MKO10013688_A_Deb1
  gRNA
acuggacgcacucguucgcu

SEQ ID NO: 13689 - RNA, 20 nt, Artificial Sequence
  MKO10013689_A_Deb1
  gRNA
cugucaucuucgcuccugac

SEQ ID NO: 13690 - RNA, 20 nt, Artificial Sequence
  MKO10013690_A_Decr1
  gRNA
ucagguggugauaaacaacg

SEQ ID NO: 13691 - RNA, 20 nt, Artificial Sequence
  MKO10013691_A_Decr1
  gRNA
ugauguucgagauccugaua

SEQ ID NO: 13692 - RNA, 20 nt, Artificial Sequence
  MKO10013692_A_Decr1
  gRNA
gccuaugugacacuagaaau

SEQ ID NO: 13693 - RNA, 20 nt, Artificial Sequence
  MKO10013693_A_Decr2
  gRNA
uccugccgacgaugacagug

SEQ ID NO: 13694 - RNA, 20 nt, Artificial Sequence
  MKO10013694_A_Decr2
  gRNA
ggcugccacacugucaucgu

SEQ ID NO: 13695 - RNA, 20 nt, Artificial Sequence
  MKO10013695_A_Decr2
  gRNA
uuucaaugccuuuaagaccg

SEQ ID NO: 13696 - RNA, 20 nt, Artificial Sequence
  MKO10013696_A_Dedd2
  gRNA
cgcaguacucugcccgaacc

SEQ ID NO: 13697 - RNA, 20 nt, Artificial Sequence
  MKO10013697_A_Dedd2
  gRNA
cgugacgggcuagcacgcgc

SEQ ID NO: 13698 - RNA, 20 nt, Artificial Sequence
  MKO10013698_A_Dedd2
  gRNA
gucgcuucaccguauguucg

SEQ ID NO: 13699 - RNA, 20 nt, Artificial Sequence
  MKO10013699_A_Dedd
  gRNA
ugacgagaguaacuuucgcc

SEQ ID NO: 13700 - RNA, 20 nt, Artificial Sequence
  MKO10013700_A_Dedd
  gRNA
ccaccgcauguucgacaucg

SEQ ID NO: 13701 - RNA, 20 nt, Artificial Sequence
  MKO10013701_A_Dedd
  gRNA
ucaccuaccucgacgcauuc

SEQ ID NO: 13702 - RNA, 20 nt, Artificial Sequence
  MKO10013702_A_Def6
  gRNA
ggggcgcgacucccucagca

SEQ ID NO: 13703 - RNA, 20 nt, Artificial Sequence
  MKO10013703_A_Def6
  gRNA
gcugaucaugguucccgaug

SEQ ID NO: 13704 - RNA, 20 nt, Artificial Sequence
  MKO10013704_A_Def6
  gRNA
cauccaagacguccugaagc

SEQ ID NO: 13705 - RNA, 20 nt, Artificial Sequence
  MKO10013705_A_Def8
  gRNA
ccaucaugcgcuccgaguag

SEQ ID NO: 13706 - RNA, 20 nt, Artificial Sequence
  MKO10013706_A_Def8
  gRNA
caccuguuugcauucuucga

SEQ ID NO: 13707 - RNA, 20 nt, Artificial Sequence
  MKO10013707_A_Def8
  gRNA
gauggaucucggccugucug

SEQ ID NO: 13708 - RNA, 20 nt, Artificial Sequence
  MKO10013708_A_Defa-rs1
  gRNA
ccucucugcccucguucugc

SEQ ID NO: 13709 - RNA, 20 nt, Artificial Sequence
  MKO10013709_A_Defa-rs1
  gRNA
ccagcagaacgagggcagag

SEQ ID NO: 13710 - RNA, 20 nt, Artificial Sequence
  MKO10013710_A_Defa-rs1
  gRNA
cagcccaaagaagguuuccg

SEQ ID NO: 13711 - RNA, 20 nt, Artificial Sequence
  MKO10013711_A_Defa-rs7
  gRNA
ucuugaagagaagagccuuc

SEQ ID NO: 13712 - RNA, 20 nt, Artificial Sequence
  MKO10013712_A_Defa-rs7
  gRNA
ccucucugcccucauccugc

SEQ ID NO: 13713 - RNA, 20 nt, Artificial Sequence
  MKO10013713_A_Defa-rs7
  gRNA
uauuaaaugacccuuucugc

SEQ ID NO: 13714 - RNA, 20 nt, Artificial Sequence
  MKO10013714_A_Defa17
  gRNA
ucuugaagagaagagccuuc

SEQ ID NO: 13715 - RNA, 20 nt, Artificial Sequence
  MKO10013715_A_Defa17
  gRNA
ccucucugcccucguccugc

SEQ ID NO: 13716 - RNA, 20 nt, Artificial Sequence
  MKO10013716_A_Defa17
  gRNA
cauuaaaugacccuuucugc

SEQ ID NO: 13717 - RNA, 20 nt, Artificial Sequence
  MKO10013717_A_Defa20
  gRNA
ucaugaagagcagauccuuc

SEQ ID NO: 13718 - RNA, 20 nt, Artificial Sequence
  MKO10013718_A_Defa20
  gRNA
ccucucugcccucguccugc

SEQ ID NO: 13719 - RNA, 20 nt, Artificial Sequence
  MKO10013719_A_Defa20
  gRNA
aucugcauguucaguggcgg

SEQ ID NO: 13720 - RNA, 20 nt, Artificial Sequence
  MKO10013720_A_Defa21
  gRNA
ugcagcgacgauuucuacaa

SEQ ID NO: 13721 - RNA, 20 nt, Artificial Sequence
  MKO10013721_A_Defa21
  gRNA
agaaaucgucgcugcaauag

SEQ ID NO: 13722 - RNA, 20 nt, Artificial Sequence
  MKO10013722_A_Defa21
  gRNA
gcagccaggggaagaugacc

SEQ ID NO: 13723 - RNA, 20 nt, Artificial Sequence
  MKO10013723_A_Defa22
  gRNA
agaaaacgucgcugcaauag

SEQ ID NO: 13724 - RNA, 20 nt, Artificial Sequence
  MKO10013724_A_Defa22
  gRNA
caugaagagcagauccuucu

SEQ ID NO: 13725 - RNA, 20 nt, Artificial Sequence
  MKO10013725_A_Defa22
  gRNA
ccucucugcccucauccugc

SEQ ID NO: 13726 - RNA, 20 nt, Artificial Sequence
  MKO10013726_A_Defa23
  gRNA
ucuugaagagaagagccuuc

SEQ ID NO: 13727 - RNA, 20 nt, Artificial Sequence
  MKO10013727_A_Defa23
  gRNA
ccucucugcccucauccugc

SEQ ID NO: 13728 - RNA, 20 nt, Artificial Sequence
  MKO10013728_A_Defa23
  gRNA
uauuaaaugacccuuucugc

SEQ ID NO: 13729 - RNA, 20 nt, Artificial Sequence
  MKO10013729_A_Defa24
  gRNA
ucuugaagagaagcgccuuc

SEQ ID NO: 13730 - RNA, 20 nt, Artificial Sequence
  MKO10013730_A_Defa24
  gRNA
caauaaaugacccuuacugc

SEQ ID NO: 13731 - RNA, 20 nt, Artificial Sequence
  MKO10013731_A_Defa24
  gRNA
gucuccagcauugagagauc

SEQ ID NO: 13732 - RNA, 20 nt, Artificial Sequence
  MKO10013732_A_Defa25
  gRNA
gucauuuaauguacaugcuc

SEQ ID NO: 13733 - RNA, 20 nt, Artificial Sequence
  MKO10013733_A_Defa25
  gRNA
ucuugaagagaagagccuuc

SEQ ID NO: 13734 - RNA, 20 nt, Artificial Sequence
  MKO10013734_A_Defa25
  gRNA
ccucucugcccuugcccugc

SEQ ID NO: 13735 - RNA, 20 nt, Artificial Sequence
  MKO10013735_A_Defa26
  gRNA
gcagccacaggaagaggacc

SEQ ID NO: 13736 - RNA, 20 nt, Artificial Sequence
  MKO10013736_A_Defa26
  gRNA
ucuugaagaucagagccuuc

SEQ ID NO: 13737 - RNA, 20 nt, Artificial Sequence
  MKO10013737_A_Defa26
  gRNA
cauuaaaugacccuuucugc

SEQ ID NO: 13738 - RNA, 20 nt, Artificial Sequence
  MKO10013738_A_Defa2
  gRNA
ucaugaagagcagauccuuc

SEQ ID NO: 13739 - RNA, 20 nt, Artificial Sequence
  MKO10013739_A_Defa2
  gRNA
ccucucugcccucguccugc

SEQ ID NO: 13740 - RNA, 20 nt, Artificial Sequence
  MKO10013740_A_Defa2
  gRNA
aucugcauguucaguggcgg

SEQ ID NO: 13741 - RNA, 20 nt, Artificial Sequence
  MKO10013741_A_Defa3
  gRNA
ucuugaagagaagagccuuc

SEQ ID NO: 13742 - RNA, 20 nt, Artificial Sequence
  MKO10013742_A_Defa3
  gRNA
ccucucugcccucguccugc

SEQ ID NO: 13743 - RNA, 20 nt, Artificial Sequence
  MKO10013743_A_Defa3
  gRNA
cauuaaaugacccuuucugc

SEQ ID NO: 13744 - RNA, 20 nt, Artificial Sequence
  MKO10013744_A_Defa4
  gRNA
caugaagagcagacccuucu

SEQ ID NO: 13745 - RNA, 20 nt, Artificial Sequence
  MKO10013745_A_Defa4
  gRNA
ccucucugcccuuguccugc

SEQ ID NO: 13746 - RNA, 20 nt, Artificial Sequence
  MKO10013746_A_Defa4
  gRNA
caaaagagauagacacagcc

SEQ ID NO: 13747 - RNA, 20 nt, Artificial Sequence
  MKO10013747_A_Defa5
  gRNA
caugaagagcagacccuucu

SEQ ID NO: 13748 - RNA, 20 nt, Artificial Sequence
  MKO10013748_A_Defa5
  gRNA
ccucucugcccuuguccugc

SEQ ID NO: 13749 - RNA, 20 nt, Artificial Sequence
  MKO10013749_A_Defa5
  gRNA
aguuaaaaaaagauuucugc

SEQ ID NO: 13750 - RNA, 20 nt, Artificial Sequence
  MKO10013750_A_Defa6
  gRNA
ucuugaagagaagcgccuuc

SEQ ID NO: 13751 - RNA, 20 nt, Artificial Sequence
  MKO10013751_A_Defa6
  gRNA
caauaaaugacccuuacugc

SEQ ID NO: 13752 - RNA, 20 nt, Artificial Sequence
  MKO10013752_A_Defa6
  gRNA
gucuccagcauugagagauc

SEQ ID NO: 13753 - RNA, 20 nt, Artificial Sequence
  MKO10013753_A_Defb10
  gRNA
cucauaaaccugcuauuacc

SEQ ID NO: 13754 - RNA, 20 nt, Artificial Sequence
  MKO10013754_A_Defb10
  gRNA
uacucaaagcacaacuuaca

SEQ ID NO: 13755 - RNA, 20 nt, Artificial Sequence
  MKO10013755_A_Defb10
  gRNA
cuggggugguauaugagaaa

SEQ ID NO: 13756 - RNA, 20 nt, Artificial Sequence
  MKO10013756_A_Defb11
  gRNA
ccuccucauaccaaguuuau

SEQ ID NO: 13757 - RNA, 20 nt, Artificial Sequence
  MKO10013757_A_Defb11
  gRNA
gugacaguuaccuauaaacu

SEQ ID NO: 13758 - RNA, 20 nt, Artificial Sequence
  MKO10013758_A_Defb11
  gRNA
cuggagugguauaugagaaa

SEQ ID NO: 13759 - RNA, 20 nt, Artificial Sequence
  MKO10013759_A_Defb12
  gRNA
auuguaguugaacugccauc

SEQ ID NO: 13760 - RNA, 20 nt, Artificial Sequence
  MKO10013760_A_Defb12
  gRNA
gaagaaucuccccucaaaca

SEQ ID NO: 13761 - RNA, 20 nt, Artificial Sequence
  MKO10013761_A_Defb12
  gRNA
uuaaauuuaggguccugggc

SEQ ID NO: 13762 - RNA, 20 nt, Artificial Sequence
  MKO10013762_A_Defb13
  gRNA
uuuaccuucgagcaaaagau

SEQ ID NO: 13763 - RNA, 20 nt, Artificial Sequence
  MKO10013763_A_Defb13
  gRNA
ccuucuguacaaugugcccc

SEQ ID NO: 13764 - RNA, 20 nt, Artificial Sequence
  MKO10013764_A_Defb13
  gRNA
cuucucauucaacuuuaccc

SEQ ID NO: 13765 - RNA, 20 nt, Artificial Sequence
  MKO10013765_A_Defb14
  gRNA
auaggucgauguucuaauag

SEQ ID NO: 13766 - RNA, 20 nt, Artificial Sequence
  MKO10013766_A_Defb14
  gRNA
ugugcuguacuuaacugccu

SEQ ID NO: 13767 - RNA, 20 nt, Artificial Sequence
  MKO10013767_A_Defb14
  gRNA
uguauuccucaucuuguucu

SEQ ID NO: 13768 - RNA, 20 nt, Artificial Sequence
  MKO10013768_A_Defb15
  gRNA
cucaggccacauggggacuu

SEQ ID NO: 13769 - RNA, 20 nt, Artificial Sequence
  MKO10013769_A_Defb15
  gRNA
uucauccccaaguccccaug

SEQ ID NO: 13770 - RNA, 20 nt, Artificial Sequence
  MKO10013770_A_Defb15
  gRNA
cuuugcuguucucuucuuuc

SEQ ID NO: 13771 - RNA, 20 nt, Artificial Sequence
  MKO10013771_A_Defb18
  gRNA
guauucucgcaccacacagc

SEQ ID NO: 13772 - RNA, 20 nt, Artificial Sequence
  MKO10013772_A_Defb18
  gRNA
gcaagucugaauguaacagu

SEQ ID NO: 13773 - RNA, 20 nt, Artificial Sequence
  MKO10013773_A_Defb18
  gRNA
aacauuaccagaaggaccac

SEQ ID NO: 13774 - RNA, 20 nt, Artificial Sequence
  MKO10013774_A_Defb19
  gRNA
ugauccucacguaggacugg

SEQ ID NO: 13775 - RNA, 20 nt, Artificial Sequence
  MKO10013775_A_Defb19
  gRNA
gcaggcugucacgguauucu

SEQ ID NO: 13776 - RNA, 20 nt, Artificial Sequence
  MKO10013776_A_Defb19
  gRNA
caguuccguugccacaagua

SEQ ID NO: 13777 - RNA, 20 nt, Artificial Sequence
  MKO10013777_A_Defb1
  gRNA
cccaucuaauaccaaacuac

SEQ ID NO: 13778 - RNA, 20 nt, Artificial Sequence
  MKO10013778_A_Defb1
  gRNA
caauacaaaugccuucaaca

SEQ ID NO: 13779 - RNA, 20 nt, Artificial Sequence
  MKO10013779_A_Defb1
  gRNA
gaaaacucauuacuuucucc

SEQ ID NO: 13780 - RNA, 20 nt, Artificial Sequence
  MKO10013780_A_Defb20
  gRNA
agacuauaugauccugccca

SEQ ID NO: 13781 - RNA, 20 nt, Artificial Sequence
  MKO10013781_A_Defb20
  gRNA
uacguugcuaaaacaucuuu

SEQ ID NO: 13782 - RNA, 20 nt, Artificial Sequence
  MKO10013782_A_Defb20
  gRNA
gugccacaaacagcaaaaca

SEQ ID NO: 13783 - RNA, 20 nt, Artificial Sequence
  MKO10013783_A_Defb21
  gRNA
cuucuaccccaagugacacc

SEQ ID NO: 13784 - RNA, 20 nt, Artificial Sequence
  MKO10013784_A_Defb21
  gRNA
cagaucauacucugauguag

SEQ ID NO: 13785 - RNA, 20 nt, Artificial Sequence
  MKO10013785_A_Defb21
  gRNA
gguaauauuugcaugaucca

SEQ ID NO: 13786 - RNA, 20 nt, Artificial Sequence
  MKO10013786_A_Defb22
  gRNA
gcaacgagcaaaugucccau

SEQ ID NO: 13787 - RNA, 20 nt, Artificial Sequence
  MKO10013787_A_Defb22
  gRNA
ggacgaagggagcagcgcaa

SEQ ID NO: 13788 - RNA, 20 nt, Artificial Sequence
  MKO10013788_A_Defb22
  gRNA
ugcauuuaccugugaccaaa

SEQ ID NO: 13789 - RNA, 20 nt, Artificial Sequence
  MKO10013789_A_Defb23
  gRNA
ugugggguauuucuugucgc

SEQ ID NO: 13790 - RNA, 20 nt, Artificial Sequence
  MKO10013790_A_Defb23
  gRNA
uggaagcaguagcgcccaug

SEQ ID NO: 13791 - RNA, 20 nt, Artificial Sequence
  MKO10013791_A_Defb23
  gRNA
cugagacugaagcaugagac

SEQ ID NO: 13792 - RNA, 20 nt, Artificial Sequence
  MKO10013792_A_Defb25
  gRNA
ggaacggccaaggagccugc

SEQ ID NO: 13793 - RNA, 20 nt, Artificial Sequence
  MKO10013793_A_Defb25
  gRNA
gcgugaaggcuugaaagaau

SEQ ID NO: 13794 - RNA, 20 nt, Artificial Sequence
  MKO10013794_A_Defb25
  gRNA
uaccuggugguacaugacuc

SEQ ID NO: 13795 - RNA, 20 nt, Artificial Sequence
  MKO10013795_A_Defb26
  gRNA
cgacccgacuuacugauaac

SEQ ID NO: 13796 - RNA, 20 nt, Artificial Sequence
  MKO10013796_A_Defb26
  gRNA
cagaguccgaugucaagaag

SEQ ID NO: 13797 - RNA, 20 nt, Artificial Sequence
  MKO10013797_A_Defb26
  gRNA
uccccugaguuagcaaccca

SEQ ID NO: 13798 - RNA, 20 nt, Artificial Sequence
  MKO10013798_A_Defb28
  gRNA
agagcuuauugugucccgag

SEQ ID NO: 13799 - RNA, 20 nt, Artificial Sequence
  MKO10013799_A_Defb28
  gRNA
ggaaaugcaggcgcauaugc

SEQ ID NO: 13800 - RNA, 20 nt, Artificial Sequence
  MKO10013800_A_Defb28
  gRNA
gacucgcuccuccacccucu

SEQ ID NO: 13801 - RNA, 20 nt, Artificial Sequence
  MKO10013801_A_Defb29
  gRNA
ugcuacugcggaauccgaac

SEQ ID NO: 13802 - RNA, 20 nt, Artificial Sequence
  MKO10013802_A_Defb29
  gRNA
uaccuguggucucgucaacc

SEQ ID NO: 13803 - RNA, 20 nt, Artificial Sequence
  MKO10013803_A_Defb29
  gRNA
ucuuugggcaacuuaaguac

SEQ ID NO: 13804 - RNA, 20 nt, Artificial Sequence
  MKO10013804_A_Defb2
  gRNA
ucauuucauguacuugcaac

SEQ ID NO: 13805 - RNA, 20 nt, Artificial Sequence
  MKO10013805_A_Defb2
  gRNA
cuugaccacugccacaccaa

SEQ ID NO: 13806 - RNA, 20 nt, Artificial Sequence
  MKO10013806_A_Defb2
  gRNA
cuggagugguauaugagaaa

SEQ ID NO: 13807 - RNA, 20 nt, Artificial Sequence
  MKO10013807_A_Defb30
  gRNA
aacggauuuacgacacaugc

SEQ ID NO: 13808 - RNA, 20 nt, Artificial Sequence
  MKO10013808_A_Defb30
  gRNA
uugcucuccuauguuccacc

SEQ ID NO: 13809 - RNA, 20 nt, Artificial Sequence
  MKO10013809_A_Defb30
  gRNA
cagcuacuucacgaagagaa

SEQ ID NO: 13810 - RNA, 20 nt, Artificial Sequence
  MKO10013810_A_Defb33
  gRNA
guuucguccgugugagaaaa

SEQ ID NO: 13811 - RNA, 20 nt, Artificial Sequence
  MKO10013811_A_Defb33
  gRNA
gucgauacaaacacugcugu

SEQ ID NO: 13812 - RNA, 20 nt, Artificial Sequence
  MKO10013812_A_Defb33
  gRNA
ugucuugcucagacuacauc

SEQ ID NO: 13813 - RNA, 20 nt, Artificial Sequence
  MKO10013813_A_Defb34
  gRNA
cucgggccacaugggcacuc

SEQ ID NO: 13814 - RNA, 20 nt, Artificial Sequence
  MKO10013814_A_Defb34
  gRNA
uucauccccgagugcccaug

SEQ ID NO: 13815 - RNA, 20 nt, Artificial Sequence
  MKO10013815_A_Defb34
  gRNA
ucuuugcuguucucuucuuu

SEQ ID NO: 13816 - RNA, 20 nt, Artificial Sequence
  MKO10013816_A_Defb35
  gRNA
caaaaaacaaaaaacgucug

SEQ ID NO: 13817 - RNA, 20 nt, Artificial Sequence
  MKO10013817_A_Defb35
  gRNA
ccaucucagcagcucuuucc

SEQ ID NO: 13818 - RNA, 20 nt, Artificial Sequence
  MKO10013818_A_Defb35
  gRNA
acagcaaucuccccugugcc

SEQ ID NO: 13819 - RNA, 20 nt, Artificial Sequence
  MKO10013819_A_Defb36
  gRNA
agugccgccaccgaugcucc

SEQ ID NO: 13820 - RNA, 20 nt, Artificial Sequence
  MKO10013820_A_Defb36
  gRNA
aucgguggcggcacuugccg

SEQ ID NO: 13821 - RNA, 20 nt, Artificial Sequence
  MKO10013821_A_Defb36
  gRNA
gcgcagccaaagucagcagc

SEQ ID NO: 13822 - RNA, 20 nt, Artificial Sequence
  MKO10013822_A_Defb37
  gRNA
ccacgccuucauaauguagu

SEQ ID NO: 13823 - RNA, 20 nt, Artificial Sequence
  MKO10013823_A_Defb37
  gRNA
gauacuuaccuggguuguuc

SEQ ID NO: 13824 - RNA, 20 nt, Artificial Sequence
  MKO10013824_A_Defb37
  gRNA
ccaacuacauuaugaaggcg

SEQ ID NO: 13825 - RNA, 20 nt, Artificial Sequence
  MKO10013825_A_Defb38
  gRNA
gucacuacuuugaaugccca

SEQ ID NO: 13826 - RNA, 20 nt, Artificial Sequence
  MKO10013826_A_Defb38
  gRNA
ucuguuggcaccuguuauaa

SEQ ID NO: 13827 - RNA, 20 nt, Artificial Sequence
  MKO10013827_A_Defb38
  gRNA
gguacuuaccuugguugauc

SEQ ID NO: 13828 - RNA, 20 nt, Artificial Sequence
  MKO10013828_A_Defb39
  gRNA
ccgaucucaucuugaaaaua

SEQ ID NO: 13829 - RNA, 20 nt, Artificial Sequence
  MKO10013829_A_Defb39
  gRNA
gguacuuaccuggguugauc

SEQ ID NO: 13830 - RNA, 20 nt, Artificial Sequence
  MKO10013830_A_Defb39
  gRNA
gguuacaccuucuucuuccu

SEQ ID NO: 13831 - RNA, 20 nt, Artificial Sequence
  MKO10013831_A_Defb3
  gRNA
auuggcaacacucgucagau

SEQ ID NO: 13832 - RNA, 20 nt, Artificial Sequence
  MKO10013832_A_Defb3
  gRNA
ccuuuccucaaacaacuuac

SEQ ID NO: 13833 - RNA, 20 nt, Artificial Sequence
  MKO10013833_A_Defb3
  gRNA
cagguggagacagcagcacc

SEQ ID NO: 13834 - RNA, 20 nt, Artificial Sequence
  MKO10013834_A_Defb40
  gRNA
gauguugccaaaaacgccgu

SEQ ID NO: 13835 - RNA, 20 nt, Artificial Sequence
  MKO10013835_A_Defb40
  gRNA
caaguuagcaccuguuauaa

SEQ ID NO: 13836 - RNA, 20 nt, Artificial Sequence
  MKO10013836_A_Defb40
  gRNA
gaagaucaucaguagaaagc

SEQ ID NO: 13837 - RNA, 20 nt, Artificial Sequence
  MKO10013837_A_Defb41
  gRNA
uggcaguuuaaaugcagcac

SEQ ID NO: 13838 - RNA, 20 nt, Artificial Sequence
  MKO10013838_A_Defb41
  gRNA
gagagaugugaaaaagugcg

SEQ ID NO: 13839 - RNA, 20 nt, Artificial Sequence
  MKO10013839_A_Defb41
  gRNA
cauauuaccuguuaauauug

SEQ ID NO: 13840 - RNA, 20 nt, Artificial Sequence
  MKO10013840_A_Defb42
  gRNA
gagacgugcaccgcaaucga

SEQ ID NO: 13841 - RNA, 20 nt, Artificial Sequence
  MKO10013841_A_Defb42
  gRNA
gaaacacaagccuucgauug

SEQ ID NO: 13842 - RNA, 20 nt, Artificial Sequence
  MKO10013842_A_Defb42
  gRNA
acaguaagcaugaaagacgc

SEQ ID NO: 13843 - RNA, 20 nt, Artificial Sequence
  MKO10013843_A_Defb43
  gRNA
auacgccgucagauacugcg

SEQ ID NO: 13844 - RNA, 20 nt, Artificial Sequence
  MKO10013844_A_Defb43
  gRNA
guucaaagcaccgccacugc

SEQ ID NO: 13845 - RNA, 20 nt, Artificial Sequence
  MKO10013845_A_Defb43
  gRNA
cuuguuauccauaguuccuc

SEQ ID NO: 13846 - RNA, 20 nt, Artificial Sequence
  MKO10013846_A_Defb45
  gRNA
cuagguuaccuggaaugacc

SEQ ID NO: 13847 - RNA, 20 nt, Artificial Sequence
  MKO10013847_A_Defb45
  gRNA
uagggaccccugaaagaugc

SEQ ID NO: 13848 - RNA, 20 nt, Artificial Sequence
  MKO10013848_A_Defb45
  gRNA
agcccaagaaugugccccug

SEQ ID NO: 13849 - RNA, 20 nt, Artificial Sequence
  MKO10013849_A_Defb46
  gRNA
ugcagcauuucauacuacga

SEQ ID NO: 13850 - RNA, 20 nt, Artificial Sequence
  MKO10013850_A_Defb46
  gRNA
ugcuggggucaguguguuuc

SEQ ID NO: 13851 - RNA, 20 nt, Artificial Sequence
  MKO10013851_A_Defb46
  gRNA
cacauggagagagcagcacc

SEQ ID NO: 13852 - RNA, 20 nt, Artificial Sequence
  MKO10013852_A_Defb47
  gRNA
uacgccaauaguaucgucug

SEQ ID NO: 13853 - RNA, 20 nt, Artificial Sequence
  MKO10013853_A_Defb47
  gRNA
acgacgugaagaaguguugu

SEQ ID NO: 13854 - RNA, 20 nt, Artificial Sequence
  MKO10013854_A_Defb47
  gRNA
ucagcaucaucaucacaaag

SEQ ID NO: 13855 - RNA, 20 nt, Artificial Sequence
  MKO10013855_A_Defb48
  gRNA
ggucuuacuucaccuuagac

SEQ ID NO: 13856 - RNA, 20 nt, Artificial Sequence
  MKO10013856_A_Defb48
  gRNA
ucaagaaccccuccagucua

SEQ ID NO: 13857 - RNA, 20 nt, Artificial Sequence
  MKO10013857_A_Defb48
  gRNA
ccaacuuaccuugggguaaa

SEQ ID NO: 13858 - RNA, 20 nt, Artificial Sequence
  MKO10013858_A_Defb4
  gRNA
auugccaaucugucgaaaag

SEQ ID NO: 13859 - RNA, 20 nt, Artificial Sequence
  MKO10013859_A_Defb4
  gRNA
agggcacggaccccagcaua

SEQ ID NO: 13860 - RNA, 20 nt, Artificial Sequence
  MKO10013860_A_Defb4
  gRNA
caaguggagacagcagcacc

SEQ ID NO: 13861 - RNA, 20 nt, Artificial Sequence
  MKO10013861_A_Defb50
  gRNA
auccugacgugaaauguacc

SEQ ID NO: 13862 - RNA, 20 nt, Artificial Sequence
  MKO10013862_A_Defb50
  gRNA
uacgaaaucuguaugcugca

SEQ ID NO: 13863 - RNA, 20 nt, Artificial Sequence
  MKO10013863_A_Defb50
  gRNA
cuccucuaccugauggucaa

SEQ ID NO: 13864 - RNA, 20 nt, Artificial Sequence
  MKO10013864_A_Defb5
  gRNA
ccaaucauacagcaacuuac

SEQ ID NO: 13865 - RNA, 20 nt, Artificial Sequence
  MKO10013865_A_Defb5
  gRNA
ccaguaaguugcuguaugau

SEQ ID NO: 13866 - RNA, 20 nt, Artificial Sequence
  MKO10013866_A_Defb5
  gRNA
uccccugacacaccugcaag

SEQ ID NO: 13867 - RNA, 20 nt, Artificial Sequence
  MKO10013867_A_Defb6
  gRNA
aaccuccauugcaugaacgc

SEQ ID NO: 13868 - RNA, 20 nt, Artificial Sequence
  MKO10013868_A_Defb6
  gRNA
uuucgacuggguggccauug

SEQ ID NO: 13869 - RNA, 20 nt, Artificial Sequence
  MKO10013869_A_Defb6
  gRNA
ccugcucuuugccuuuaucc

SEQ ID NO: 13870 - RNA, 20 nt, Artificial Sequence
  MKO10013870_A_Defb7
  gRNA
acaguaaacgagcuugcuau

SEQ ID NO: 13871 - RNA, 20 nt, Artificial Sequence
  MKO10013871_A_Defb7
  gRNA
aaggaggcgaaugccugcaa

SEQ ID NO: 13872 - RNA, 20 nt, Artificial Sequence
  MKO10013872_A_Defb7
  gRNA
gaaaugcgaacagaacauaa

SEQ ID NO: 13873 - RNA, 20 nt, Artificial Sequence
  MKO10013873_A_Defb8
  gRNA
ccguuucgaauguaaguuac

SEQ ID NO: 13874 - RNA, 20 nt, Artificial Sequence
  MKO10013874_A_Defb8
  gRNA
ccaguaacuuacauucgaaa

SEQ ID NO: 13875 - RNA, 20 nt, Artificial Sequence
  MKO10013875_A_Defb8
  gRNA
ccuucucuucacauuucucc

SEQ ID NO: 13876 - RNA, 20 nt, Artificial Sequence
  MKO10013876_A_Defb9
  gRNA
ugauacaccgauuauagagu

SEQ ID NO: 13877 - RNA, 20 nt, Artificial Sequence
  MKO10013877_A_Defb9
  gRNA
gcagcugccaacucuauaau

SEQ ID NO: 13878 - RNA, 20 nt, Artificial Sequence
  MKO10013878_A_Defb9
  gRNA
cuggggugguauaugagaaa

SEQ ID NO: 13879 - RNA, 20 nt, Artificial Sequence
  MKO10013879_A_Degs1
  gRNA
caucaaucuuauccgcuccg

SEQ ID NO: 13880 - RNA, 20 nt, Artificial Sequence
  MKO10013880_A_Degs1
  gRNA
ucaccaccgguaccucggag

SEQ ID NO: 13881 - RNA, 20 nt, Artificial Sequence
  MKO10013881_A_Degs1
  gRNA
uccgaaagggaacgagauuc

SEQ ID NO: 13882 - RNA, 20 nt, Artificial Sequence
  MKO10013882_A_Degs2
  gRNA
ggauauuccuacgaacuucg

SEQ ID NO: 13883 - RNA, 20 nt, Artificial Sequence
  MKO10013883_A_Degs2
  gRNA
guugugucucccgaaaccgc

SEQ ID NO: 13884 - RNA, 20 nt, Artificial Sequence
  MKO10013884_A_Degs2
  gRNA
cgagcaucuccuugcgccuc

SEQ ID NO: 13885 - RNA, 20 nt, Artificial Sequence
  MKO10013885_A_Dek
  gRNA
aguggcuuuccauucgaaaa

SEQ ID NO: 13886 - RNA, 20 nt, Artificial Sequence
  MKO10013886_A_Dek
  gRNA
ugaacagcgaacucgugaag

SEQ ID NO: 13887 - RNA, 20 nt, Artificial Sequence
  MKO10013887_A_Dek
  gRNA
acccacguucuucuucaacg

SEQ ID NO: 13888 - RNA, 20 nt, Artificial Sequence
  MKO10013888_A_Dennd1a
  gRNA
agccucacaguuagccaagu

SEQ ID NO: 13889 - RNA, 20 nt, Artificial Sequence
  MKO10013889_A_Dennd1a
  gRNA
cccagaggacuacagugacc

SEQ ID NO: 13890 - RNA, 20 nt, Artificial Sequence
  MKO10013890_A_Dennd1a
  gRNA
acacuaccuguccacauaga

SEQ ID NO: 13891 - RNA, 20 nt, Artificial Sequence
  MKO10013891_A_Dennd1b
  gRNA
cuuacacucuccgguaucgu

SEQ ID NO: 13892 - RNA, 20 nt, Artificial Sequence
  MKO10013892_A_Dennd1b
  gRNA
auggaaaguaagcagcgauu

SEQ ID NO: 13893 - RNA, 20 nt, Artificial Sequence
  MKO10013893_A_Dennd1b
  gRNA
cuucuuacaguuacuugcca

SEQ ID NO: 13894 - RNA, 20 nt, Artificial Sequence
  MKO10013894_A_Dennd1c
  gRNA
caaaucuacgguugcccacc

SEQ ID NO: 13895 - RNA, 20 nt, Artificial Sequence
  MKO10013895_A_Dennd1c
  gRNA
aacuccgugcaccagcucgc

SEQ ID NO: 13896 - RNA, 20 nt, Artificial Sequence
  MKO10013896_A_Dennd1c
  gRNA
uccauaccuuucuaugucga

SEQ ID NO: 13897 - RNA, 20 nt, Artificial Sequence
  MKO10013897_A_Dennd2a
  gRNA
agguuaaagaacgugucguc

SEQ ID NO: 13898 - RNA, 20 nt, Artificial Sequence
  MKO10013898_A_Dennd2a
  gRNA
acucacacgcacuuuaucgg

SEQ ID NO: 13899 - RNA, 20 nt, Artificial Sequence
  MKO10013899_A_Dennd2a
  gRNA
uaguaaguccucgaacucau

SEQ ID NO: 13900 - RNA, 20 nt, Artificial Sequence
  MKO10013900_A_Dennd2c
  gRNA
uuccauuccguuagggugac

SEQ ID NO: 13901 - RNA, 20 nt, Artificial Sequence
  MKO10013901_A_Dennd2c
  gRNA
uucgugaguuccgaaagugc

SEQ ID NO: 13902 - RNA, 20 nt, Artificial Sequence
  MKO10013902_A_Dennd2c
  gRNA
gagcgccuuccgaacaccca

SEQ ID NO: 13903 - RNA, 20 nt, Artificial Sequence
  MKO10013903_A_Dennd2d
  gRNA
cagcuuccccaggauuguuc

SEQ ID NO: 13904 - RNA, 20 nt, Artificial Sequence
  MKO10013904_A_Dennd2d
  gRNA
gcaggaagaucggauacugc

SEQ ID NO: 13905 - RNA, 20 nt, Artificial Sequence
  MKO10013905_A_Dennd2d
  gRNA
aguugaggaccaggaccggc

SEQ ID NO: 13906 - RNA, 20 nt, Artificial Sequence
  MKO10013906_A_Dennd3
  gRNA
gcaccuagcugagaucacgc

SEQ ID NO: 13907 - RNA, 20 nt, Artificial Sequence
  MKO10013907_A_Dennd3
  gRNA
aggcgguggacuagguauua

SEQ ID NO: 13908 - RNA, 20 nt, Artificial Sequence
  MKO10013908_A_Dennd3
  gRNA
cgcucuucacuccucguuuc

SEQ ID NO: 13909 - RNA, 20 nt, Artificial Sequence
  MKO10013909_A_Dennd4a
  gRNA
guuuaacgucucugguagau

SEQ ID NO: 13910 - RNA, 20 nt, Artificial Sequence
  MKO10013910_A_Dennd4a
  gRNA
aauauuggcaggucguccau

SEQ ID NO: 13911 - RNA, 20 nt, Artificial Sequence
  MKO10013911_A_Dennd4a
  gRNA
cuguaucguuauuccaucuc

SEQ ID NO: 13912 - RNA, 20 nt, Artificial Sequence
  MKO10013912_A_Dennd4b
  gRNA
guacguaccccagcucaacg

SEQ ID NO: 13913 - RNA, 20 nt, Artificial Sequence
  MKO10013913_A_Dennd4b
  gRNA
cugcugcccgccgauacaug

SEQ ID NO: 13914 - RNA, 20 nt, Artificial Sequence
  MKO10013914_A_Dennd4b
  gRNA
caucgcuagggcacugggcg

SEQ ID NO: 13915 - RNA, 20 nt, Artificial Sequence
  MKO10013915_A_Dennd4c
  gRNA
agcggccguacggcguggcu

SEQ ID NO: 13916 - RNA, 20 nt, Artificial Sequence
  MKO10013916_A_Dennd4c
  gRNA
gugauccaagccacgccgua

SEQ ID NO: 13917 - RNA, 20 nt, Artificial Sequence
  MKO10013917_A_Dennd4c
  gRNA
guuagacguucuugagagua

SEQ ID NO: 13918 - RNA, 20 nt, Artificial Sequence
  MKO10013918_A_Dennd5a
  gRNA
ccuggaugaccgcuccaagu

SEQ ID NO: 13919 - RNA, 20 nt, Artificial Sequence
  MKO10013919_A_Dennd5a
  gRNA
ucagucguacuugaaaugaa

SEQ ID NO: 13920 - RNA, 20 nt, Artificial Sequence
  MKO10013920_A_Dennd5a
  gRNA
aucgaauagaggaagcucau

SEQ ID NO: 13921 - RNA, 20 nt, Artificial Sequence
  MKO10013921_A_Dennd5b
  gRNA
auacacgcugacgcuguugu

SEQ ID NO: 13922 - RNA, 20 nt, Artificial Sequence
  MKO10013922_A_Dennd5b
  gRNA
uucugacuacccucuucgag

SEQ ID NO: 13923 - RNA, 20 nt, Artificial Sequence
  MKO10013923_A_Dennd5b
  gRNA
gcaccucguagagaauauug

SEQ ID NO: 13924 - RNA, 20 nt, Artificial Sequence
  MKO10013924_A_Dennd6a
  gRNA
uuuagauuccgacagucuuc

SEQ ID NO: 13925 - RNA, 20 nt, Artificial Sequence
  MKO10013925_A_Dennd6a
  gRNA
uuucccaccuuuaaguaaac

SEQ ID NO: 13926 - RNA, 20 nt, Artificial Sequence
  MKO10013926_A_Dennd6a
  gRNA
aaguuaccugaauuugaguc

SEQ ID NO: 13927 - RNA, 20 nt, Artificial Sequence
  MKO10013927_A_Dennd6b
  gRNA
ugaucggucguauaacaaca

SEQ ID NO: 13928 - RNA, 20 nt, Artificial Sequence
  MKO10013928_A_Dennd6b
  gRNA
aguuuccguaugcgucagug

SEQ ID NO: 13929 - RNA, 20 nt, Artificial Sequence
  MKO10013929_A_Dennd6b
  gRNA
acauagcccagauagugugc

SEQ ID NO: 13930 - RNA, 20 nt, Artificial Sequence
  MKO10013930_A_Denr
  gRNA
aaauacgugacgagagugug

SEQ ID NO: 13931 - RNA, 20 nt, Artificial Sequence
  MKO10013931_A_Denr
  gRNA
ucaacucaccaaaaguugca

SEQ ID NO: 13932 - RNA, 20 nt, Artificial Sequence
  MKO10013932_A_Denr
  gRNA
agucuguucauuaccaacag

SEQ ID NO: 13933 - RNA, 20 nt, Artificial Sequence
  MKO10013933_A_Depdc1a
  gRNA
augacaacaaucaacuauuc

SEQ ID NO: 13934 - RNA, 20 nt, Artificial Sequence
  MKO10013934_A_Depdc1a
  gRNA
uucuuaccagcuugguggcc

SEQ ID NO: 13935 - RNA, 20 nt, Artificial Sequence
  MKO10013935_A_Depdc1a
  gRNA
caaugauagcauggagcguc

SEQ ID NO: 13936 - RNA, 20 nt, Artificial Sequence
  MKO10013936_A_Depdc1b
  gRNA
uccagugaggccgauuguga

SEQ ID NO: 13937 - RNA, 20 nt, Artificial Sequence
  MKO10013937_A_Depdc1b
  gRNA
ugcugacacuguacacguua

SEQ ID NO: 13938 - RNA, 20 nt, Artificial Sequence
  MKO10013938_A_Depdc1b
  gRNA
acuuacucgacuugucgucc

SEQ ID NO: 13939 - RNA, 20 nt, Artificial Sequence
  MKO10013939_A_Depdc5
  gRNA
cucaccccaaugaugaguac

SEQ ID NO: 13940 - RNA, 20 nt, Artificial Sequence
  MKO10013940_A_Depdc5
  gRNA
uuugcaagucaagucgcuua

SEQ ID NO: 13941 - RNA, 20 nt, Artificial Sequence
  MKO10013941_A_Depdc5
  gRNA
ugcucaccuguacucaucau

SEQ ID NO: 13942 - RNA, 20 nt, Artificial Sequence
  MKO10013942_A_Depdc7
  gRNA
caacgacugcuucgucggcu

SEQ ID NO: 13943 - RNA, 20 nt, Artificial Sequence
  MKO10013943_A_Depdc7
  gRNA
cgauauuccucgggccaaag

SEQ ID NO: 13944 - RNA, 20 nt, Artificial Sequence
  MKO10013944_A_Depdc7
  gRNA
uccucgauccagauaguugc

SEQ ID NO: 13945 - RNA, 20 nt, Artificial Sequence
  MKO10013945_A_Deptor
  gRNA
cuucauggcauccgaauucc

SEQ ID NO: 13946 - RNA, 20 nt, Artificial Sequence
  MKO10013946_A_Deptor
  gRNA
ucaugcagaaauuagccgac

SEQ ID NO: 13947 - RNA, 20 nt, Artificial Sequence
  MKO10013947_A_Deptor
  gRNA
uugcaaaagagcugauugac

SEQ ID NO: 13948 - RNA, 20 nt, Artificial Sequence
  MKO10013948_A_Dera
  gRNA
cgacgcugugaaggcgcuga

SEQ ID NO: 13949 - RNA, 20 nt, Artificial Sequence
  MKO10013949_A_Dera
  gRNA
auaacagagucguugaacgu

SEQ ID NO: 13950 - RNA, 20 nt, Artificial Sequence
  MKO10013950_A_Dera
  gRNA
auagaucuuaccacgcuuuc

SEQ ID NO: 13951 - RNA, 20 nt, Artificial Sequence
  MKO10013951_A_Derl1
  gRNA
ucaugucagugcucuacguc

SEQ ID NO: 13952 - RNA, 20 nt, Artificial Sequence
  MKO10013952_A_Derl1
  gRNA
caagauuacuggcuuagcaa

SEQ ID NO: 13953 - RNA, 20 nt, Artificial Sequence
  MKO10013953_A_Derl1
  gRNA
ucuuauaucaguauucuacu

SEQ ID NO: 13954 - RNA, 20 nt, Artificial Sequence
  MKO10013954_A_Derl2
  gRNA
caaagucugcuguccgaccu

SEQ ID NO: 13955 - RNA, 20 nt, Artificial Sequence
  MKO10013955_A_Derl2
  gRNA
cuucuagcauucgacaauaa

SEQ ID NO: 13956 - RNA, 20 nt, Artificial Sequence
  MKO10013956_A_Derl2
  gRNA
guagaccagcauuauuguaa

SEQ ID NO: 13957 - RNA, 20 nt, Artificial Sequence
  MKO10013957_A_Derl3
  gRNA
gccgucgcagcccucacgug

SEQ ID NO: 13958 - RNA, 20 nt, Artificial Sequence
  MKO10013958_A_Derl3
  gRNA
aagaaguugacccucacgug

SEQ ID NO: 13959 - RNA, 20 nt, Artificial Sequence
  MKO10013959_A_Derl3
  gRNA
ggugcggguugaaguagagc

SEQ ID NO: 13960 - RNA, 20 nt, Artificial Sequence
  MKO10013960_A_Desi1
  gRNA
gccacucaccgggguacagc

SEQ ID NO: 13961 - RNA, 20 nt, Artificial Sequence
  MKO10013961_A_Desi1
  gRNA
gcaggucggugauguaagaa

SEQ ID NO: 13962 - RNA, 20 nt, Artificial Sequence
  MKO10013962_A_Desi1
  gRNA
cugcgccacuucauugcuaa

SEQ ID NO: 13963 - RNA, 20 nt, Artificial Sequence
  MKO10013963_A_Desi2
  gRNA
agauuccucgcuggaucaac

SEQ ID NO: 13964 - RNA, 20 nt, Artificial Sequence
  MKO10013964_A_Desi2
  gRNA
ugcagccgcauccagugcca

SEQ ID NO: 13965 - RNA, 20 nt, Artificial Sequence
  MKO10013965_A_Desi2
  gRNA
cauucuggaauugaaguaua

SEQ ID NO: 13966 - RNA, 20 nt, Artificial Sequence
  MKO10013966_A_Des
  gRNA
cagaaucgaaucccucaacg

SEQ ID NO: 13967 - RNA, 20 nt, Artificial Sequence
  MKO10013967_A_Des
  gRNA
agagauguucuuagccgcga

SEQ ID NO: 13968 - RNA, 20 nt, Artificial Sequence
  MKO10013968_A_Des
  gRNA
cacucuagcucguauugacc

SEQ ID NO: 13969 - RNA, 20 nt, Artificial Sequence
  MKO10013969_A_Det1
  gRNA
gcaauaaaguagcgcccguc

SEQ ID NO: 13970 - RNA, 20 nt, Artificial Sequence
  MKO10013970_A_Det1
  gRNA
gaugguucgaacgucgauaa

SEQ ID NO: 13971 - RNA, 20 nt, Artificial Sequence
  MKO10013971_A_Det1
  gRNA
ccacacagugcgacgccucg

SEQ ID NO: 13972 - RNA, 20 nt, Artificial Sequence
  MKO10013972_A_Dexi
  gRNA
ucagagcuugacgucuucga

SEQ ID NO: 13973 - RNA, 20 nt, Artificial Sequence
  MKO10013973_A_Dexi
  gRNA
gaccaggcgcugguggaccu

SEQ ID NO: 13974 - RNA, 20 nt, Artificial Sequence
  MKO10013974_A_Dexi
  gRNA
aguccucgggcaggaagacg

SEQ ID NO: 13975 - RNA, 20 nt, Artificial Sequence
  MKO10013975_A_Dffa
  gRNA
caacgccacaaacuucguau

SEQ ID NO: 13976 - RNA, 20 nt, Artificial Sequence
  MKO10013976_A_Dffa
  gRNA
cugccacgccgugcugaucg

SEQ ID NO: 13977 - RNA, 20 nt, Artificial Sequence
  MKO10013977_A_Dffa
  gRNA
ccccagacccggacgauguc

SEQ ID NO: 13978 - RNA, 20 nt, Artificial Sequence
  MKO10013978_A_Dffb
  gRNA
ucucgccagcggugagcaau

SEQ ID NO: 13979 - RNA, 20 nt, Artificial Sequence
  MKO10013979_A_Dffb
  gRNA
cagguuuggagucgagauuc

SEQ ID NO: 13980 - RNA, 20 nt, Artificial Sequence
  MKO10013980_A_Dffb
  gRNA
gagcuccuauugcucaccgc

SEQ ID NO: 13981 - RNA, 20 nt, Artificial Sequence
  MKO10013981_A_Dfna5
  gRNA
ucccaauagccccgcucuua

SEQ ID NO: 13982 - RNA, 20 nt, Artificial Sequence
  MKO10013982_A_Dfna5
  gRNA
cacggacaccaauguagugc

SEQ ID NO: 13983 - RNA, 20 nt, Artificial Sequence
  MKO10013983_A_Dfna5
  gRNA
cuuaccucuugacggcaucc

SEQ ID NO: 13984 - RNA, 20 nt, Artificial Sequence
  MKO10013984_A_Dfnb59
  gRNA
acucaccgaaggcaccgucc

SEQ ID NO: 13985 - RNA, 20 nt, Artificial Sequence
  MKO10013985_A_Dfnb59
  gRNA
caaccauauugugaaugacg

SEQ ID NO: 13986 - RNA, 20 nt, Artificial Sequence
  MKO10013986_A_Dfnb59
  gRNA
aaaugaagcuuugacugcga

SEQ ID NO: 13987 - RNA, 20 nt, Artificial Sequence
  MKO10013987_A_Dgau1
  gRNA
auuucagauugagaagcgcc

SEQ ID NO: 13988 - RNA, 20 nt, Artificial Sequence
  MKO10013988_A_Dgau1
  gRNA
ccugccccaugcgugauuau

SEQ ID NO: 13989 - RNA, 20 nt, Artificial Sequence
  MKO10013989_A_Dgau1
  gRNA
gcaucaccacacaccaauuc

SEQ ID NO: 13990 - RNA, 20 nt, Artificial Sequence
  MKO10013990_A_Dgau2l6
  gRNA
gaaucgcucuugagccgccc

SEQ ID NO: 13991 - RNA, 20 nt, Artificial Sequence
  MKO10013991_A_Dgau2l6
  gRNA
gcgagacuaucugauguccu

SEQ ID NO: 13992 - RNA, 20 nt, Artificial Sequence
  MKO10013992_A_Dgau2l6
  gRNA
aucagauagucucgcacaaa

SEQ ID NO: 13993 - RNA, 20 nt, Artificial Sequence
  MKO10013993_A_Dgau2
  gRNA
cuucgcgaguaccugauguc

SEQ ID NO: 13994 - RNA, 20 nt, Artificial Sequence
  MKO10013994_A_Dgau2
  gRNA
aagguggcaggagaucgcag

SEQ ID NO: 13995 - RNA, 20 nt, Artificial Sequence
  MKO10013995_A_Dgau2
  gRNA
aaggcccuauuuggcuacgu

SEQ ID NO: 13996 - RNA, 20 nt, Artificial Sequence
  MKO10013996_A_Dgcr14
  gRNA
agagccacgcgugccgugca

SEQ ID NO: 13997 - RNA, 20 nt, Artificial Sequence
  MKO10013997_A_Dgcr14
  gRNA
cgcguggcucuaccaggcug

SEQ ID NO: 13998 - RNA, 20 nt, Artificial Sequence
  MKO10013998_A_Dgcr14
  gRNA
ggccgaggaaaacggagauu

SEQ ID NO: 13999 - RNA, 20 nt, Artificial Sequence
  MKO10013999_A_Dgcr2
  gRNA
aacuuacugcugaagcguac

SEQ ID NO: 14000 - RNA, 20 nt, Artificial Sequence
  MKO10014000_A_Dgcr2
  gRNA
gaccagccagagcggagcuu

SEQ ID NO: 14001 - RNA, 20 nt, Artificial Sequence
  MKO10014001_A_Dgcr2
  gRNA
cuaggacgaagcgcagcucc

SEQ ID NO: 14002 - RNA, 20 nt, Artificial Sequence
  MKO10014002_A_Dgcr6
  gRNA
caagucgcugagcguggugu

SEQ ID NO: 14003 - RNA, 20 nt, Artificial Sequence
  MKO10014003_A_Dgcr6
  gRNA
ccuggcgcugcucgacggaa

SEQ ID NO: 14004 - RNA, 20 nt, Artificial Sequence
  MKO10014004_A_Dgcr6
  gRNA
cuacgugaccaccaauccuc

SEQ ID NO: 14005 - RNA, 20 nt, Artificial Sequence
  MKO10014005_A_Dgcr8
  gRNA
aguucaaccgugagaugaag

SEQ ID NO: 14006 - RNA, 20 nt, Artificial Sequence
  MKO10014006_A_Dgcr8
  gRNA
ccugcacagagagucucgag

SEQ ID NO: 14007 - RNA, 20 nt, Artificial Sequence
  MKO10014007_A_Dgcr8
  gRNA
caacucugcagaccgaccca

SEQ ID NO: 14008 - RNA, 20 nt, Artificial Sequence
  MKO10014008_A_Dgka
  gRNA
cagccgcaacuugacuagua

SEQ ID NO: 14009 - RNA, 20 nt, Artificial Sequence
  MKO10014009_A_Dgka
  gRNA
caguacaucgcugacccuuu

SEQ ID NO: 14010 - RNA, 20 nt, Artificial Sequence
  MKO10014010_A_Dgka
  gRNA
cuuccauacuagucaaguug

SEQ ID NO: 14011 - RNA, 20 nt, Artificial Sequence
  MKO10014011_A_Dgkb
  gRNA
uuucgccuuuaugacaccga

SEQ ID NO: 14012 - RNA, 20 nt, Artificial Sequence
  MKO10014012_A_Dgkb
  gRNA
cguacacucgagcuuauccu

SEQ ID NO: 14013 - RNA, 20 nt, Artificial Sequence
  MKO10014013_A_Dgkb
  gRNA
cauucccaucggugucauaa

SEQ ID NO: 14014 - RNA, 20 nt, Artificial Sequence
  MKO10014014_A_Dgkd
  gRNA
acucguuccagcgauccaag

SEQ ID NO: 14015 - RNA, 20 nt, Artificial Sequence
  MKO10014015_A_Dgkd
  gRNA
uucacgacacacauugcaau

SEQ ID NO: 14016 - RNA, 20 nt, Artificial Sequence
  MKO10014016_A_Dgkd
  gRNA
aagcuuaaaguaccuccucu

SEQ ID NO: 14017 - RNA, 20 nt, Artificial Sequence
  MKO10014017_A_Dgke
  gRNA
guuaguuccacuacgagagu

SEQ ID NO: 14018 - RNA, 20 nt, Artificial Sequence
  MKO10014018_A_Dgke
  gRNA
guccacgacgagugcaugcg

SEQ ID NO: 14019 - RNA, 20 nt, Artificial Sequence
  MKO10014019_A_Dgke
  gRNA
auccuagccaacucucguag

SEQ ID NO: 14020 - RNA, 20 nt, Artificial Sequence
  MKO10014020_A_Dgkg
  gRNA
ugcucccguaguguaccuga

SEQ ID NO: 14021 - RNA, 20 nt, Artificial Sequence
  MKO10014021_A_Dgkg
  gRNA
aguaacacacgacauccuuc

SEQ ID NO: 14022 - RNA, 20 nt, Artificial Sequence
  MKO10014022_A_Dgkg
  gRNA
cuacugcuggcccccuccuu

SEQ ID NO: 14023 - RNA, 20 nt, Artificial Sequence
  MKO10014023_A_Dgkh
  gRNA
accuaccguaaagcuguugu

SEQ ID NO: 14024 - RNA, 20 nt, Artificial Sequence
  MKO10014024_A_Dgkh
  gRNA
cuuucgcauaauaaagugug

SEQ ID NO: 14025 - RNA, 20 nt, Artificial Sequence
  MKO10014025_A_Dgkh
  gRNA
ugugcuugcuuccgcaacac

SEQ ID NO: 14026 - RNA, 20 nt, Artificial Sequence
  MKO10014026_A_Dgki
  gRNA
uguggcuaacgguccagcga

SEQ ID NO: 14027 - RNA, 20 nt, Artificial Sequence
  MKO10014027_A_Dgki
  gRNA
gugugccgucugcaaaaucg

SEQ ID NO: 14028 - RNA, 20 nt, Artificial Sequence
  MKO10014028_A_Dgki
  gRNA
uguuguagaaauccgcucuc

SEQ ID NO: 14029 - RNA, 20 nt, Artificial Sequence
  MKO10014029_A_Dgkk
  gRNA
gguauuccaguaguaauccc

SEQ ID NO: 14030 - RNA, 20 nt, Artificial Sequence
  MKO10014030_A_Dgkk
  gRNA
cgagaugccgucaccuguga

SEQ ID NO: 14031 - RNA, 20 nt, Artificial Sequence
  MKO10014031_A_Dgkk
  gRNA
ccugacggauuucuccuugu

SEQ ID NO: 14032 - RNA, 20 nt, Artificial Sequence
  MKO10014032_A_Dgkq
  gRNA
gcacugacgacagucgcugc

SEQ ID NO: 14033 - RNA, 20 nt, Artificial Sequence
  MKO10014033_A_Dgkq
  gRNA
guacccgcauuccgcuguga

SEQ ID NO: 14034 - RNA, 20 nt, Artificial Sequence
  MKO10014034_A_Dgkq
  gRNA
cgacugucgucagugccacc

SEQ ID NO: 14035 - RNA, 20 nt, Artificial Sequence
  MKO10014035_A_Dgkz
  gRNA
aagccguccuuccgcgaauc

SEQ ID NO: 14036 - RNA, 20 nt, Artificial Sequence
  MKO10014036_A_Dgkz
  gRNA
acuuaccucacggacauucc

SEQ ID NO: 14037 - RNA, 20 nt, Artificial Sequence
  MKO10014037_A_Dgkz
  gRNA
ugguuugagaccaacguguc

SEQ ID NO: 14038 - RNA, 20 nt, Artificial Sequence
  MKO10014038_A_Dguok
  gRNA
uccacgagcgcguuccgcag

SEQ ID NO: 14039 - RNA, 20 nt, Artificial Sequence
  MKO10014039_A_Dguok
  gRNA
acgcucggagacgacgcaga

SEQ ID NO: 14040 - RNA, 20 nt, Artificial Sequence
  MKO10014040_A_Dguok
  gRNA
caucgaguggcacaucuauc

SEQ ID NO: 14041 - RNA, 20 nt, Artificial Sequence
  MKO10014041_A_Dhcr24
  gRNA
cugucuacagauuguucgag

SEQ ID NO: 14042 - RNA, 20 nt, Artificial Sequence
  MKO10014042_A_Dhcr24
  gRNA
accuguucuaugccgugccc

SEQ ID NO: 14043 - RNA, 20 nt, Artificial Sequence
  MKO10014043_A_Dhcr24
  gRNA
ugccgagauccggaucaucc

SEQ ID NO: 14044 - RNA, 20 nt, Artificial Sequence
  MKO10014044_A_Dhcr7
  gRNA
guccacguucgcaaugauca

SEQ ID NO: 14045 - RNA, 20 nt, Artificial Sequence
  MKO10014045_A_Dhcr7
  gRNA
gcccuugaucauugcgaacg

SEQ ID NO: 14046 - RNA, 20 nt, Artificial Sequence
  MKO10014046_A_Dhcr7
  gRNA
agucaaaccacuucccgaug

SEQ ID NO: 14047 - RNA, 20 nt, Artificial Sequence
  MKO10014047_A_Dhdds
  gRNA
cauuaugaacgcgauauguu

SEQ ID NO: 14048 - RNA, 20 nt, Artificial Sequence
  MKO10014048_A_Dhdds
  gRNA
gaagauugcgcaugccaucc

SEQ ID NO: 14049 - RNA, 20 nt, Artificial Sequence
  MKO10014049_A_Dhdds
  gRNA
cagaccuuguuccacgcccc

SEQ ID NO: 14050 - RNA, 20 nt, Artificial Sequence
  MKO10014050_A_Dhdh
  gRNA
aacuaucggagaccuacgag

SEQ ID NO: 14051 - RNA, 20 nt, Artificial Sequence
  MKO10014051_A_Dhdh
  gRNA
cccaacacagcguaugugag

SEQ ID NO: 14052 - RNA, 20 nt, Artificial Sequence
  MKO10014052_A_Dhdh
  gRNA
accacucacauacgcugugu

SEQ ID NO: 14053 - RNA, 20 nt, Artificial Sequence
  MKO10014053_A_Dhfr
  gRNA
cggaggcaguucuguuuacc

SEQ ID NO: 14054 - RNA, 20 nt, Artificial Sequence
  MKO10014054_A_Dhfr
  gRNA
ucuacuuuacuugccaauuc

SEQ ID NO: 14055 - RNA, 20 nt, Artificial Sequence
  MKO10014055_A_Dhfr
  gRNA
ugagaagaaucgaccuuuaa

SEQ ID NO: 14056 - RNA, 20 nt, Artificial Sequence
  MKO10014056_A_Dhh
  gRNA
gcuugcgcacauaacgccgc

SEQ ID NO: 14057 - RNA, 20 nt, Artificial Sequence
  MKO10014057_A_Dhh
  gRNA
uaccagcuuugaccgauacg

SEQ ID NO: 14058 - RNA, 20 nt, Artificial Sequence
  MKO10014058_A_Dhh
  gRNA
uucgcgcgccgcuuacgugc

SEQ ID NO: 14059 - RNA, 20 nt, Artificial Sequence
  MKO10014059_A_Dhodh
  gRNA
ucagguacucggcguagaaa

SEQ ID NO: 14060 - RNA, 20 nt, Artificial Sequence
  MKO10014060_A_Dhodh
  gRNA
ccuuccucgagcuacguuuc

SEQ ID NO: 14061 - RNA, 20 nt, Artificial Sequence
  MKO10014061_A_Dhodh
  gRNA
uguggacggacucuauaagc

SEQ ID NO: 14062 - RNA, 20 nt, Artificial Sequence
  MKO10014062_A_Dhps
  gRNA
ccaccauguugugcugcacg

SEQ ID NO: 14063 - RNA, 20 nt, Artificial Sequence
  MKO10014063_A_Dhps
  gRNA
auaccucgugcagcacaaca

SEQ ID NO: 14064 - RNA, 20 nt, Artificial Sequence
  MKO10014064_A_Dhps
  gRNA
ccgaccacagguggauguau

SEQ ID NO: 14065 - RNA, 20 nt, Artificial Sequence
  MKO10014065_A_Dhrs11
  gRNA
gaacauguccuuccauccgc

SEQ ID NO: 14066 - RNA, 20 nt, Artificial Sequence
  MKO10014066_A_Dhrs11
  gRNA
ccagacccauauccgggcca

SEQ ID NO: 14067 - RNA, 20 nt, Artificial Sequence
  MKO10014067_A_Dhrs11
  gRNA
gccucaccguggcccggaua

SEQ ID NO: 14068 - RNA, 20 nt, Artificial Sequence
  MKO10014068_A_Dhrs13
  gRNA
ucgucucgacuucacacguc

SEQ ID NO: 14069 - RNA, 20 nt, Artificial Sequence
  MKO10014069_A_Dhrs13
  gRNA
caccugacggaggucgaaag

SEQ ID NO: 14070 - RNA, 20 nt, Artificial Sequence
  MKO10014070_A_Dhrs13
  gRNA
caucuuuccgaugccgcuau

SEQ ID NO: 14071 - RNA, 20 nt, Artificial Sequence
  MKO10014071_A_Dhrs1
  gRNA
cuccgugacgccguagcuca

SEQ ID NO: 14072 - RNA, 20 nt, Artificial Sequence
  MKO10014072_A_Dhrs1
  gRNA
cccgaucuacuugcucgaac

SEQ ID NO: 14073 - RNA, 20 nt, Artificial Sequence
  MKO10014073_A_Dhrs1
  gRNA
gcacggcugauggugccagc

SEQ ID NO: 14074 - RNA, 20 nt, Artificial Sequence
  MKO10014074_A_Dhrs2
  gRNA
aaggggaggcagcguuguuc

SEQ ID NO: 14075 - RNA, 20 nt, Artificial Sequence
  MKO10014075_A_Dhrs2
  gRNA
caaugcccccagaaugcuuc

SEQ ID NO: 14076 - RNA, 20 nt, Artificial Sequence
  MKO10014076_A_Dhrs2
  gRNA
ugaagcugugaccauauuga

SEQ ID NO: 14077 - RNA, 20 nt, Artificial Sequence
  MKO10014077_A_Dhrs3
  gRNA
gcaucggacgccaccucgcu

SEQ ID NO: 14078 - RNA, 20 nt, Artificial Sequence
  MKO10014078_A_Dhrs3
  gRNA
gcucugcgaacucccgagcg

SEQ ID NO: 14079 - RNA, 20 nt, Artificial Sequence
  MKO10014079_A_Dhrs3
  gRNA
ggcacacaauauggccguuc

SEQ ID NO: 14080 - RNA, 20 nt, Artificial Sequence
  MKO10014080_A_Dhrs4
  gRNA
cuaggcucugaagcgucacc

SEQ ID NO: 14081 - RNA, 20 nt, Artificial Sequence
  MKO10014081_A_Dhrs4
  gRNA
ggcugaagauggggcccacg

SEQ ID NO: 14082 - RNA, 20 nt, Artificial Sequence
  MKO10014082_A_Dhrs4
  gRNA
gacuggcaucgugugccacg

SEQ ID NO: 14083 - RNA, 20 nt, Artificial Sequence
  MKO10014083_A_Dhrs7b
  gRNA
accuuugaccucgcggaucc

SEQ ID NO: 14084 - RNA, 20 nt, Artificial Sequence
  MKO10014084_A_Dhrs7b
  gRNA
gcugcagaggauccgcucaa

SEQ ID NO: 14085 - RNA, 20 nt, Artificial Sequence
  MKO10014085_A_Dhrs7b
  gRNA
uccucacaugccgaucggaa

SEQ ID NO: 14086 - RNA, 20 nt, Artificial Sequence
  MKO10014086_A_Dhrs7c
  gRNA
gacuuacaagcugugcggaa

SEQ ID NO: 14087 - RNA, 20 nt, Artificial Sequence
  MKO10014087_A_Dhrs7c
  gRNA
aggccccuucacuuucacgc

SEQ ID NO: 14088 - RNA, 20 nt, Artificial Sequence
  MKO10014088_A_Dhrs7c
  gRNA
cuuugacugccuccgagccg

SEQ ID NO: 14089 - RNA, 20 nt, Artificial Sequence
  MKO10014089_A_Dhrs7
  gRNA
auuggccgagcucacuaugg

SEQ ID NO: 14090 - RNA, 20 nt, Artificial Sequence
  MKO10014090_A_Dhrs7
  gRNA
agccaccaaagccguucugc

SEQ ID NO: 14091 - RNA, 20 nt, Artificial Sequence
  MKO10014091_A_Dhrs7
  gRNA
gaccgauacaaguucccaug

SEQ ID NO: 14092 - RNA, 20 nt, Artificial Sequence
  MKO10014092_A_Dhrs9
  gRNA
cccauugaaguuaaccuguu

SEQ ID NO: 14093 - RNA, 20 nt, Artificial Sequence
  MKO10014093_A_Dhrs9
  gRNA
gaaacccuccacugcguauu

SEQ ID NO: 14094 - RNA, 20 nt, Artificial Sequence
  MKO10014094_A_Dhrs9
  gRNA
gagacuccacaccgugcuuc

SEQ ID NO: 14095 - RNA, 20 nt, Artificial Sequence
  MKO10014095_A_Dhrsx
  gRNA
gcaucgggcguagcaccgcg

SEQ ID NO: 14096 - RNA, 20 nt, Artificial Sequence
  MKO10014096_A_Dhrsx
  gRNA
cuccccgccuugcgcgcguc

SEQ ID NO: 14097 - RNA, 20 nt, Artificial Sequence
  MKO10014097_A_Dhrsx
  gRNA
cauacacucaccgcccguga

SEQ ID NO: 14098 - RNA, 20 nt, Artificial Sequence
  MKO10014098_A_Dhtkd1
  gRNA
gaugucgguuauaccgccau

SEQ ID NO: 14099 - RNA, 20 nt, Artificial Sequence
  MKO10014099_A_Dhtkd1
  gRNA
cugauguuccguaaaaugcg

SEQ ID NO: 14100 - RNA, 20 nt, Artificial Sequence
  MKO10014100_A_Dhtkd1
  gRNA
accgccguaucucuucaccg

SEQ ID NO: 14101 - RNA, 20 nt, Artificial Sequence
  MKO10014101_A_Dhx15
  gRNA
gaguauaugcgauccuugcc

SEQ ID NO: 14102 - RNA, 20 nt, Artificial Sequence
  MKO10014102_A_Dhx15
  gRNA
cgugaccgagaacgugauag

SEQ ID NO: 14103 - RNA, 20 nt, Artificial Sequence
  MKO10014103_A_Dhx15
  gRNA
ggaaagaccgggaacgagau

SEQ ID NO: 14104 - RNA, 20 nt, Artificial Sequence
  MKO10014104_A_Dhx16
  gRNA
agcuccguaagaagucucgu

SEQ ID NO: 14105 - RNA, 20 nt, Artificial Sequence
  MKO10014105_A_Dhx16
  gRNA
ucaaguacaagcgacgugug

SEQ ID NO: 14106 - RNA, 20 nt, Artificial Sequence
  MKO10014106_A_Dhx16
  gRNA
uugccgaacccgcucugcaa

SEQ ID NO: 14107 - RNA, 20 nt, Artificial Sequence
  MKO10014107_A_Dhx29
  gRNA
cucugcuuaaaucuuuccga

SEQ ID NO: 14108 - RNA, 20 nt, Artificial Sequence
  MKO10014108_A_Dhx29
  gRNA
agcgaucucuggaagacugu

SEQ ID NO: 14109 - RNA, 20 nt, Artificial Sequence
  MKO10014109_A_Dhx29
  gRNA
accuccaugcaagaguguau

SEQ ID NO: 14110 - RNA, 20 nt, Artificial Sequence
  MKO10014110_A_Dhx30
  gRNA
gcaggacuaucccgauccuu

SEQ ID NO: 14111 - RNA, 20 nt, Artificial Sequence
  MKO10014111_A_Dhx30
  gRNA
cgagugcuagcugaucguuu

SEQ ID NO: 14112 - RNA, 20 nt, Artificial Sequence
  MKO10014112_A_Dhx30
  gRNA
aaccuucucaacagcgugau

SEQ ID NO: 14113 - RNA, 20 nt, Artificial Sequence
  MKO10014113_A_Dhx32
  gRNA
cgagcagcacgucagucgcc

SEQ ID NO: 14114 - RNA, 20 nt, Artificial Sequence
  MKO10014114_A_Dhx32
  gRNA
ugcauaucacgcccccgugc

SEQ ID NO: 14115 - RNA, 20 nt, Artificial Sequence
  MKO10014115_A_Dhx32
  gRNA
aaggcguaugacagacucga

SEQ ID NO: 14116 - RNA, 20 nt, Artificial Sequence
  MKO10014116_A_Dhx33
  gRNA
cugugugaauaguccgcuca

SEQ ID NO: 14117 - RNA, 20 nt, Artificial Sequence
  MKO10014117_A_Dhx33
  gRNA
gacucgaagcugcugcgaau

SEQ ID NO: 14118 - RNA, 20 nt, Artificial Sequence
  MKO10014118_A_Dhx33
  gRNA
ugugacccagccccgucgag

SEQ ID NO: 14119 - RNA, 20 nt, Artificial Sequence
  MKO10014119_A_Dhx34
  gRNA
cuugccccagguguucgaug

SEQ ID NO: 14120 - RNA, 20 nt, Artificial Sequence
  MKO10014120_A_Dhx34
  gRNA
cgacaauaaguauccccccg

SEQ ID NO: 14121 - RNA, 20 nt, Artificial Sequence
  MKO10014121_A_Dhx34
  gRNA
gagaccucagucacgaucga

SEQ ID NO: 14122 - RNA, 20 nt, Artificial Sequence
  MKO10014122_A_Dhx35
  gRNA
cgaugacugcaccgacccac

SEQ ID NO: 14123 - RNA, 20 nt, Artificial Sequence
  MKO10014123_A_Dhx35
  gRNA
uaucagaccguggugauugu

SEQ ID NO: 14124 - RNA, 20 nt, Artificial Sequence
  MKO10014124_A_Dhx35
  gRNA
ggucggugcagucaucgaag

SEQ ID NO: 14125 - RNA, 20 nt, Artificial Sequence
  MKO10014125_A_Dhx36
  gRNA
accugcaucucuauauaucg

SEQ ID NO: 14126 - RNA, 20 nt, Artificial Sequence
  MKO10014126_A_Dhx36
  gRNA
cccucgauauauagagaugc

SEQ ID NO: 14127 - RNA, 20 nt, Artificial Sequence
  MKO10014127_A_Dhx36
  gRNA
auucagaagcgcagauaucc

SEQ ID NO: 14128 - RNA, 20 nt, Artificial Sequence
  MKO10014128_A_Dhx37
  gRNA
caagcucccgauccucgccg

SEQ ID NO: 14129 - RNA, 20 nt, Artificial Sequence
  MKO10014129_A_Dhx37
  gRNA
cuugcuccucggcgaggauc

SEQ ID NO: 14130 - RNA, 20 nt, Artificial Sequence
  MKO10014130_A_Dhx37
  gRNA
ucaucucggccuccgauacu

SEQ ID NO: 14131 - RNA, 20 nt, Artificial Sequence
  MKO10014131_A_Dhx38
  gRNA
accucgcucagagucccgau

SEQ ID NO: 14132 - RNA, 20 nt, Artificial Sequence
  MKO10014132_A_Dhx38
  gRNA
ucaccugucucgaucccgag

SEQ ID NO: 14133 - RNA, 20 nt, Artificial Sequence
  MKO10014133_A_Dhx38
  gRNA
auaccuuugggccgaugucg

SEQ ID NO: 14134 - RNA, 20 nt, Artificial Sequence
  MKO10014134_A_Dhx40
  gRNA
aacucguuccucaucguuac

SEQ ID NO: 14135 - RNA, 20 nt, Artificial Sequence
  MKO10014135_A_Dhx40
  gRNA
ugccccauauuugauauacc

SEQ ID NO: 14136 - RNA, 20 nt, Artificial Sequence
  MKO10014136_A_Dhx40
  gRNA
aacccucugagcaacugaua

SEQ ID NO: 14137 - RNA, 20 nt, Artificial Sequence
  MKO10014137_A_Dhx57
  gRNA
uucuccacgauaauugaugc

SEQ ID NO: 14138 - RNA, 20 nt, Artificial Sequence
  MKO10014138_A_Dhx57
  gRNA
uugugucgucaucagcguca

SEQ ID NO: 14139 - RNA, 20 nt, Artificial Sequence
  MKO10014139_A_Dhx57
  gRNA
uaaugaccuggacgggcgcu

SEQ ID NO: 14140 - RNA, 20 nt, Artificial Sequence
  MKO10014140_A_Dhx58
  gRNA
ccucuagcuuugugcgaauu

SEQ ID NO: 14141 - RNA, 20 nt, Artificial Sequence
  MKO10014141_A_Dhx58
  gRNA
ccuggugagccagcacgccg

SEQ ID NO: 14142 - RNA, 20 nt, Artificial Sequence
  MKO10014142_A_Dhx58
  gRNA
cccagaauucucgcugauug

SEQ ID NO: 14143 - RNA, 20 nt, Artificial Sequence
  MKO10014143_A_Dhx8
  gRNA
ggcccccguacccgagcuga

SEQ ID NO: 14144 - RNA, 20 nt, Artificial Sequence
  MKO10014144_A_Dhx8
  gRNA
gcuuuaaugcccagcgcagc

SEQ ID NO: 14145 - RNA, 20 nt, Artificial Sequence
  MKO10014145_A_Dhx8
  gRNA
uuucucuuggccugcugcgc

SEQ ID NO: 14146 - RNA, 20 nt, Artificial Sequence
  MKO10014146_A_Dhx9
  gRNA
agugguccucccauuggugc

SEQ ID NO: 14147 - RNA, 20 nt, Artificial Sequence
  MKO10014147_A_Dhx9
  gRNA
aucuuaaagguucgaguaga

SEQ ID NO: 14148 - RNA, 20 nt, Artificial Sequence
  MKO10014148_A_Dhx9
  gRNA
cagagacuuuguuaacuauu

SEQ ID NO: 14149 - RNA, 20 nt, Artificial Sequence
  MKO10014149_A_Diablo
  gRNA
gauugcuucaaucagcgcgu

SEQ ID NO: 14150 - RNA, 20 nt, Artificial Sequence
  MKO10014150_A_Diablo
  gRNA
gagaccuaccuuaguauacu

SEQ ID NO: 14151 - RNA, 20 nt, Artificial Sequence
  MKO10014151_A_Diablo
  gRNA
caaguaaacuuguauauugu

SEQ ID NO: 14152 - RNA, 20 nt, Artificial Sequence
  MKO10014152_A_Diap1
  gRNA
agaaacuccucugcaucgua

SEQ ID NO: 14153 - RNA, 20 nt, Artificial Sequence
  MKO10014153_A_Diap1
  gRNA
gucaucuccguacgaugcag

SEQ ID NO: 14154 - RNA, 20 nt, Artificial Sequence
  MKO10014154_A_Diap1
  gRNA
gcagcagccuuugcgagaga

SEQ ID NO: 14155 - RNA, 20 nt, Artificial Sequence
  MKO10014155_A_Diap2
  gRNA
cuaaaauccuucuuucgcaa

SEQ ID NO: 14156 - RNA, 20 nt, Artificial Sequence
  MKO10014156_A_Diap2
  gRNA
gaaagcuccuuugcgaaaga

SEQ ID NO: 14157 - RNA, 20 nt, Artificial Sequence
  MKO10014157_A_Diap2
  gRNA
uauguucaugaauuacgauc

SEQ ID NO: 14158 - RNA, 20 nt, Artificial Sequence
  MKO10014158_A_Diap3
  gRNA
ccauugcgggaaaaagacuu

SEQ ID NO: 14159 - RNA, 20 nt, Artificial Sequence
  MKO10014159_A_Diap3
  gRNA
ccccaccugaagacuguguc

SEQ ID NO: 14160 - RNA, 20 nt, Artificial Sequence
  MKO10014160_A_Diap3
  gRNA
aaguuaccucacaggaugac

SEQ ID NO: 14161 - RNA, 20 nt, Artificial Sequence
  MKO10014161_A_Dicer1
  gRNA
cgcugagacggcgacugacu

SEQ ID NO: 14162 - RNA, 20 nt, Artificial Sequence
  MKO10014162_A_Dicer1
  gRNA
cucagggaagacguucaucg

SEQ ID NO: 14163 - RNA, 20 nt, Artificial Sequence
  MKO10014163_A_Dicer1
  gRNA
ccccuaucgugaaauuauga

SEQ ID NO: 14164 - RNA, 20 nt, Artificial Sequence
  MKO10014164_A_Dido1
  gRNA
cgguagcgccaccgaugagc

SEQ ID NO: 14165 - RNA, 20 nt, Artificial Sequence
  MKO10014165_A_Dido1
  gRNA
uugccguccacugcggcgca

SEQ ID NO: 14166 - RNA, 20 nt, Artificial Sequence
  MKO10014166_A_Dido1
  gRNA
ucuacccucucaguacguuu

SEQ ID NO: 14167 - RNA, 20 nt, Artificial Sequence
  MKO10014167_A_Diexf
  gRNA
uaguacguacuuucaguugc

SEQ ID NO: 14168 - RNA, 20 nt, Artificial Sequence
  MKO10014168_A_Diexf
  gRNA
agugaacaagagcacguuuc

SEQ ID NO: 14169 - RNA, 20 nt, Artificial Sequence
  MKO10014169_A_Diexf
  gRNA
caagccgcagauuugucagc

SEQ ID NO: 14170 - RNA, 20 nt, Artificial Sequence
  MKO10014170_A_Dimt1
  gRNA
ucaggacucauguucaacac

SEQ ID NO: 14171 - RNA, 20 nt, Artificial Sequence
  MKO10014171_A_Dimt1
  gRNA
augaugcuguuaacaauuag

SEQ ID NO: 14172 - RNA, 20 nt, Artificial Sequence
  MKO10014172_A_Dimt1
  gRNA
acagucauauugccaguccc

SEQ ID NO: 14173 - RNA, 20 nt, Artificial Sequence
  MKO10014173_A_Dio1
  gRNA
gcggcuugugauauuccugc

SEQ ID NO: 14174 - RNA, 20 nt, Artificial Sequence
  MKO10014174_A_Dio1
  gRNA
ugagaggcucuacgugauac

SEQ ID NO: 14175 - RNA, 20 nt, Artificial Sequence
  MKO10014175_A_Dio1
  gRNA
cugcccgcacgcgcuccugg

SEQ ID NO: 14176 - RNA, 20 nt, Artificial Sequence
  MKO10014176_A_Dio2
  gRNA
gcgccuccacucuccgcgag

SEQ ID NO: 14177 - RNA, 20 nt, Artificial Sequence
  MKO10014177_A_Dio2
  gRNA
agccgcuccaaguccacucg

SEQ ID NO: 14178 - RNA, 20 nt, Artificial Sequence
  MKO10014178_A_Dio2
  gRNA
accuacaagaaguccgaagu

SEQ ID NO: 14179 - RNA, 20 nt, Artificial Sequence
  MKO10014179_A_Dio3
  gRNA
gggucccuugugcguagucg

SEQ ID NO: 14180 - RNA, 20 nt, Artificial Sequence
  MKO10014180_A_Dio3
  gRNA
ucgagguugguggucggaga

SEQ ID NO: 14181 - RNA, 20 nt, Artificial Sequence
  MKO10014181_A_Dio3
  gRNA
cgcauccucgacuacgcaca

SEQ ID NO: 14182 - RNA, 20 nt, Artificial Sequence
  MKO10014182_A_Dip2a
  gRNA
agcgguagcugccgucagca

SEQ ID NO: 14183 - RNA, 20 nt, Artificial Sequence
  MKO10014183_A_Dip2a
  gRNA
aucaauaccuggaggcgugu

SEQ ID NO: 14184 - RNA, 20 nt, Artificial Sequence
  MKO10014184_A_Dip2a
  gRNA
agugccuccacugcgcucgc

SEQ ID NO: 14185 - RNA, 20 nt, Artificial Sequence
  MKO10014185_A_Dip2b
  gRNA
gccaguuacagaugacgccc

SEQ ID NO: 14186 - RNA, 20 nt, Artificial Sequence
  MKO10014186_A_Dip2b
  gRNA
ccguaugugagaguguagac

SEQ ID NO: 14187 - RNA, 20 nt, Artificial Sequence
  MKO10014187_A_Dip2b
  gRNA
acccaaaagaccccccuuaa

SEQ ID NO: 14188 - RNA, 20 nt, Artificial Sequence
  MKO10014188_A_Dip2c
  gRNA
ggucucgagaugaacguuau

SEQ ID NO: 14189 - RNA, 20 nt, Artificial Sequence
  MKO10014189_A_Dip2c
  gRNA
acaggcgcccgucgcucuug

SEQ ID NO: 14190 - RNA, 20 nt, Artificial Sequence
  MKO10014190_A_Dip2c
  gRNA
gccuuccaaacgaagauccc

SEQ ID NO: 14191 - RNA, 20 nt, Artificial Sequence
  MKO10014191_A_Diras1
  gRNA
ugcugacgcucgagacgcgc

SEQ ID NO: 14192 - RNA, 20 nt, Artificial Sequence
  MKO10014192_A_Diras1
  gRNA
cugcgccgaacacgaccaca

SEQ ID NO: 14193 - RNA, 20 nt, Artificial Sequence
  MKO10014193_A_Diras1
  gRNA
ggugcacacgcgcgaggcgc

SEQ ID NO: 14194 - RNA, 20 nt, Artificial Sequence
  MKO10014194_A_Diras2
  gRNA
cggaacagagcaacgacuac

SEQ ID NO: 14195 - RNA, 20 nt, Artificial Sequence
  MKO10014195_A_Diras2
  gRNA
ugaugagagccccaaccgug

SEQ ID NO: 14196 - RNA, 20 nt, Artificial Sequence
  MKO10014196_A_Diras2
  gRNA
ugcucuucuugccgucgauc

SEQ ID NO: 14197 - RNA, 20 nt, Artificial Sequence
  MKO10014197_A_Dirc2
  gRNA
ggcgccgcauucaugacagu

SEQ ID NO: 14198 - RNA, 20 nt, Artificial Sequence
  MKO10014198_A_Dirc2
  gRNA
ggagcgugugcguuucucgu

SEQ ID NO: 14199 - RNA, 20 nt, Artificial Sequence
  MKO10014199_A_Dirc2
  gRNA
guaaccuacaaaagcuccgc

SEQ ID NO: 14200 - RNA, 20 nt, Artificial Sequence
  MKO10014200_A_Dis3l2
  gRNA
cgaagguucagcuuguaguc

SEQ ID NO: 14201 - RNA, 20 nt, Artificial Sequence
  MKO10014201_A_Dis3l2
  gRNA
gcucguaauagagccuuaaa

SEQ ID NO: 14202 - RNA, 20 nt, Artificial Sequence
  MKO10014202_A_Dis3l2
  gRNA
agugcuguuggugcuucgcc

SEQ ID NO: 14203 - RNA, 20 nt, Artificial Sequence
  MKO10014203_A_Dis3l
  gRNA
caaaucuggacgcuacaucc

SEQ ID NO: 14204 - RNA, 20 nt, Artificial Sequence
  MKO10014204_A_Dis3l
  gRNA
aaucuggccagaaguugucc

SEQ ID NO: 14205 - RNA, 20 nt, Artificial Sequence
  MKO10014205_A_Dis3l
  gRNA
aucuucugucaccauaacga

SEQ ID NO: 14206 - RNA, 20 nt, Artificial Sequence
  MKO10014206_A_Dis3
  gRNA
uguaccacuucgcugcgacu

SEQ ID NO: 14207 - RNA, 20 nt, Artificial Sequence
  MKO10014207_A_Dis3
  gRNA
ugcuuacuuguccgaugaaa

SEQ ID NO: 14208 - RNA, 20 nt, Artificial Sequence
  MKO10014208_A_Dis3
  gRNA
aaccuacaucgagcaagagc

SEQ ID NO: 14209 - RNA, 20 nt, Artificial Sequence
  MKO10014209_A_Disc1
  gRNA
ccggccgcacgaugcagggc

SEQ ID NO: 14210 - RNA, 20 nt, Artificial Sequence
  MKO10014210_A_Disc1
  gRNA
gaggauggcgauuacgauac

SEQ ID NO: 14211 - RNA, 20 nt, Artificial Sequence
  MKO10014211_A_Disc1
  gRNA
uucaacgccggugaugccag

SEQ ID NO: 14212 - RNA, 20 nt, Artificial Sequence
  MKO10014212_A_Disp1
  gRNA
ccguaguuacgcagcccugc

SEQ ID NO: 14213 - RNA, 20 nt, Artificial Sequence
  MKO10014213_A_Disp1
  gRNA
cagcagcggguccgagaagu

SEQ ID NO: 14214 - RNA, 20 nt, Artificial Sequence
  MKO10014214_A_Disp1
  gRNA
cgucugaccaucggucaucc

SEQ ID NO: 14215 - RNA, 20 nt, Artificial Sequence
  MKO10014215_A_Disp2
  gRNA
ggcccuaccucuucggcauc

SEQ ID NO: 14216 - RNA, 20 nt, Artificial Sequence
  MKO10014216_A_Disp2
  gRNA
ggcugugaucgugggguguc

SEQ ID NO: 14217 - RNA, 20 nt, Artificial Sequence
  MKO10014217_A_Disp2
  gRNA
caccccacgaucacagccac

SEQ ID NO: 14218 - RNA, 20 nt, Artificial Sequence
  MKO10014218_A_Dixdc1
  gRNA
caucucggagauccugucgc

SEQ ID NO: 14219 - RNA, 20 nt, Artificial Sequence
  MKO10014219_A_Dixdc1
  gRNA
accaacaaucucgaugagau

SEQ ID NO: 14220 - RNA, 20 nt, Artificial Sequence
  MKO10014220_A_Dixdc1
  gRNA
cgccuguaggaacgccagcg

SEQ ID NO: 14221 - RNA, 20 nt, Artificial Sequence
  MKO10014221_A_Dkc1
  gRNA
cauugaacgagccacucguu

SEQ ID NO: 14222 - RNA, 20 nt, Artificial Sequence
  MKO10014222_A_Dkc1
  gRNA
ucucuacccgaaguauucgu

SEQ ID NO: 14223 - RNA, 20 nt, Artificial Sequence
  MKO10014223_A_Dkc1
  gRNA
gcaacaucaucuucuuguaa

SEQ ID NO: 14224 - RNA, 20 nt, Artificial Sequence
  MKO10014224_A_Dkk1
  gRNA
uaaugaccacaacgccgccg

SEQ ID NO: 14225 - RNA, 20 nt, Artificial Sequence
  MKO10014225_A_Dkk1
  gRNA
gaucuguacaccuccgacgc

SEQ ID NO: 14226 - RNA, 20 nt, Artificial Sequence
  MKO10014226_A_Dkk1
  gRNA
gggcagguucuugaucgcgu

SEQ ID NO: 14227 - RNA, 20 nt, Artificial Sequence
  MKO10014227_A_Dkk2
  gRNA
cgaacccuucuugcguuguu

SEQ ID NO: 14228 - RNA, 20 nt, Artificial Sequence
  MKO10014228_A_Dkk2
  gRNA
ugccgccgaaagccaguccu

SEQ ID NO: 14229 - RNA, 20 nt, Artificial Sequence
  MKO10014229_A_Dkk2
  gRNA
auccuugacccgcaucagcg

SEQ ID NO: 14230 - RNA, 20 nt, Artificial Sequence
  MKO10014230_A_Dkk3
  gRNA
gauggucccauugccaccuu

SEQ ID NO: 14231 - RNA, 20 nt, Artificial Sequence
  MKO10014231_A_Dkk3
  gRNA
ggaccaucugugacaaccag

SEQ ID NO: 14232 - RNA, 20 nt, Artificial Sequence
  MKO10014232_A_Dkk3
  gRNA
aaaagaccaccuguccacuc

SEQ ID NO: 14233 - RNA, 20 nt, Artificial Sequence
  MKO10014233_A_Dkk4
  gRNA
ugacuucggcacguuagucc

SEQ ID NO: 14234 - RNA, 20 nt, Artificial Sequence
  MKO10014234_A_Dkk4
  gRNA
ccacgugccguagaguucgc

SEQ ID NO: 14235 - RNA, 20 nt, Artificial Sequence
  MKO10014235_A_Dkk4
  gRNA
uugcaagccaguucuacgag

SEQ ID NO: 14236 - RNA, 20 nt, Artificial Sequence
  MKO10014236_A_Dkkl1
  gRNA
gaaugaccugcuacgagacc

SEQ ID NO: 14237 - RNA, 20 nt, Artificial Sequence
  MKO10014237_A_Dkkl1
  gRNA
caccugcaaugugucgacug

SEQ ID NO: 14238 - RNA, 20 nt, Artificial Sequence
  MKO10014238_A_Dkkl1
  gRNA
agaaaagcgacaucgcaugc

SEQ ID NO: 14239 - RNA, 20 nt, Artificial Sequence
  MKO10014239_A_Dlau
  gRNA
cuaccgggagcgcuugcaga

SEQ ID NO: 14240 - RNA, 20 nt, Artificial Sequence
  MKO10014240_A_Dlau
  gRNA
agucuuaccugcauaugagu

SEQ ID NO: 14241 - RNA, 20 nt, Artificial Sequence
  MKO10014241_A_Dlau
  gRNA
gagaccgacaaggccaccau

SEQ ID NO: 14242 - RNA, 20 nt, Artificial Sequence
  MKO10014242_A_Dlc1
  gRNA
gaugagccuugcgccauaag

SEQ ID NO: 14243 - RNA, 20 nt, Artificial Sequence
  MKO10014243_A_Dlc1
  gRNA
ugcagcggauagucaaccag

SEQ ID NO: 14244 - RNA, 20 nt, Artificial Sequence
  MKO10014244_A_Dlc1
  gRNA
uugaccagcgcaauaucaau

SEQ ID NO: 14245 - RNA, 20 nt, Artificial Sequence
  MKO10014245_A_Dld
  gRNA
accuuaccuuaaagccuaac

SEQ ID NO: 14246 - RNA, 20 nt, Artificial Sequence
  MKO10014246_A_Dld
  gRNA
caugagauauccgauugaaa

SEQ ID NO: 14247 - RNA, 20 nt, Artificial Sequence
  MKO10014247_A_Dld
  gRNA
ugaucugcauaaguucuuaa

SEQ ID NO: 14248 - RNA, 20 nt, Artificial Sequence
  MKO10014248_A_Dlec1
  gRNA
uuucugcaauaucccgugca

SEQ ID NO: 14249 - RNA, 20 nt, Artificial Sequence
  MKO10014249_A_Dlec1
  gRNA
ugacgacuuugaguacaccg

SEQ ID NO: 14250 - RNA, 20 nt, Artificial Sequence
  MKO10014250_A_Dlec1
  gRNA
guguuaggcgggaaaaaccg

SEQ ID NO: 14251 - RNA, 20 nt, Artificial Sequence
  MKO10014251_A_Dleu7
  gRNA
cgaugcgcagcgcucuggcu

SEQ ID NO: 14252 - RNA, 20 nt, Artificial Sequence
  MKO10014252_A_Dleu7
  gRNA
gcgcaucgccauccgcgcca

SEQ ID NO: 14253 - RNA, 20 nt, Artificial Sequence
  MKO10014253_A_Dleu7
  gRNA
cuggaucaacuucuucacua

SEQ ID NO: 14254 - RNA, 20 nt, Artificial Sequence
  MKO10014254_A_Dlg1
  gRNA
cgcuccgccugugauaauuu

SEQ ID NO: 14255 - RNA, 20 nt, Artificial Sequence
  MKO10014255_A_Dlg1
  gRNA
cguaccgcaaucuuccaucc

SEQ ID NO: 14256 - RNA, 20 nt, Artificial Sequence
  MKO10014256_A_Dlg1
  gRNA
aagcucauuaaagguccuaa

SEQ ID NO: 14257 - RNA, 20 nt, Artificial Sequence
  MKO10014257_A_Dlg2
  gRNA
cccagauuacgcucgauuug

SEQ ID NO: 14258 - RNA, 20 nt, Artificial Sequence
  MKO10014258_A_Dlg2
  gRNA
gugaauggaaucgaucuucg

SEQ ID NO: 14259 - RNA, 20 nt, Artificial Sequence
  MKO10014259_A_Dlg2
  gRNA
gcacccuuaccuccgcuugc

SEQ ID NO: 14260 - RNA, 20 nt, Artificial Sequence
  MKO10014260_A_Dlg3
  gRNA
gggcccuguuugauuaugau

SEQ ID NO: 14261 - RNA, 20 nt, Artificial Sequence
  MKO10014261_A_Dlg3
  gRNA
uuugucucaccgauaagauc

SEQ ID NO: 14262 - RNA, 20 nt, Artificial Sequence
  MKO10014262_A_Dlg3
  gRNA
aaggggagaccggaucuuau

SEQ ID NO: 14263 - RNA, 20 nt, Artificial Sequence
  MKO10014263_A_Dlg4
  gRNA
guguccguguugacaaucac

SEQ ID NO: 14264 - RNA, 20 nt, Artificial Sequence
  MKO10014264_A_Dlg4
  gRNA
guugcaggugaacggaacag

SEQ ID NO: 14265 - RNA, 20 nt, Artificial Sequence
  MKO10014265_A_Dlg4
  gRNA
ucccccugugauugucaaca

SEQ ID NO: 14266 - RNA, 20 nt, Artificial Sequence
  MKO10014266_A_Dlg5
  gRNA
cgggccgccgcagucuacag

SEQ ID NO: 14267 - RNA, 20 nt, Artificial Sequence
  MKO10014267_A_Dlg5
  gRNA
gaaugagcuacgcaagcgcc

SEQ ID NO: 14268 - RNA, 20 nt, Artificial Sequence
  MKO10014268_A_Dlg5
  gRNA
ccaccauggagccgcagcgc

SEQ ID NO: 14269 - RNA, 20 nt, Artificial Sequence
  MKO10014269_A_Dlgap1
  gRNA
aucucgucgucuuucccgcg

SEQ ID NO: 14270 - RNA, 20 nt, Artificial Sequence
  MKO10014270_A_Dlgap1
  gRNA
acgacgaaugcgugucgcug

SEQ ID NO: 14271 - RNA, 20 nt, Artificial Sequence
  MKO10014271_A_Dlgap1
  gRNA
aagacgacgagaucccgugc

SEQ ID NO: 14272 - RNA, 20 nt, Artificial Sequence
  MKO10014272_A_Dlgap2
  gRNA
ggagcuacguuucauguacc

SEQ ID NO: 14273 - RNA, 20 nt, Artificial Sequence
  MKO10014273_A_Dlgap2
  gRNA
ugcgguaggccuccuuagcc

SEQ ID NO: 14274 - RNA, 20 nt, Artificial Sequence
  MKO10014274_A_Dlgap2
  gRNA
auugcugcaucuuaccagac

SEQ ID NO: 14275 - RNA, 20 nt, Artificial Sequence
  MKO10014275_A_Dlgap3
  gRNA
cggaaguggcggccguccau

SEQ ID NO: 14276 - RNA, 20 nt, Artificial Sequence
  MKO10014276_A_Dlgap3
  gRNA
auggggagauccccugccgc

SEQ ID NO: 14277 - RNA, 20 nt, Artificial Sequence
  MKO10014277_A_Dlgap3
  gRNA
acgcacccucgaguuggcac

SEQ ID NO: 14278 - RNA, 20 nt, Artificial Sequence
  MKO10014278_A_Dlgap4
  gRNA
caucgagauuuauguccccg

SEQ ID NO: 14279 - RNA, 20 nt, Artificial Sequence
  MKO10014279_A_Dlgap4
  gRNA
cugcuugucccccgcgucug

SEQ ID NO: 14280 - RNA, 20 nt, Artificial Sequence
  MKO10014280_A_Dlgap4
  gRNA
ggggcagcgaagacgccucc

SEQ ID NO: 14281 - RNA, 20 nt, Artificial Sequence
  MKO10014281_A_Dlgap5
  gRNA
cucuauagacccgcugcgcc

SEQ ID NO: 14282 - RNA, 20 nt, Artificial Sequence
  MKO10014282_A_Dlgap5
  gRNA
ccccuuagggucaguaaaaa

SEQ ID NO: 14283 - RNA, 20 nt, Artificial Sequence
  MKO10014283_A_Dlgap5
  gRNA
cagccugugcuguucacguc

SEQ ID NO: 14284 - RNA, 20 nt, Artificial Sequence
  MKO10014284_A_Dlk1
  gRNA
cgccccgagaugaucgcgac

SEQ ID NO: 14285 - RNA, 20 nt, Artificial Sequence
  MKO10014285_A_Dlk1
  gRNA
gcaaguuccauuguuggcgc

SEQ ID NO: 14286 - RNA, 20 nt, Artificial Sequence
  MKO10014286_A_Dlk1
  gRNA
uauuuacccauugaucacgc

SEQ ID NO: 14287 - RNA, 20 nt, Artificial Sequence
  MKO10014287_A_Dlk2
  gRNA
auuuaggcagcggcagccgc

SEQ ID NO: 14288 - RNA, 20 nt, Artificial Sequence
  MKO10014288_A_Dlk2
  gRNA
cccacaggugucuacacguc

SEQ ID NO: 14289 - RNA, 20 nt, Artificial Sequence
  MKO10014289_A_Dlk2
  gRNA
aggccaguguguguaugacg

SEQ ID NO: 14290 - RNA, 20 nt, Artificial Sequence
  MKO10014290_A_Dll1
  gRNA
gggucgaugccugcgccauc

SEQ ID NO: 14291 - RNA, 20 nt, Artificial Sequence
  MKO10014291_A_Dll1
  gRNA
ggaaccgcaacugcugccgc

SEQ ID NO: 14292 - RNA, 20 nt, Artificial Sequence
  MKO10014292_A_Dll1
  gRNA
ucucccgaugaccucgcaac

SEQ ID NO: 14293 - RNA, 20 nt, Artificial Sequence
  MKO10014293_A_Dll3
  gRNA
ugcacuucuccuaccgcgcg

SEQ ID NO: 14294 - RNA, 20 nt, Artificial Sequence
  MKO10014294_A_Dll3
  gRNA
ggccguagacgccuggcggc

SEQ ID NO: 14295 - RNA, 20 nt, Artificial Sequence
  MKO10014295_A_Dll3
  gRNA
gugugcccuuccgcgaugcu

SEQ ID NO: 14296 - RNA, 20 nt, Artificial Sequence
  MKO10014296_A_Dll4
  gRNA
ggcacucauaauguccgaag

SEQ ID NO: 14297 - RNA, 20 nt, Artificial Sequence
  MKO10014297_A_Dll4
  gRNA
guuggugcccaauaccggcg

SEQ ID NO: 14298 - RNA, 20 nt, Artificial Sequence
  MKO10014298_A_Dll4
  gRNA
aagaagcgcgaugaccacuu

SEQ ID NO: 14299 - RNA, 20 nt, Artificial Sequence
  MKO10014299_A_Dlst
  gRNA
guaaccugguccccgacaua

SEQ ID NO: 14300 - RNA, 20 nt, Artificial Sequence
  MKO10014300_A_Dlst
  gRNA
caacaggggaacugcccucu

SEQ ID NO: 14301 - RNA, 20 nt, Artificial Sequence
  MKO10014301_A_Dlst
  gRNA
gugacagacucugcaaacgc

SEQ ID NO: 14302 - RNA, 20 nt, Artificial Sequence
  MKO10014302_A_Dlx1
  gRNA
ggccgaacuguaggcaccgu

SEQ ID NO: 14303 - RNA, 20 nt, Artificial Sequence
  MKO10014303_A_Dlx1
  gRNA
gcugcugaccgaguugacgu

SEQ ID NO: 14304 - RNA, 20 nt, Artificial Sequence
  MKO10014304_A_Dlx1
  gRNA
ggaaaaagauccguaaaccc

SEQ ID NO: 14305 - RNA, 20 nt, Artificial Sequence
  MKO10014305_A_Dlx2
  gRNA
acuggugccguagggcgcgu

SEQ ID NO: 14306 - RNA, 20 nt, Artificial Sequence
  MKO10014306_A_Dlx2
  gRNA
gucguugaagggccgccagc

SEQ ID NO: 14307 - RNA, 20 nt, Artificial Sequence
  MKO10014307_A_Dlx2
  gRNA
aaaaucguccccgcgcucac

SEQ ID NO: 14308 - RNA, 20 nt, Artificial Sequence
  MKO10014308_A_Dlx3
  gRNA
aguagaucguucgcggcuuu

SEQ ID NO: 14309 - RNA, 20 nt, Artificial Sequence
  MKO10014309_A_Dlx3
  gRNA
cccguagguauauuccgacu

SEQ ID NO: 14310 - RNA, 20 nt, Artificial Sequence
  MKO10014310_A_Dlx3
  gRNA
gccguucaccaugcgaaccu

SEQ ID NO: 14311 - RNA, 20 nt, Artificial Sequence
  MKO10014311_A_Dlx4
  gRNA
uucccggggauaguccgagc

SEQ ID NO: 14312 - RNA, 20 nt, Artificial Sequence
  MKO10014312_A_Dlx4
  gRNA
accggggguggccguaggac

SEQ ID NO: 14313 - RNA, 20 nt, Artificial Sequence
  MKO10014313_A_Dlx4
  gRNA
uuuccagcacacccaauacc

SEQ ID NO: 14314 - RNA, 20 nt, Artificial Sequence
  MKO10014314_A_Dlx5
  gRNA
aagucgccggaucggaugcu

SEQ ID NO: 14315 - RNA, 20 nt, Artificial Sequence
  MKO10014315_A_Dlx5
  gRNA
guuacacgccauagggucgc

SEQ ID NO: 14316 - RNA, 20 nt, Artificial Sequence
  MKO10014316_A_Dlx5
  gRNA
cgccaugcaccacccgucuc

SEQ ID NO: 14317 - RNA, 20 nt, Artificial Sequence
  MKO10014317_A_Dlx6
  gRNA
guugccuccgcucgacgcgu

SEQ ID NO: 14318 - RNA, 20 nt, Artificial Sequence
  MKO10014318_A_Dlx6
  gRNA
ucgcccuacgcgucgagcgg

SEQ ID NO: 14319 - RNA, 20 nt, Artificial Sequence
  MKO10014319_A_Dlx6
  gRNA
acacgagagugacccccucc

SEQ ID NO: 14320 - RNA, 20 nt, Artificial Sequence
  MKO10014320_A_Dmap1
  gRNA
auagcgccguccuuucgagc

SEQ ID NO: 14321 - RNA, 20 nt, Artificial Sequence
  MKO10014321_A_Dmap1
  gRNA
gcuucguaguuauucacgau

SEQ ID NO: 14322 - RNA, 20 nt, Artificial Sequence
  MKO10014322_A_Dmap1
  gRNA
ccuccgccgcucgucgccag

SEQ ID NO: 14323 - RNA, 20 nt, Artificial Sequence
  MKO10014323_A_Dmbt1
  gRNA
uuaccguuauuugucccucc

SEQ ID NO: 14324 - RNA, 20 nt, Artificial Sequence
  MKO10014324_A_Dmbt1
  gRNA
uauuaaggcugguggaaucc

SEQ ID NO: 14325 - RNA, 20 nt, Artificial Sequence
  MKO10014325_A_Dmbt1
  gRNA
caaacagcuguucccacaga

SEQ ID NO: 14326 - RNA, 20 nt, Artificial Sequence
  MKO10014326_A_Dmbx1
  gRNA
ugcgacuccgacguuguuua

SEQ ID NO: 14327 - RNA, 20 nt, Artificial Sequence
  MKO10014327_A_Dmbx1
  gRNA
cccagcacgcccccgacuac

SEQ ID NO: 14328 - RNA, 20 nt, Artificial Sequence
  MKO10014328_A_Dmbx1
  gRNA
cccagcaccguaaacaacgu

SEQ ID NO: 14329 - RNA, 20 nt, Artificial Sequence
  MKO10014329_A_Dmc1
  gRNA
caaucccaugcuucugcaac

SEQ ID NO: 14330 - RNA, 20 nt, Artificial Sequence
  MKO10014330_A_Dmc1
  gRNA
uuggcuuacaauaagcuugu

SEQ ID NO: 14331 - RNA, 20 nt, Artificial Sequence
  MKO10014331_A_Dmc1
  gRNA
auggcaauuacagaagcuuu

SEQ ID NO: 14332 - RNA, 20 nt, Artificial Sequence
  MKO10014332_A_Dmd
  gRNA
aaaacgccuccuagaccucu

SEQ ID NO: 14333 - RNA, 20 nt, Artificial Sequence
  MKO10014333_A_Dmd
  gRNA
gugccuuguugacauuguuc

SEQ ID NO: 14334 - RNA, 20 nt, Artificial Sequence
  MKO10014334_A_Dmd
  gRNA
cagguugauuuagugaauau

SEQ ID NO: 14335 - RNA, 20 nt, Artificial Sequence
  MKO10014335_A_Dmgdh
  gRNA
uuaaauucguccacccuuac

SEQ ID NO: 14336 - RNA, 20 nt, Artificial Sequence
  MKO10014336_A_Dmgdh
  gRNA
ugauccuuauucucugacga

SEQ ID NO: 14337 - RNA, 20 nt, Artificial Sequence
  MKO10014337_A_Dmgdh
  gRNA
guagcaagccugauacuacc

SEQ ID NO: 14338 - RNA, 20 nt, Artificial Sequence
  MKO10014338_A_Dmkn
  gRNA
uaguauugccaguuguaagu

SEQ ID NO: 14339 - RNA, 20 nt, Artificial Sequence
  MKO10014339_A_Dmkn
  gRNA
auucaccuuggcaguggucu

SEQ ID NO: 14340 - RNA, 20 nt, Artificial Sequence
  MKO10014340_A_Dmkn
  gRNA
guacucaccgaggaagauga

SEQ ID NO: 14341 - RNA, 20 nt, Artificial Sequence
  MKO10014341_A_Dmp1
  gRNA
guugucaccccuggacucgc

SEQ ID NO: 14342 - RNA, 20 nt, Artificial Sequence
  MKO10014342_A_Dmp1
  gRNA
aaugaucuagggcccgaaga

SEQ ID NO: 14343 - RNA, 20 nt, Artificial Sequence
  MKO10014343_A_Dmp1
  gRNA
gugauacuuaccgugggugg

SEQ ID NO: 14344 - RNA, 20 nt, Artificial Sequence
  MKO10014344_A_Dmpk
  gRNA
ccucacaggugucgugcuuc

SEQ ID NO: 14345 - RNA, 20 nt, Artificial Sequence
  MKO10014345_A_Dmpk
  gRNA
ccaacaugucagccgaagug

SEQ ID NO: 14346 - RNA, 20 nt, Artificial Sequence
  MKO10014346_A_Dmpk
  gRNA
cgcccaggagaaggucgagc

SEQ ID NO: 14347 - RNA, 20 nt, Artificial Sequence
  MKO10014347_A_Dmrt1
  gRNA
uagcagcuacgccgucaacc

SEQ ID NO: 14348 - RNA, 20 nt, Artificial Sequence
  MKO10014348_A_Dmrt1
  gRNA
gcccguaguaugagugcauc

SEQ ID NO: 14349 - RNA, 20 nt, Artificial Sequence
  MKO10014349_A_Dmrt1
  gRNA
ucuucacgggggaucccccg

SEQ ID NO: 14350 - RNA, 20 nt, Artificial Sequence
  MKO10014350_A_Dmrt2
  gRNA
auuugucgcugagcgucugc

SEQ ID NO: 14351 - RNA, 20 nt, Artificial Sequence
  MKO10014351_A_Dmrt2
  gRNA
cuuauuccugcccaaccgua

SEQ ID NO: 14352 - RNA, 20 nt, Artificial Sequence
  MKO10014352_A_Dmrt2
  gRNA
gccgccgcaggaacccaguc

SEQ ID NO: 14353 - RNA, 20 nt, Artificial Sequence
  MKO10014353_A_Dmrt3
  gRNA
gugcgcugcaagggcgcccg

SEQ ID NO: 14354 - RNA, 20 nt, Artificial Sequence
  MKO10014354_A_Dmrt3
  gRNA
acgauuggacaaccgucguc

SEQ ID NO: 14355 - RNA, 20 nt, Artificial Sequence
  MKO10014355_A_Dmrt3
  gRNA
gagccccgagaucguguccg

SEQ ID NO: 14356 - RNA, 20 nt, Artificial Sequence
  MKO10014356_A_Dmrua1
  gRNA
uugcggucgaucgcagaaaa

SEQ ID NO: 14357 - RNA, 20 nt, Artificial Sequence
  MKO10014357_A_Dmrua1
  gRNA
ccgcgcggucggugucgucg

SEQ ID NO: 14358 - RNA, 20 nt, Artificial Sequence
  MKO10014358_A_Dmrua1
  gRNA
agaauuccgagagggucucg

SEQ ID NO: 14359 - RNA, 20 nt, Artificial Sequence
  MKO10014359_A_Dmrua2
  gRNA
cgcgaguugcaauugcugua

SEQ ID NO: 14360 - RNA, 20 nt, Artificial Sequence
  MKO10014360_A_Dmrua2
  gRNA
cgaccucaugcgcgaccgcu

SEQ ID NO: 14361 - RNA, 20 nt, Artificial Sequence
  MKO10014361_A_Dmrua2
  gRNA
cggccgagcggucgcgcaug

SEQ ID NO: 14362 - RNA, 20 nt, Artificial Sequence
  MKO10014362_A_Dmrtb1
  gRNA
ggcuuaccguagucggcgaa

SEQ ID NO: 14363 - RNA, 20 nt, Artificial Sequence
  MKO10014363_A_Dmrtb1
  gRNA
acgccucccggaaccgcccu

SEQ ID NO: 14364 - RNA, 20 nt, Artificial Sequence
  MKO10014364_A_Dmrtb1
  gRNA
aacuuaccaagccgcuucua

SEQ ID NO: 14365 - RNA, 20 nt, Artificial Sequence
  MKO10014365_A_Dmruc1a
  gRNA
ccuggguugcugugucaacc

SEQ ID NO: 14366 - RNA, 20 nt, Artificial Sequence
  MKO10014366_A_Dmruc1a
  gRNA
cccuaugcuacugcaaccac

SEQ ID NO: 14367 - RNA, 20 nt, Artificial Sequence
  MKO10014367_A_Dmruc1a
  gRNA
ccagguugacacagcaaccc

SEQ ID NO: 14368 - RNA, 20 nt, Artificial Sequence
  MKO10014368_A_Dmruc1b
  gRNA
ugcagugagugccccaaaaa

SEQ ID NO: 14369 - RNA, 20 nt, Artificial Sequence
  MKO10014369_A_Dmruc1b
  gRNA
ucuuuaucacuccuugaucc

SEQ ID NO: 14370 - RNA, 20 nt, Artificial Sequence
  MKO10014370_A_Dmruc1b
  gRNA
uccucuucuacugcagccac

SEQ ID NO: 14371 - RNA, 20 nt, Artificial Sequence
  MKO10014371_A_Dmruc1c1
  gRNA
uuuccaaccugacuuggguc

SEQ ID NO: 14372 - RNA, 20 nt, Artificial Sequence
  MKO10014372_A_Dmruc1c1
  gRNA
ugcucucagccuaagaacca

SEQ ID NO: 14373 - RNA, 20 nt, Artificial Sequence
  MKO10014373_A_Dmruc1c1
  gRNA
cucacggcgaccucuuccuu

SEQ ID NO: 14374 - RNA, 20 nt, Artificial Sequence
  MKO10014374_A_Dmruc1c2
  gRNA
ugcucucagccuaagaacca

SEQ ID NO: 14375 - RNA, 20 nt, Artificial Sequence
  MKO10014375_A_Dmruc1c2
  gRNA
uuuccaaccugacuuggguc

SEQ ID NO: 14376 - RNA, 20 nt, Artificial Sequence
  MKO10014376_A_Dmruc1c2
  gRNA
cuauugaagggaccacggcg

SEQ ID NO: 14377 - RNA, 20 nt, Artificial Sequence
  MKO10014377_A_Dmruc2
  gRNA
gucaguacugagcgagaucc

SEQ ID NO: 14378 - RNA, 20 nt, Artificial Sequence
  MKO10014378_A_Dmruc2
  gRNA
ccucucuuagggaacgucgg

SEQ ID NO: 14379 - RNA, 20 nt, Artificial Sequence
  MKO10014379_A_Dmruc2
  gRNA
uacccuugcaggagaacuau

SEQ ID NO: 14380 - RNA, 20 nt, Artificial Sequence
  MKO10014380_A_Dmtf1
  gRNA
uacgccaugcauaucagucg

SEQ ID NO: 14381 - RNA, 20 nt, Artificial Sequence
  MKO10014381_A_Dmtf1
  gRNA
cuuuaguuguaaaccacgcu

SEQ ID NO: 14382 - RNA, 20 nt, Artificial Sequence
  MKO10014382_A_Dmtf1
  gRNA
gaacucugugacguuuacuc

SEQ ID NO: 14383 - RNA, 20 nt, Artificial Sequence
  MKO10014383_A_Dmtn
  gRNA
aguacucaccacgaugcugg

SEQ ID NO: 14384 - RNA, 20 nt, Artificial Sequence
  MKO10014384_A_Dmtn
  gRNA
aggucgcucaauguccagga

SEQ ID NO: 14385 - RNA, 20 nt, Artificial Sequence
  MKO10014385_A_Dmtn
  gRNA
ggagcugacgcuccccgggg

SEQ ID NO: 14386 - RNA, 20 nt, Artificial Sequence
  MKO10014386_A_Dmwd
  gRNA
ucccuacaccacucgcgcag

SEQ ID NO: 14387 - RNA, 20 nt, Artificial Sequence
  MKO10014387_A_Dmwd
  gRNA
cuuguagauccgcuugucga

SEQ ID NO: 14388 - RNA, 20 nt, Artificial Sequence
  MKO10014388_A_Dmwd
  gRNA
ggcuccaucacguaccgcuu

SEQ ID NO: 14389 - RNA, 20 nt, Artificial Sequence
  MKO10014389_A_Dmxl1
  gRNA
cagucaguuugccgaaaaaa

SEQ ID NO: 14390 - RNA, 20 nt, Artificial Sequence
  MKO10014390_A_Dmxl1
  gRNA
uuccuuaccugcgggauccc

SEQ ID NO: 14391 - RNA, 20 nt, Artificial Sequence
  MKO10014391_A_Dmxl1
  gRNA
guagacuguucaaugcaaca

SEQ ID NO: 14392 - RNA, 20 nt, Artificial Sequence
  MKO10014392_A_Dmxl2
  gRNA
ucuucuagaauaucaccgcc

SEQ ID NO: 14393 - RNA, 20 nt, Artificial Sequence
  MKO10014393_A_Dmxl2
  gRNA
ggucacuuacucucccaugc

SEQ ID NO: 14394 - RNA, 20 nt, Artificial Sequence
  MKO10014394_A_Dmxl2
  gRNA
ccgugacauacaacuuagca

SEQ ID NO: 14395 - RNA, 20 nt, Artificial Sequence
  MKO10014395_A_Dna2
  gRNA
ucgauuuagacuucggaaga

SEQ ID NO: 14396 - RNA, 20 nt, Artificial Sequence
  MKO10014396_A_Dna2
  gRNA
gaauuguaccgaucagcauc

SEQ ID NO: 14397 - RNA, 20 nt, Artificial Sequence
  MKO10014397_A_Dna2
  gRNA
caagcgucgcuagcagcauu

SEQ ID NO: 14398 - RNA, 20 nt, Artificial Sequence
  MKO10014398_A_Dnaaf1
  gRNA
ucugacccguugucgccacu

SEQ ID NO: 14399 - RNA, 20 nt, Artificial Sequence
  MKO10014399_A_Dnaaf1
  gRNA
guugcacaagaucgagaacc

SEQ ID NO: 14400 - RNA, 20 nt, Artificial Sequence
  MKO10014400_A_Dnaaf1
  gRNA
agaggcagcgcaguucgcuc

SEQ ID NO: 14401 - RNA, 20 nt, Artificial Sequence
  MKO10014401_A_Dnaaf2
  gRNA
uuaccgcugcucgcgcgacg

SEQ ID NO: 14402 - RNA, 20 nt, Artificial Sequence
  MKO10014402_A_Dnaaf2
  gRNA
cgcgacaccggaagagcccg

SEQ ID NO: 14403 - RNA, 20 nt, Artificial Sequence
  MKO10014403_A_Dnaaf2
  gRNA
ucuggccccaccgcugauug

SEQ ID NO: 14404 - RNA, 20 nt, Artificial Sequence
  MKO10014404_A_Dnaaf3
  gRNA
ucccgcuacgaugcccggcg

SEQ ID NO: 14405 - RNA, 20 nt, Artificial Sequence
  MKO10014405_A_Dnaaf3
  gRNA
cgagucccaaaggcgacuca

SEQ ID NO: 14406 - RNA, 20 nt, Artificial Sequence
  MKO10014406_A_Dnaaf3
  gRNA
gaacgcgcugcugcgacccu

SEQ ID NO: 14407 - RNA, 20 nt, Artificial Sequence
  MKO10014407_A_Dnah10
  gRNA
ccuggcagaugacguccuuu

SEQ ID NO: 14408 - RNA, 20 nt, Artificial Sequence
  MKO10014408_A_Dnah10
  gRNA
ccuaaaggacgucaucugcc

SEQ ID NO: 14409 - RNA, 20 nt, Artificial Sequence
  MKO10014409_A_Dnah10
  gRNA
gacccccucucuauuugaua

SEQ ID NO: 14410 - RNA, 20 nt, Artificial Sequence
  MKO10014410_A_Dnah11
  gRNA
auaagaacaaccauacgucc

SEQ ID NO: 14411 - RNA, 20 nt, Artificial Sequence
  MKO10014411_A_Dnah11
  gRNA
aucagcauuacuuggugacc

SEQ ID NO: 14412 - RNA, 20 nt, Artificial Sequence
  MKO10014412_A_Dnah11
  gRNA
ucaguaucuuaaccaucuug

SEQ ID NO: 14413 - RNA, 20 nt, Artificial Sequence
  MKO10014413_A_Dnah17
  gRNA
augggaccagucgaugauga

SEQ ID NO: 14414 - RNA, 20 nt, Artificial Sequence
  MKO10014414_A_Dnah17
  gRNA
ucgagaccaucaucaucgac

SEQ ID NO: 14415 - RNA, 20 nt, Artificial Sequence
  MKO10014415_A_Dnah17
  gRNA
uggaguccagcgugccgucc

SEQ ID NO: 14416 - RNA, 20 nt, Artificial Sequence
  MKO10014416_A_Dnah1
  gRNA
uggaucacggcccuguucga

SEQ ID NO: 14417 - RNA, 20 nt, Artificial Sequence
  MKO10014417_A_Dnah1
  gRNA
guuagagucgaugcccucgc

SEQ ID NO: 14418 - RNA, 20 nt, Artificial Sequence
  MKO10014418_A_Dnah1
  gRNA
ucuucccacagacgacgauc

SEQ ID NO: 14419 - RNA, 20 nt, Artificial Sequence
  MKO10014419_A_Dnah2
  gRNA
gucgugcucccccguccacg

SEQ ID NO: 14420 - RNA, 20 nt, Artificial Sequence
  MKO10014420_A_Dnah2
  gRNA
cggucaacaucguucgugag

SEQ ID NO: 14421 - RNA, 20 nt, Artificial Sequence
  MKO10014421_A_Dnah2
  gRNA
cuuagauacucgcuacaagc

SEQ ID NO: 14422 - RNA, 20 nt, Artificial Sequence
  MKO10014422_A_Dnah5
  gRNA
gacgccucacgcuguucaac

SEQ ID NO: 14423 - RNA, 20 nt, Artificial Sequence
  MKO10014423_A_Dnah5
  gRNA
ggggccuguugaacagcgug

SEQ ID NO: 14424 - RNA, 20 nt, Artificial Sequence
  MKO10014424_A_Dnah5
  gRNA
uuuacccgguggauguucuc

SEQ ID NO: 14425 - RNA, 20 nt, Artificial Sequence
  MKO10014425_A_Dnah6
  gRNA
aguacaucgagauugagcga

SEQ ID NO: 14426 - RNA, 20 nt, Artificial Sequence
  MKO10014426_A_Dnah6
  gRNA
aaacugccccgcacaaguau

SEQ ID NO: 14427 - RNA, 20 nt, Artificial Sequence
  MKO10014427_A_Dnah6
  gRNA
ugcacaaauagugcgacugc

SEQ ID NO: 14428 - RNA, 20 nt, Artificial Sequence
  MKO10014428_A_Dnah7a
  gRNA
agucuuaccacaguuaucuu

SEQ ID NO: 14429 - RNA, 20 nt, Artificial Sequence
  MKO10014429_A_Dnah7a
  gRNA
auggcgcagucugcugccac

SEQ ID NO: 14430 - RNA, 20 nt, Artificial Sequence
  MKO10014430_A_Dnah7a
  gRNA
accaucaacuucaagaucaa

SEQ ID NO: 14431 - RNA, 20 nt, Artificial Sequence
  MKO10014431_A_Dnah7b
  gRNA
gacucccgcagcaacgaucc

SEQ ID NO: 14432 - RNA, 20 nt, Artificial Sequence
  MKO10014432_A_Dnah7b
  gRNA
uaaacuaucgagcagagaaa

SEQ ID NO: 14433 - RNA, 20 nt, Artificial Sequence
  MKO10014433_A_Dnah7b
  gRNA
caggauaagcuaucuacuaa

SEQ ID NO: 14434 - RNA, 20 nt, Artificial Sequence
  MKO10014434_A_Dnah8
  gRNA
agaauguggucgaacgauua

SEQ ID NO: 14435 - RNA, 20 nt, Artificial Sequence
  MKO10014435_A_Dnah8
  gRNA
uggcaacaucauuacgacaa

SEQ ID NO: 14436 - RNA, 20 nt, Artificial Sequence
  MKO10014436_A_Dnah8
  gRNA
aaccgggcacuucuccuucc

SEQ ID NO: 14437 - RNA, 20 nt, Artificial Sequence
  MKO10014437_A_Dnah9
  gRNA
auuccuuccagcccugaccg

SEQ ID NO: 14438 - RNA, 20 nt, Artificial Sequence
  MKO10014438_A_Dnah9
  gRNA
guacuuacacuggcucacug

SEQ ID NO: 14439 - RNA, 20 nt, Artificial Sequence
  MKO10014439_A_Dnah9
  gRNA
caagucaacucucuaugcug

SEQ ID NO: 14440 - RNA, 20 nt, Artificial Sequence
  MKO10014440_A_Dnaic1
  gRNA
ggcugaagugaaccgccauu

SEQ ID NO: 14441 - RNA, 20 nt, Artificial Sequence
  MKO10014441_A_Dnaic1
  gRNA
ccgcaucggucagcuccagc

SEQ ID NO: 14442 - RNA, 20 nt, Artificial Sequence
  MKO10014442_A_Dnaic1
  gRNA
uagagcaucaguguaaccag

SEQ ID NO: 14443 - RNA, 20 nt, Artificial Sequence
  MKO10014443_A_Dnaic2
  gRNA
ucaugcucaugggugcgcgc

SEQ ID NO: 14444 - RNA, 20 nt, Artificial Sequence
  MKO10014444_A_Dnaic2
  gRNA
ugaacuacgacuccuacauc

SEQ ID NO: 14445 - RNA, 20 nt, Artificial Sequence
  MKO10014445_A_Dnaic2
  gRNA
caucaacgccgucaugcagc

SEQ ID NO: 14446 - RNA, 20 nt, Artificial Sequence
  MKO10014446_A_Dnaja1
  gRNA
cuguguuuaggcaugaaaga

SEQ ID NO: 14447 - RNA, 20 nt, Artificial Sequence
  MKO10014447_A_Dnaja1
  gRNA
cuaggccgaggugguaagaa

SEQ ID NO: 14448 - RNA, 20 nt, Artificial Sequence
  MKO10014448_A_Dnaja1
  gRNA
uuuaccuuguaaaaacagca

SEQ ID NO: 14449 - RNA, 20 nt, Artificial Sequence
  MKO10014449_A_Dnaja2
  gRNA
gcgcauuaugaucagacagc

SEQ ID NO: 14450 - RNA, 20 nt, Artificial Sequence
  MKO10014450_A_Dnaja2
  gRNA
uccgugugcuccgacuguaa

SEQ ID NO: 14451 - RNA, 20 nt, Artificial Sequence
  MKO10014451_A_Dnaja2
  gRNA
cgagagcuguaugacagaua

SEQ ID NO: 14452 - RNA, 20 nt, Artificial Sequence
  MKO10014452_A_Dnaja3
  gRNA
auguugccacuacgcccccc

SEQ ID NO: 14453 - RNA, 20 nt, Artificial Sequence
  MKO10014453_A_Dnaja3
  gRNA
agacgcacagcuugcgacac

SEQ ID NO: 14454 - RNA, 20 nt, Artificial Sequence
  MKO10014454_A_Dnaja3
  gRNA
uggcauuucggggcacuccc

SEQ ID NO: 14455 - RNA, 20 nt, Artificial Sequence
  MKO10014455_A_Dnaja4
  gRNA
ccaugcccggcccaaucugc

SEQ ID NO: 14456 - RNA, 20 nt, Artificial Sequence
  MKO10014456_A_Dnaja4
  gRNA
gggcgagcgcaucaacccca

SEQ ID NO: 14457 - RNA, 20 nt, Artificial Sequence
  MKO10014457_A_Dnaja4
  gRNA
agcacaauuaucacaucgcc

SEQ ID NO: 14458 - RNA, 20 nt, Artificial Sequence
  MKO10014458_A_Dnajb11
  gRNA
auauuccuguccugcugacg

SEQ ID NO: 14459 - RNA, 20 nt, Artificial Sequence
  MKO10014459_A_Dnajb11
  gRNA
cgaaaacaguacgauacuua

SEQ ID NO: 14460 - RNA, 20 nt, Artificial Sequence
  MKO10014460_A_Dnajb11
  gRNA
gccucgaagugccuccauaa

SEQ ID NO: 14461 - RNA, 20 nt, Artificial Sequence
  MKO10014461_A_Dnajb12
  gRNA
gcugguagguguaccgcauu

SEQ ID NO: 14462 - RNA, 20 nt, Artificial Sequence
  MKO10014462_A_Dnajb12
  gRNA
aaagaaggccuaccgcaagc

SEQ ID NO: 14463 - RNA, 20 nt, Artificial Sequence
  MKO10014463_A_Dnajb12
  gRNA
uacggcauacgcugugccaa

SEQ ID NO: 14464 - RNA, 20 nt, Artificial Sequence
  MKO10014464_A_Dnajb13
  gRNA
cagauagaggucucguucaa

SEQ ID NO: 14465 - RNA, 20 nt, Artificial Sequence
  MKO10014465_A_Dnajb13
  gRNA
ugucucccccaaaaaacucg

SEQ ID NO: 14466 - RNA, 20 nt, Artificial Sequence
  MKO10014466_A_Dnajb13
  gRNA
acggucgcucagcacgucgu

SEQ ID NO: 14467 - RNA, 20 nt, Artificial Sequence
  MKO10014467_A_Dnajb14
  gRNA
gcaaugcgugcuacuuccag

SEQ ID NO: 14468 - RNA, 20 nt, Artificial Sequence
  MKO10014468_A_Dnajb14
  gRNA
aaggacggcacuucuggugc

SEQ ID NO: 14469 - RNA, 20 nt, Artificial Sequence
  MKO10014469_A_Dnajb14
  gRNA
aauugaaccugccguuguuc

SEQ ID NO: 14470 - RNA, 20 nt, Artificial Sequence
  MKO10014470_A_Dnajb1
  gRNA
ucgaaaaucucgcgcuugcg

SEQ ID NO: 14471 - RNA, 20 nt, Artificial Sequence
  MKO10014471_A_Dnajb1
  gRNA
ucucgucgucggacgcgccg

SEQ ID NO: 14472 - RNA, 20 nt, Artificial Sequence
  MKO10014472_A_Dnajb1
  gRNA
uaccucccgaaggcuaaucc

SEQ ID NO: 14473 - RNA, 20 nt, Artificial Sequence
  MKO10014473_A_Dnajb2
  gRNA
acgagauucuagacguaccg

SEQ ID NO: 14474 - RNA, 20 nt, Artificial Sequence
  MKO10014474_A_Dnajb2
  gRNA
uacgucuagaaucucguagu

SEQ ID NO: 14475 - RNA, 20 nt, Artificial Sequence
  MKO10014475_A_Dnajb2
  gRNA
auucaccuuccguagccccg

SEQ ID NO: 14476 - RNA, 20 nt, Artificial Sequence
  MKO10014476_A_Dnajb3
  gRNA
gacguccgauaagaccucgu

SEQ ID NO: 14477 - RNA, 20 nt, Artificial Sequence
  MKO10014477_A_Dnajb3
  gRNA
cgcgagguguacgaccgcug

SEQ ID NO: 14478 - RNA, 20 nt, Artificial Sequence
  MKO10014478_A_Dnajb3
  gRNA
ccucgcccacuucgccgcag

SEQ ID NO: 14479 - RNA, 20 nt, Artificial Sequence
  MKO10014479_A_Dnajb4
  gRNA
ucgagaaaucuucauccguu

SEQ ID NO: 14480 - RNA, 20 nt, Artificial Sequence
  MKO10014480_A_Dnajb4
  gRNA
gucacugauauugugaaacc

SEQ ID NO: 14481 - RNA, 20 nt, Artificial Sequence
  MKO10014481_A_Dnajb4
  gRNA
agggucuuguuugagacggg

SEQ ID NO: 14482 - RNA, 20 nt, Artificial Sequence
  MKO10014482_A_Dnajb5
  gRNA
gggguccuguaccuugcgcc

SEQ ID NO: 14483 - RNA, 20 nt, Artificial Sequence
  MKO10014483_A_Dnajb5
  gRNA
gaacaaagagcccaacgccg

SEQ ID NO: 14484 - RNA, 20 nt, Artificial Sequence
  MKO10014484_A_Dnajb5
  gRNA
caugcacacuuccgccgaga

SEQ ID NO: 14485 - RNA, 20 nt, Artificial Sequence
  MKO10014485_A_Dnajb6
  gRNA
ucuuucaagguaucgaaaac

SEQ ID NO: 14486 - RNA, 20 nt, Artificial Sequence
  MKO10014486_A_Dnajb6
  gRNA
cacauuuaaagcuaaaaagc

SEQ ID NO: 14487 - RNA, 20 nt, Artificial Sequence
  MKO10014487_A_Dnajb6
  gRNA
ccaaagaagucaaaugaaaa

SEQ ID NO: 14488 - RNA, 20 nt, Artificial Sequence
  MKO10014488_A_Dnajb7
  gRNA
acucacgcucaucgucgaga

SEQ ID NO: 14489 - RNA, 20 nt, Artificial Sequence
  MKO10014489_A_Dnajb7
  gRNA
gugaguaccgcuucacauuc

SEQ ID NO: 14490 - RNA, 20 nt, Artificial Sequence
  MKO10014490_A_Dnajb7
  gRNA
aaaauucaaagaagucgccg

SEQ ID NO: 14491 - RNA, 20 nt, Artificial Sequence
  MKO10014491_A_Dnajb8
  gRNA
agaagcguucuguguacgac

SEQ ID NO: 14492 - RNA, 20 nt, Artificial Sequence
  MKO10014492_A_Dnajb8
  gRNA
acgcaaagccagcuuucgau

SEQ ID NO: 14493 - RNA, 20 nt, Artificial Sequence
  MKO10014493_A_Dnajb8
  gRNA
gacacuccguucagcggccg

SEQ ID NO: 14494 - RNA, 20 nt, Artificial Sequence
  MKO10014494_A_Dnajb9
  gRNA
agucuguacugugugucgau

SEQ ID NO: 14495 - RNA, 20 nt, Artificial Sequence
  MKO10014495_A_Dnajb9
  gRNA
gucauacucuuuccgacuau

SEQ ID NO: 14496 - RNA, 20 nt, Artificial Sequence
  MKO10014496_A_Dnajb9
  gRNA
uaagauaucauaguagcuuu

SEQ ID NO: 14497 - RNA, 20 nt, Artificial Sequence
  MKO10014497_A_Dnajc10
  gRNA
agcuacuaccguuacgauuu

SEQ ID NO: 14498 - RNA, 20 nt, Artificial Sequence
  MKO10014498_A_Dnajc10
  gRNA
cgaaucggagcugucaacug

SEQ ID NO: 14499 - RNA, 20 nt, Artificial Sequence
  MKO10014499_A_Dnajc10
  gRNA
guacagugggggcuaaauca

SEQ ID NO: 14500 - RNA, 20 nt, Artificial Sequence
  MKO10014500_A_Dnajc11
  gRNA
gguuaaacagccgcuccgcc

SEQ ID NO: 14501 - RNA, 20 nt, Artificial Sequence
  MKO10014501_A_Dnajc11
  gRNA
cgcaucuacuccaacgcuga

SEQ ID NO: 14502 - RNA, 20 nt, Artificial Sequence
  MKO10014502_A_Dnajc11
  gRNA
ccccagggaaccaucagcgu

SEQ ID NO: 14503 - RNA, 20 nt, Artificial Sequence
  MKO10014503_A_Dnajc12
  gRNA
gucgagcccgcuaugaccau

SEQ ID NO: 14504 - RNA, 20 nt, Artificial Sequence
  MKO10014504_A_Dnajc12
  gRNA
ugucaaugccguucgagcag

SEQ ID NO: 14505 - RNA, 20 nt, Artificial Sequence
  MKO10014505_A_Dnajc12
  gRNA
cauaguuucugaacuuccgc

SEQ ID NO: 14506 - RNA, 20 nt, Artificial Sequence
  MKO10014506_A_Dnajc13
  gRNA
cguagaucucucugauuauc

SEQ ID NO: 14507 - RNA, 20 nt, Artificial Sequence
  MKO10014507_A_Dnajc13
  gRNA
auaacugcuacaagcaucac

SEQ ID NO: 14508 - RNA, 20 nt, Artificial Sequence
  MKO10014508_A_Dnajc13
  gRNA
cacugccuuuacgaaaugug

SEQ ID NO: 14509 - RNA, 20 nt, Artificial Sequence
  MKO10014509_A_Dnajc14
  gRNA
gaucacuuacuuugcgcuga

SEQ ID NO: 14510 - RNA, 20 nt, Artificial Sequence
  MKO10014510_A_Dnajc14
  gRNA
gcgcaaaguaagugaucuug

SEQ ID NO: 14511 - RNA, 20 nt, Artificial Sequence
  MKO10014511_A_Dnajc14
  gRNA
ucucggguacccggcaccag

SEQ ID NO: 14512 - RNA, 20 nt, Artificial Sequence
  MKO10014512_A_Dnajc15
  gRNA
gccgugauuacuuguucuag

SEQ ID NO: 14513 - RNA, 20 nt, Artificial Sequence
  MKO10014513_A_Dnajc15
  gRNA
cucgaauccuccuuuauagu

SEQ ID NO: 14514 - RNA, 20 nt, Artificial Sequence
  MKO10014514_A_Dnajc15
  gRNA
gucgcuaugcauuucagauc

SEQ ID NO: 14515 - RNA, 20 nt, Artificial Sequence
  MKO10014515_A_Dnajc16
  gRNA
gacucuccacgaacugccgu

SEQ ID NO: 14516 - RNA, 20 nt, Artificial Sequence
  MKO10014516_A_Dnajc16
  gRNA
ucaucaagaucacgucagac

SEQ ID NO: 14517 - RNA, 20 nt, Artificial Sequence
  MKO10014517_A_Dnajc16
  gRNA
gcauccauaucgagccuguc

SEQ ID NO: 14518 - RNA, 20 nt, Artificial Sequence
  MKO10014518_A_Dnajc17
  gRNA
cccagagacuugacgagaac

SEQ ID NO: 14519 - RNA, 20 nt, Artificial Sequence
  MKO10014519_A_Dnajc17
  gRNA
ucuaggugaagaaggcguac

SEQ ID NO: 14520 - RNA, 20 nt, Artificial Sequence
  MKO10014520_A_Dnajc17
  gRNA
uggucaggcugcauaugaca

SEQ ID NO: 14521 - RNA, 20 nt, Artificial Sequence
  MKO10014521_A_Dnajc18
  gRNA
acgacagucaguauuaucgc

SEQ ID NO: 14522 - RNA, 20 nt, Artificial Sequence
  MKO10014522_A_Dnajc18
  gRNA
cccgacaagaacugcgcucc

SEQ ID NO: 14523 - RNA, 20 nt, Artificial Sequence
  MKO10014523_A_Dnajc18
  gRNA
augcaguuacagcagccgca

SEQ ID NO: 14524 - RNA, 20 nt, Artificial Sequence
  MKO10014524_A_Dnajc19
  gRNA
uucuuucaggcauucggugg

SEQ ID NO: 14525 - RNA, 20 nt, Artificial Sequence
  MKO10014525_A_Dnajc19
  gRNA
cagcauuaauauuaggugua

SEQ ID NO: 14526 - RNA, 20 nt, Artificial Sequence
  MKO10014526_A_Dnajc19
  gRNA
cccgacugcuaccacugugc

SEQ ID NO: 14527 - RNA, 20 nt, Artificial Sequence
  MKO10014527_A_Dnajc1
  gRNA
aguguggacgcagcaaaacu

SEQ ID NO: 14528 - RNA, 20 nt, Artificial Sequence
  MKO10014528_A_Dnajc1
  gRNA
gacagccuguauucuacuac

SEQ ID NO: 14529 - RNA, 20 nt, Artificial Sequence
  MKO10014529_A_Dnajc1
  gRNA
acucgccuguaguagaauac

SEQ ID NO: 14530 - RNA, 20 nt, Artificial Sequence
  MKO10014530_A_Dnajc21
  gRNA
cuuaucucguuuacgaauga

SEQ ID NO: 14531 - RNA, 20 nt, Artificial Sequence
  MKO10014531_A_Dnajc21
  gRNA
uagguacgauaaccaccgag

SEQ ID NO: 14532 - RNA, 20 nt, Artificial Sequence
  MKO10014532_A_Dnajc21
  gRNA
ucaccgugucauagucgcuc

SEQ ID NO: 14533 - RNA, 20 nt, Artificial Sequence
  MKO10014533_A_Dnajc22
  gRNA
cuauauagugggccucccac

SEQ ID NO: 14534 - RNA, 20 nt, Artificial Sequence
  MKO10014534_A_Dnajc22
  gRNA
aucugguggcuacuggucgg

SEQ ID NO: 14535 - RNA, 20 nt, Artificial Sequence
  MKO10014535_A_Dnajc22
  gRNA
accgggaccuggugaaaguc

SEQ ID NO: 14536 - RNA, 20 nt, Artificial Sequence
  MKO10014536_A_Dnajc24
  gRNA
aguaccuaccaugccgcugc

SEQ ID NO: 14537 - RNA, 20 nt, Artificial Sequence
  MKO10014537_A_Dnajc24
  gRNA
aaucagcgagcacgcgucac

SEQ ID NO: 14538 - RNA, 20 nt, Artificial Sequence
  MKO10014538_A_Dnajc24
  gRNA
ugacgcgugcucgcugauug

SEQ ID NO: 14539 - RNA, 20 nt, Artificial Sequence
  MKO10014539_A_Dnajc25
  gRNA
ggcucgggccgguagcgauc

SEQ ID NO: 14540 - RNA, 20 nt, Artificial Sequence
  MKO10014540_A_Dnajc25
  gRNA
ccgcgcgaucuccgccuugc

SEQ ID NO: 14541 - RNA, 20 nt, Artificial Sequence
  MKO10014541_A_Dnajc25
  gRNA
cucgguggaagcgcuaccgc

SEQ ID NO: 14542 - RNA, 20 nt, Artificial Sequence
  MKO10014542_A_Dnajc27
  gRNA
gugauacuagucuaugaugu

SEQ ID NO: 14543 - RNA, 20 nt, Artificial Sequence
  MKO10014543_A_Dnajc27
  gRNA
ucucugccagccacgaauca

SEQ ID NO: 14544 - RNA, 20 nt, Artificial Sequence
  MKO10014544_A_Dnajc27
  gRNA
gggaaucaacgagauguucc

SEQ ID NO: 14545 - RNA, 20 nt, Artificial Sequence
  MKO10014545_A_Dnajc28
  gRNA
guucagggcggaucgcgcga

SEQ ID NO: 14546 - RNA, 20 nt, Artificial Sequence
  MKO10014546_A_Dnajc28
  gRNA
gaugcucuguagacgacguc

SEQ ID NO: 14547 - RNA, 20 nt, Artificial Sequence
  MKO10014547_A_Dnajc28
  gRNA
aaaacgcaccuuacauucaa

SEQ ID NO: 14548 - RNA, 20 nt, Artificial Sequence
  MKO10014548_A_Dnajc2
  gRNA
ccagccgcuuuccguuuguc

SEQ ID NO: 14549 - RNA, 20 nt, Artificial Sequence
  MKO10014549_A_Dnajc2
  gRNA
agucugucaaguugaaccug

SEQ ID NO: 14550 - RNA, 20 nt, Artificial Sequence
  MKO10014550_A_Dnajc2
  gRNA
uacuucacuugcauaacuaa

SEQ ID NO: 14551 - RNA, 20 nt, Artificial Sequence
  MKO10014551_A_Dnajc30
  gRNA
caagcccucuaagacgcccg

SEQ ID NO: 14552 - RNA, 20 nt, Artificial Sequence
  MKO10014552_A_Dnajc30
  gRNA
gguggacccugucaccgcua

SEQ ID NO: 14553 - RNA, 20 nt, Artificial Sequence
  MKO10014553_A_Dnajc30
  gRNA
gucucguguaucgucccagc

SEQ ID NO: 14554 - RNA, 20 nt, Artificial Sequence
  MKO10014554_A_Dnajc3
  gRNA
cgucaaaggcgucgagcgcu

SEQ ID NO: 14555 - RNA, 20 nt, Artificial Sequence
  MKO10014555_A_Dnajc3
  gRNA
caagcgcucgacgccuuuga

SEQ ID NO: 14556 - RNA, 20 nt, Artificial Sequence
  MKO10014556_A_Dnajc3
  gRNA
ugcagcgugaaacugugaua

SEQ ID NO: 14557 - RNA, 20 nt, Artificial Sequence
  MKO10014557_A_Dnajc4
  gRNA
aaccccccaacgcucaauac

SEQ ID NO: 14558 - RNA, 20 nt, Artificial Sequence
  MKO10014558_A_Dnajc4
  gRNA
gcccaguauugagcguuggg

SEQ ID NO: 14559 - RNA, 20 nt, Artificial Sequence
  MKO10014559_A_Dnajc4
  gRNA
ggcccgagugucauuguaga

SEQ ID NO: 14560 - RNA, 20 nt, Artificial Sequence
  MKO10014560_A_Dnajc5b
  gRNA
caaaucaucgacaccagaag

SEQ ID NO: 14561 - RNA, 20 nt, Artificial Sequence
  MKO10014561_A_Dnajc5b
  gRNA
aaaaauagcagccggucaag

SEQ ID NO: 14562 - RNA, 20 nt, Artificial Sequence
  MKO10014562_A_Dnajc5b
  gRNA
uugacaaaguccgcugucuu

SEQ ID NO: 14563 - RNA, 20 nt, Artificial Sequence
  MKO10014563_A_Dnajc5g
  gRNA
ucccaguucuagauagucgc

SEQ ID NO: 14564 - RNA, 20 nt, Artificial Sequence
  MKO10014564_A_Dnajc5g
  gRNA
auaauccuagugagccgugc

SEQ ID NO: 14565 - RNA, 20 nt, Artificial Sequence
  MKO10014565_A_Dnajc5g
  gRNA
uagacuuaauccaucagccg

SEQ ID NO: 14566 - RNA, 20 nt, Artificial Sequence
  MKO10014566_A_Dnajc5
  gRNA
aaccuaacauggccgaccag

SEQ ID NO: 14567 - RNA, 20 nt, Artificial Sequence
  MKO10014567_A_Dnajc5
  gRNA
ccuacuucguacucuccagc

SEQ ID NO: 14568 - RNA, 20 nt, Artificial Sequence
  MKO10014568_A_Dnajc5
  gRNA
cuacguauccccugaagacu

SEQ ID NO: 14569 - RNA, 20 nt, Artificial Sequence
  MKO10014569_A_Dnajc6
  gRNA
gagaaccuuaccgauaaucc

SEQ ID NO: 14570 - RNA, 20 nt, Artificial Sequence
  MKO10014570_A_Dnajc6
  gRNA
cgccuuucaccaugucaaaa

SEQ ID NO: 14571 - RNA, 20 nt, Artificial Sequence
  MKO10014571_A_Dnajc6
  gRNA
aggugacguaaguaaagucu

SEQ ID NO: 14572 - RNA, 20 nt, Artificial Sequence
  MKO10014572_A_Dnajc7
  gRNA
cgcucgauuaccguaauagc

SEQ ID NO: 14573 - RNA, 20 nt, Artificial Sequence
  MKO10014573_A_Dnajc7
  gRNA
uucuagggacaccuccgaga

SEQ ID NO: 14574 - RNA, 20 nt, Artificial Sequence
  MKO10014574_A_Dnajc7
  gRNA
caagaacgccaaugccguca

SEQ ID NO: 14575 - RNA, 20 nt, Artificial Sequence
  MKO10014575_A_Dnajc8
  gRNA
uucccugcaguuguccaucc

SEQ ID NO: 14576 - RNA, 20 nt, Artificial Sequence
  MKO10014576_A_Dnajc8
  gRNA
uuugucaggaugcaccagga

SEQ ID NO: 14577 - RNA, 20 nt, Artificial Sequence
  MKO10014577_A_Dnajc8
  gRNA
auugaaagauugacucgucc

SEQ ID NO: 14578 - RNA, 20 nt, Artificial Sequence
  MKO10014578_A_Dnajc9
  gRNA
uuguuauuagauaucgcuag

SEQ ID NO: 14579 - RNA, 20 nt, Artificial Sequence
  MKO10014579_A_Dnajc9
  gRNA
uuguuuagacucuuugacga

SEQ ID NO: 14580 - RNA, 20 nt, Artificial Sequence
  MKO10014580_A_Dnajc9
  gRNA
ccucaaccaagaccgggacu

SEQ ID NO: 14581 - RNA, 20 nt, Artificial Sequence
  MKO10014581_A_Dnal1
  gRNA
cauaaccuaccaguccauuu

SEQ ID NO: 14582 - RNA, 20 nt, Artificial Sequence
  MKO10014582_A_Dnal1
  gRNA
uuacucgcaguuaccaagug

SEQ ID NO: 14583 - RNA, 20 nt, Artificial Sequence
  MKO10014583_A_Dnal1
  gRNA
gucuacucacccaucuggac

SEQ ID NO: 14584 - RNA, 20 nt, Artificial Sequence
  MKO10014584_A_Dnal4
  gRNA
cucgccgaucaccacaugcc

SEQ ID NO: 14585 - RNA, 20 nt, Artificial Sequence
  MKO10014585_A_Dnal4
  gRNA
acaagaaguucggcuccucc

SEQ ID NO: 14586 - RNA, 20 nt, Artificial Sequence
  MKO10014586_A_Dnal4
  gRNA
ugccaauaccucauuguugu

SEQ ID NO: 14587 - RNA, 20 nt, Artificial Sequence
  MKO10014587_A_Dnali1
  gRNA
uggucauguggaucucgucc

SEQ ID NO: 14588 - RNA, 20 nt, Artificial Sequence
  MKO10014588_A_Dnali1
  gRNA
uguuggaagacgaacugauc

SEQ ID NO: 14589 - RNA, 20 nt, Artificial Sequence
  MKO10014589_A_Dnali1
  gRNA
aguagaguucccugcgcaca

SEQ ID NO: 14590 - RNA, 20 nt, Artificial Sequence
  MKO10014590_A_Dnase1l1
  gRNA
ccuagcccgaugugauauca

SEQ ID NO: 14591 - RNA, 20 nt, Artificial Sequence
  MKO10014591_A_Dnase1l1
  gRNA
uaucaucugugucguuguau

SEQ ID NO: 14592 - RNA, 20 nt, Artificial Sequence
  MKO10014592_A_Dnase1l1
  gRNA
cuaccagcgcuggcagaaug

SEQ ID NO: 14593 - RNA, 20 nt, Artificial Sequence
  MKO10014593_A_Dnase1l2
  gRNA
uuguacuggucacguccgag

SEQ ID NO: 14594 - RNA, 20 nt, Artificial Sequence
  MKO10014594_A_Dnase1l2
  gRNA
ggccggcuaugauaucgccc

SEQ ID NO: 14595 - RNA, 20 nt, Artificial Sequence
  MKO10014595_A_Dnase1l2
  gRNA
ucccggcugaaagcguccuc

SEQ ID NO: 14596 - RNA, 20 nt, Artificial Sequence
  MKO10014596_A_Dnase1l3
  gRNA
cugugaccuuauacuguuga

SEQ ID NO: 14597 - RNA, 20 nt, Artificial Sequence
  MKO10014597_A_Dnase1l3
  gRNA
uaugugauuaguucucgacu

SEQ ID NO: 14598 - RNA, 20 nt, Artificial Sequence
  MKO10014598_A_Dnase1l3
  gRNA
ucacacucacuuguagacga

SEQ ID NO: 14599 - RNA, 20 nt, Artificial Sequence
  MKO10014599_A_Dnase1
  gRNA
cagcgaugucauagcgacuc

SEQ ID NO: 14600 - RNA, 20 nt, Artificial Sequence
  MKO10014600_A_Dnase1
  gRNA
cccaccgauugaguucaucc

SEQ ID NO: 14601 - RNA, 20 nt, Artificial Sequence
  MKO10014601_A_Dnase1
  gRNA
gcggcucacugacuacauag

SEQ ID NO: 14602 - RNA, 20 nt, Artificial Sequence
  MKO10014602_A_Dnase2a
  gRNA
uacaccgucuugccaaccgu

SEQ ID NO: 14603 - RNA, 20 nt, Artificial Sequence
  MKO10014603_A_Dnase2a
  gRNA
ucucacccuucguaugccca

SEQ ID NO: 14604 - RNA, 20 nt, Artificial Sequence
  MKO10014604_A_Dnase2a
  gRNA
uaccggccaugggcauacga

SEQ ID NO: 14605 - RNA, 20 nt, Artificial Sequence
  MKO10014605_A_Dnase2b
  gRNA
augaguacccaaccucgggg

SEQ ID NO: 14606 - RNA, 20 nt, Artificial Sequence
  MKO10014606_A_Dnase2b
  gRNA
accaucguuguauauuagau

SEQ ID NO: 14607 - RNA, 20 nt, Artificial Sequence
  MKO10014607_A_Dnase2b
  gRNA
gccuaucuaauauacaacga

SEQ ID NO: 14608 - RNA, 20 nt, Artificial Sequence
  MKO10014608_A_Dnd1
  gRNA
acuuaccucgcacucccguu

SEQ ID NO: 14609 - RNA, 20 nt, Artificial Sequence
  MKO10014609_A_Dnd1
  gRNA
ggcagggaccgaacgguugc

SEQ ID NO: 14610 - RNA, 20 nt, Artificial Sequence
  MKO10014610_A_Dnd1
  gRNA
cugcucgcccugcaaccguu

SEQ ID NO: 14611 - RNA, 20 nt, Artificial Sequence
  MKO10014611_A_Dner
  gRNA
uugggacccaaccacuucau

SEQ ID NO: 14612 - RNA, 20 nt, Artificial Sequence
  MKO10014612_A_Dner
  gRNA
gcggccacccgcagaguugu

SEQ ID NO: 14613 - RNA, 20 nt, Artificial Sequence
  MKO10014613_A_Dner
  gRNA
ucgaagugugacaccccucc

SEQ ID NO: 14614 - RNA, 20 nt, Artificial Sequence
  MKO10014614_A_Dnlz
  gRNA
cccgggauuccggaccgcgg

SEQ ID NO: 14615 - RNA, 20 nt, Artificial Sequence
  MKO10014615_A_Dnlz
  gRNA
cgcacacuacgaaguagugu

SEQ ID NO: 14616 - RNA, 20 nt, Artificial Sequence
  MKO10014616_A_Dnlz
  gRNA
aagucacgaugaccacgccc

SEQ ID NO: 14617 - RNA, 20 nt, Artificial Sequence
  MKO10014617_A_Dnm1l
  gRNA
ggucauggaggcgcugaucc

SEQ ID NO: 14618 - RNA, 20 nt, Artificial Sequence
  MKO10014618_A_Dnm1l
  gRNA
gcugccucagaucgucguag

SEQ ID NO: 14619 - RNA, 20 nt, Artificial Sequence
  MKO10014619_A_Dnm1l
  gRNA
ggugaccacaccaguuccuc

SEQ ID NO: 14620 - RNA, 20 nt, Artificial Sequence
  MKO10014620_A_Dnm1
  gRNA
uucccaggucagcgcaccau

SEQ ID NO: 14621 - RNA, 20 nt, Artificial Sequence
  MKO10014621_A_Dnm1
  gRNA
gcuuaugcaguucgucacua

SEQ ID NO: 14622 - RNA, 20 nt, Artificial Sequence
  MKO10014622_A_Dnm1
  gRNA
cauggggcgaguagacccgc

SEQ ID NO: 14623 - RNA, 20 nt, Artificial Sequence
  MKO10014623_A_Dnm2
  gRNA
cguguggugaguagacccga

SEQ ID NO: 14624 - RNA, 20 nt, Artificial Sequence
  MKO10014624_A_Dnm2
  gRNA
ccagagcgccggcaaaaguu

SEQ ID NO: 14625 - RNA, 20 nt, Artificial Sequence
  MKO10014625_A_Dnm2
  gRNA
uccugcagcuuguuaaccag

SEQ ID NO: 14626 - RNA, 20 nt, Artificial Sequence
  MKO10014626_A_Dnm3
  gRNA
gcagaaacagaccgcguaac

SEQ ID NO: 14627 - RNA, 20 nt, Artificial Sequence
  MKO10014627_A_Dnm3
  gRNA
acgggcacuuucguuauucc

SEQ ID NO: 14628 - RNA, 20 nt, Artificial Sequence
  MKO10014628_A_Dnm3
  gRNA
ugcauccgaguucgcaagau

SEQ ID NO: 14629 - RNA, 20 nt, Artificial Sequence
  MKO10014629_A_Dnmbp
  gRNA
cgcugucgucgagaaucacc

SEQ ID NO: 14630 - RNA, 20 nt, Artificial Sequence
  MKO10014630_A_Dnmbp
  gRNA
gaaccccgauaauggugauc

SEQ ID NO: 14631 - RNA, 20 nt, Artificial Sequence
  MKO10014631_A_Dnmbp
  gRNA
uaugagcucaugcgauuguu

SEQ ID NO: 14632 - RNA, 20 nt, Artificial Sequence
  MKO10014632_A_Dnmt1
  gRNA
ugaaacuucaccuaguuccg

SEQ ID NO: 14633 - RNA, 20 nt, Artificial Sequence
  MKO10014633_A_Dnmt1
  gRNA
cuucgugaagugagccguga

SEQ ID NO: 14634 - RNA, 20 nt, Artificial Sequence
  MKO10014634_A_Dnmt1
  gRNA
acccaaggaagagucggaag

SEQ ID NO: 14635 - RNA, 20 nt, Artificial Sequence
  MKO10014635_A_Dnmt3a
  gRNA
cgacgaugagccugaguaug

SEQ ID NO: 14636 - RNA, 20 nt, Artificial Sequence
  MKO10014636_A_Dnmt3a
  gRNA
uccgugggcugcugcacagc

SEQ ID NO: 14637 - RNA, 20 nt, Artificial Sequence
  MKO10014637_A_Dnmt3a
  gRNA
ggccaggccgaauugugucu

SEQ ID NO: 14638 - RNA, 20 nt, Artificial Sequence
  MKO10014638_A_Dnmt3b
  gRNA
cgggcuuucagagcgcgucc

SEQ ID NO: 14639 - RNA, 20 nt, Artificial Sequence
  MKO10014639_A_Dnmt3b
  gRNA
gaggagugcauuaucguuaa

SEQ ID NO: 14640 - RNA, 20 nt, Artificial Sequence
  MKO10014640_A_Dnmt3b
  gRNA
cugccgaccucgggugauuc

SEQ ID NO: 14641 - RNA, 20 nt, Artificial Sequence
  MKO10014641_A_Dnmt3l
  gRNA
acgaagucaaagugaaccga

SEQ ID NO: 14642 - RNA, 20 nt, Artificial Sequence
  MKO10014642_A_Dnmt3l
  gRNA
gugagagccccgacuguacc

SEQ ID NO: 14643 - RNA, 20 nt, Artificial Sequence
  MKO10014643_A_Dnmt3l
  gRNA
ccccgcucaggauaaguucc

SEQ ID NO: 14644 - RNA, 20 nt, Artificial Sequence
  MKO10014644_A_Dnpep
  gRNA
acgcaaaucgcgccgaagcc

SEQ ID NO: 14645 - RNA, 20 nt, Artificial Sequence
  MKO10014645_A_Dnpep
  gRNA
caggucgguguugagaccua

SEQ ID NO: 14646 - RNA, 20 nt, Artificial Sequence
  MKO10014646_A_Dnpep
  gRNA
agaggcucguccauauagaa

SEQ ID NO: 14647 - RNA, 20 nt, Artificial Sequence
  MKO10014647_A_Dnph1
  gRNA
cgauccgcgaauacagagcu

SEQ ID NO: 14648 - RNA, 20 nt, Artificial Sequence
  MKO10014648_A_Dnph1
  gRNA
guaucccggcugcggcgcua

SEQ ID NO: 14649 - RNA, 20 nt, Artificial Sequence
  MKO10014649_A_Dnph1
  gRNA
ccaauucguagccaacaccc

SEQ ID NO: 14650 - RNA, 20 nt, Artificial Sequence
  MKO10014650_A_Dnuuip1
  gRNA
uugauucucaccuugauccc

SEQ ID NO: 14651 - RNA, 20 nt, Artificial Sequence
  MKO10014651_A_Dnuuip1
  gRNA
gccgaucucagaugaccaca

SEQ ID NO: 14652 - RNA, 20 nt, Artificial Sequence
  MKO10014652_A_Dnuuip1
  gRNA
accuuguggucaucugagau

SEQ ID NO: 14653 - RNA, 20 nt, Artificial Sequence
  MKO10014653_A_Dnuuip2
  gRNA
auaagcacaaugaucuccgc

SEQ ID NO: 14654 - RNA, 20 nt, Artificial Sequence
  MKO10014654_A_Dnuuip2
  gRNA
agaugugucccaauucuccg

SEQ ID NO: 14655 - RNA, 20 nt, Artificial Sequence
  MKO10014655_A_Dnuuip2
  gRNA
aucgacuucagaagcagcgc

SEQ ID NO: 14656 - RNA, 20 nt, Artificial Sequence
  MKO10014656_A_Dnuu
  gRNA
cagcuccgagcucgaacucu

SEQ ID NO: 14657 - RNA, 20 nt, Artificial Sequence
  MKO10014657_A_Dnuu
  gRNA
ugacauccgauuucgagacu

SEQ ID NO: 14658 - RNA, 20 nt, Artificial Sequence
  MKO10014658_A_Dnuu
  gRNA
accucguuaccgugaauagu

SEQ ID NO: 14659 - RNA, 20 nt, Artificial Sequence
  MKO10014659_A_Doc2a
  gRNA
gcugacguacagcgggauca

SEQ ID NO: 14660 - RNA, 20 nt, Artificial Sequence
  MKO10014660_A_Doc2a
  gRNA
ggaccgggaccuggcgcuca

SEQ ID NO: 14661 - RNA, 20 nt, Artificial Sequence
  MKO10014661_A_Doc2a
  gRNA
acaucacccacaaggugcuc

SEQ ID NO: 14662 - RNA, 20 nt, Artificial Sequence
  MKO10014662_A_Doc2b
  gRNA
cagcagguguaguuugacgu

SEQ ID NO: 14663 - RNA, 20 nt, Artificial Sequence
  MKO10014663_A_Doc2b
  gRNA
ccgugauuccguaauaagug

SEQ ID NO: 14664 - RNA, 20 nt, Artificial Sequence
  MKO10014664_A_Doc2b
  gRNA
cacagccgcccuggguacgc

SEQ ID NO: 14665 - RNA, 20 nt, Artificial Sequence
  MKO10014665_A_Doc2g
  gRNA
gaacagugcguguccgaagc

SEQ ID NO: 14666 - RNA, 20 nt, Artificial Sequence
  MKO10014666_A_Doc2g
  gRNA
cugcacagcccaucgugcaa

SEQ ID NO: 14667 - RNA, 20 nt, Artificial Sequence
  MKO10014667_A_Doc2g
  gRNA
agcuggugccaaaccgagcc

SEQ ID NO: 14668 - RNA, 20 nt, Artificial Sequence
  MKO10014668_A_Dock10
  gRNA
uauccgaacacucuauucga

SEQ ID NO: 14669 - RNA, 20 nt, Artificial Sequence
  MKO10014669_A_Dock10
  gRNA
ucggauaucccaagaaaccg

SEQ ID NO: 14670 - RNA, 20 nt, Artificial Sequence
  MKO10014670_A_Dock10
  gRNA
uguaguuuaccacguaccac

SEQ ID NO: 14671 - RNA, 20 nt, Artificial Sequence
  MKO10014671_A_Dock11
  gRNA
ggccaaguuaguugaacccc

SEQ ID NO: 14672 - RNA, 20 nt, Artificial Sequence
  MKO10014672_A_Dock11
  gRNA
agugcagucuacuguaccag

SEQ ID NO: 14673 - RNA, 20 nt, Artificial Sequence
  MKO10014673_A_Dock11
  gRNA
gggacuuucggauguugcca

SEQ ID NO: 14674 - RNA, 20 nt, Artificial Sequence
  MKO10014674_A_Dock1
  gRNA
ucaccacaacgcuucgagag

SEQ ID NO: 14675 - RNA, 20 nt, Artificial Sequence
  MKO10014675_A_Dock1
  gRNA
gcacggugucuccaauuuga

SEQ ID NO: 14676 - RNA, 20 nt, Artificial Sequence
  MKO10014676_A_Dock1
  gRNA
agaccacucucgaagcguug

SEQ ID NO: 14677 - RNA, 20 nt, Artificial Sequence
  MKO10014677_A_Dock2
  gRNA
aagaagugacaaccacgcuc

SEQ ID NO: 14678 - RNA, 20 nt, Artificial Sequence
  MKO10014678_A_Dock2
  gRNA
cagcaucucacgcuacagau

SEQ ID NO: 14679 - RNA, 20 nt, Artificial Sequence
  MKO10014679_A_Dock2
  gRNA
gugacaguuuaugcuuuaug

SEQ ID NO: 14680 - RNA, 20 nt, Artificial Sequence
  MKO10014680_A_Dock3
  gRNA
uuagugauaugcagcuuucg

SEQ ID NO: 14681 - RNA, 20 nt, Artificial Sequence
  MKO10014681_A_Dock3
  gRNA
uuacaacaacucuacaagag

SEQ ID NO: 14682 - RNA, 20 nt, Artificial Sequence
  MKO10014682_A_Dock3
  gRNA
auauaguuguuuccacagac

SEQ ID NO: 14683 - RNA, 20 nt, Artificial Sequence
  MKO10014683_A_Dock4
  gRNA
cgggacggugccucgaaagc

SEQ ID NO: 14684 - RNA, 20 nt, Artificial Sequence
  MKO10014684_A_Dock4
  gRNA
cgucccguacggccugucau

SEQ ID NO: 14685 - RNA, 20 nt, Artificial Sequence
  MKO10014685_A_Dock4
  gRNA
ccgagaugacaucaacuuua

SEQ ID NO: 14686 - RNA, 20 nt, Artificial Sequence
  MKO10014686_A_Dock5
  gRNA
gacggugucgccgaucugca

SEQ ID NO: 14687 - RNA, 20 nt, Artificial Sequence
  MKO10014687_A_Dock5
  gRNA
caucuggcgcaagcucuaug

SEQ ID NO: 14688 - RNA, 20 nt, Artificial Sequence
  MKO10014688_A_Dock5
  gRNA
ucacaaacacgcuacgagaa

SEQ ID NO: 14689 - RNA, 20 nt, Artificial Sequence
  MKO10014689_A_Dock6
  gRNA
gguucgaugaccuccgucag

SEQ ID NO: 14690 - RNA, 20 nt, Artificial Sequence
  MKO10014690_A_Dock6
  gRNA
ccgucgcuccaguaguuccc

SEQ ID NO: 14691 - RNA, 20 nt, Artificial Sequence
  MKO10014691_A_Dock6
  gRNA
acugggucauuguacgcaga

SEQ ID NO: 14692 - RNA, 20 nt, Artificial Sequence
  MKO10014692_A_Dock7
  gRNA
cucgucacucacccguuguc

SEQ ID NO: 14693 - RNA, 20 nt, Artificial Sequence
  MKO10014693_A_Dock7
  gRNA
cagacaacgggugagugacg

SEQ ID NO: 14694 - RNA, 20 nt, Artificial Sequence
  MKO10014694_A_Dock7
  gRNA
gaaucugaugaagcucccga

SEQ ID NO: 14695 - RNA, 20 nt, Artificial Sequence
  MKO10014695_A_Dock8
  gRNA
auguacugauacugugccga

SEQ ID NO: 14696 - RNA, 20 nt, Artificial Sequence
  MKO10014696_A_Dock8
  gRNA
gugcagugaaccggacacuc

SEQ ID NO: 14697 - RNA, 20 nt, Artificial Sequence
  MKO10014697_A_Dock8
  gRNA
uucagaccuauauucgagag

SEQ ID NO: 14698 - RNA, 20 nt, Artificial Sequence
  MKO10014698_A_Dock9
  gRNA
ggggcgguacuuacgcucca

SEQ ID NO: 14699 - RNA, 20 nt, Artificial Sequence
  MKO10014699_A_Dock9
  gRNA
aguaccgccccugccgccuc

SEQ ID NO: 14700 - RNA, 20 nt, Artificial Sequence
  MKO10014700_A_Dock9
  gRNA
accggaaguuuauccagcuu

SEQ ID NO: 14701 - RNA, 20 nt, Artificial Sequence
  MKO10014701_A_Dohh
  gRNA
gaaacgugccagcucgccgu

SEQ ID NO: 14702 - RNA, 20 nt, Artificial Sequence
  MKO10014702_A_Dohh
  gRNA
ccggguuaccaaucgccccc

SEQ ID NO: 14703 - RNA, 20 nt, Artificial Sequence
  MKO10014703_A_Dohh
  gRNA
uagccacucuagacgaccaa

SEQ ID NO: 14704 - RNA, 20 nt, Artificial Sequence
  MKO10014704_A_Dok1
  gRNA
uccagccgcgccacgccgug

SEQ ID NO: 14705 - RNA, 20 nt, Artificial Sequence
  MKO10014705_A_Dok1
  gRNA
cccgaaucggguaccacucg

SEQ ID NO: 14706 - RNA, 20 nt, Artificial Sequence
  MKO10014706_A_Dok1
  gRNA
auacggcguccgccgccagc

SEQ ID NO: 14707 - RNA, 20 nt, Artificial Sequence
  MKO10014707_A_Dok2
  gRNA
uacggcauacucccccucag

SEQ ID NO: 14708 - RNA, 20 nt, Artificial Sequence
  MKO10014708_A_Dok2
  gRNA
caccccgguccggagaguau

SEQ ID NO: 14709 - RNA, 20 nt, Artificial Sequence
  MKO10014709_A_Dok2
  gRNA
ccagucacugcgcucugccg

SEQ ID NO: 14710 - RNA, 20 nt, Artificial Sequence
  MKO10014710_A_Dok3
  gRNA
ucuagccgagcuaccccuga

SEQ ID NO: 14711 - RNA, 20 nt, Artificial Sequence
  MKO10014711_A_Dok3
  gRNA
gaguuggccgggcucggccc

SEQ ID NO: 14712 - RNA, 20 nt, Artificial Sequence
  MKO10014712_A_Dok3
  gRNA
cugccgccauugcccgccag

SEQ ID NO: 14713 - RNA, 20 nt, Artificial Sequence
  MKO10014713_A_Dok4
  gRNA
cccgcgugaagcucgucucg

SEQ ID NO: 14714 - RNA, 20 nt, Artificial Sequence
  MKO10014714_A_Dok4
  gRNA
gcguagcaucucggccauaa

SEQ ID NO: 14715 - RNA, 20 nt, Artificial Sequence
  MKO10014715_A_Dok4
  gRNA
uugacccacagauuuaccgg

SEQ ID NO: 14716 - RNA, 20 nt, Artificial Sequence
  MKO10014716_A_Dok5
  gRNA
ugucucguccauaacgccgc

SEQ ID NO: 14717 - RNA, 20 nt, Artificial Sequence
  MKO10014717_A_Dok5
  gRNA
cuaagugcccugcggcguua

SEQ ID NO: 14718 - RNA, 20 nt, Artificial Sequence
  MKO10014718_A_Dok5
  gRNA
guucaagaaagcuucgagca

SEQ ID NO: 14719 - RNA, 20 nt, Artificial Sequence
  MKO10014719_A_Dok6
  gRNA
cuagcuugaccuucgcauug

SEQ ID NO: 14720 - RNA, 20 nt, Artificial Sequence
  MKO10014720_A_Dok6
  gRNA
ucuuaugccuacacccaacc

SEQ ID NO: 14721 - RNA, 20 nt, Artificial Sequence
  MKO10014721_A_Dok6
  gRNA
guggugcaagcaccuuugca

SEQ ID NO: 14722 - RNA, 20 nt, Artificial Sequence
  MKO10014722_A_Dok7
  gRNA
cuguuugacugcaucguccg

SEQ ID NO: 14723 - RNA, 20 nt, Artificial Sequence
  MKO10014723_A_Dok7
  gRNA
ucaucuucgaaggcgggacc

SEQ ID NO: 14724 - RNA, 20 nt, Artificial Sequence
  MKO10014724_A_Dok7
  gRNA
gggagcucgccgacggggac

SEQ ID NO: 14725 - RNA, 20 nt, Artificial Sequence
  MKO10014725_A_Dolk
  gRNA
augccgaagcgcucgaagua

SEQ ID NO: 14726 - RNA, 20 nt, Artificial Sequence
  MKO10014726_A_Dolk
  gRNA
cguagaaggccugcaccgcg

SEQ ID NO: 14727 - RNA, 20 nt, Artificial Sequence
  MKO10014727_A_Dolk
  gRNA
cgcgaacagcggcuuacugc

SEQ ID NO: 14728 - RNA, 20 nt, Artificial Sequence
  MKO10014728_A_Dolpp1
  gRNA
cacugaaucagggcgucaac

SEQ ID NO: 14729 - RNA, 20 nt, Artificial Sequence
  MKO10014729_A_Dolpp1
  gRNA
ugcaccaaacaaauaacgcc

SEQ ID NO: 14730 - RNA, 20 nt, Artificial Sequence
  MKO10014730_A_Dolpp1
  gRNA
guccccacaggugaucuguc

SEQ ID NO: 14731 - RNA, 20 nt, Artificial Sequence
  MKO10014731_A_Donson
  gRNA
acguguaucguugucugaau

SEQ ID NO: 14732 - RNA, 20 nt, Artificial Sequence
  MKO10014732_A_Donson
  gRNA
cucauauccccuacgacaag

SEQ ID NO: 14733 - RNA, 20 nt, Artificial Sequence
  MKO10014733_A_Donson
  gRNA
gcgcagcgcaguggacaguu

SEQ ID NO: 14734 - RNA, 20 nt, Artificial Sequence
  MKO10014734_A_Dopey1
  gRNA
aguccugcugugcgcuuacc

SEQ ID NO: 14735 - RNA, 20 nt, Artificial Sequence
  MKO10014735_A_Dopey1
  gRNA
aagggucggaguauuaugag

SEQ ID NO: 14736 - RNA, 20 nt, Artificial Sequence
  MKO10014736_A_Dopey1
  gRNA
auguucuggcccaucugaac

SEQ ID NO: 14737 - RNA, 20 nt, Artificial Sequence
  MKO10014737_A_Dopey2
  gRNA
ccuaugccgccaugucgguc

SEQ ID NO: 14738 - RNA, 20 nt, Artificial Sequence
  MKO10014738_A_Dopey2
  gRNA
ccggaccgacauggcggcau

SEQ ID NO: 14739 - RNA, 20 nt, Artificial Sequence
  MKO10014739_A_Dopey2
  gRNA
uugucagaacgcugccccac

SEQ ID NO: 14740 - RNA, 20 nt, Artificial Sequence
  MKO10014740_A_Dos
  gRNA
ccgccgcguguccuucaacg

SEQ ID NO: 14741 - RNA, 20 nt, Artificial Sequence
  MKO10014741_A_Dos
  gRNA
aggugcaccagcgcuucaac

SEQ ID NO: 14742 - RNA, 20 nt, Artificial Sequence
  MKO10014742_A_Dos
  gRNA
gcuguucguuggaggcacgc

SEQ ID NO: 14743 - RNA, 20 nt, Artificial Sequence
  MKO10014743_A_Dot1l
  gRNA
ugaucgacuacgacaccaaa

SEQ ID NO: 14744 - RNA, 20 nt, Artificial Sequence
  MKO10014744_A_Dot1l
  gRNA
cacugcccaggucgacaaac

SEQ ID NO: 14745 - RNA, 20 nt, Artificial Sequence
  MKO10014745_A_Dot1l
  gRNA
agugguuauauaccugcugc

SEQ ID NO: 14746 - RNA, 20 nt, Artificial Sequence
  MKO10014746_A_Doxl2
  gRNA
gccuacgaaguuccuagacg

SEQ ID NO: 14747 - RNA, 20 nt, Artificial Sequence
  MKO10014747_A_Doxl2
  gRNA
accaccaucuauacccguga

SEQ ID NO: 14748 - RNA, 20 nt, Artificial Sequence
  MKO10014748_A_Doxl2
  gRNA
ggcgcugcgaauuucccacc

SEQ ID NO: 14749 - RNA, 20 nt, Artificial Sequence
  MKO10014749_A_Dpagu1
  gRNA
gccccauguagacguaguac

SEQ ID NO: 14750 - RNA, 20 nt, Artificial Sequence
  MKO10014750_A_Dpagu1
  gRNA
augauguccucaaucuccgc

SEQ ID NO: 14751 - RNA, 20 nt, Artificial Sequence
  MKO10014751_A_Dpagu1
  gRNA
cuaggccauuaaugcccgcc

SEQ ID NO: 14752 - RNA, 20 nt, Artificial Sequence
  MKO10014752_A_Dpcd
  gRNA
ggagauuucgaauccgccac

SEQ ID NO: 14753 - RNA, 20 nt, Artificial Sequence
  MKO10014753_A_Dpcd
  gRNA
ucgaaaucuccccuacccga

SEQ ID NO: 14754 - RNA, 20 nt, Artificial Sequence
  MKO10014754_A_Dpcd
  gRNA
cucaacgcagaauccucuag

SEQ ID NO: 14755 - RNA, 20 nt, Artificial Sequence
  MKO10014755_A_Dpcr1
  gRNA
accugauuucgucguuaagc

SEQ ID NO: 14756 - RNA, 20 nt, Artificial Sequence
  MKO10014756_A_Dpcr1
  gRNA
accagcuuaacgacgaaauc

SEQ ID NO: 14757 - RNA, 20 nt, Artificial Sequence
  MKO10014757_A_Dpcr1
  gRNA
auggcgugcucgugaugcac

SEQ ID NO: 14758 - RNA, 20 nt, Artificial Sequence
  MKO10014758_A_Dpep1
  gRNA
gccuuccacgccgaucagac

SEQ ID NO: 14759 - RNA, 20 nt, Artificial Sequence
  MKO10014759_A_Dpep1
  gRNA
accagggcguguugcaauug

SEQ ID NO: 14760 - RNA, 20 nt, Artificial Sequence
  MKO10014760_A_Dpep1
  gRNA
cucucuucagggccgacaac

SEQ ID NO: 14761 - RNA, 20 nt, Artificial Sequence
  MKO10014761_A_Dpep2
  gRNA
uuacguaccaugccagacgc

SEQ ID NO: 14762 - RNA, 20 nt, Artificial Sequence
  MKO10014762_A_Dpep2
  gRNA
gagcucuugcgcgaucucgc

SEQ ID NO: 14763 - RNA, 20 nt, Artificial Sequence
  MKO10014763_A_Dpep2
  gRNA
ggagcaagccggcacggaug

SEQ ID NO: 14764 - RNA, 20 nt, Artificial Sequence
  MKO10014764_A_Dpep3
  gRNA
ggcguacggcaucccggucc

SEQ ID NO: 14765 - RNA, 20 nt, Artificial Sequence
  MKO10014765_A_Dpep3
  gRNA
aaucugcgcaauuucacccg

SEQ ID NO: 14766 - RNA, 20 nt, Artificial Sequence
  MKO10014766_A_Dpep3
  gRNA
agaccaaccuggauaggcuc

SEQ ID NO: 14767 - RNA, 20 nt, Artificial Sequence
  MKO10014767_A_Dpf1
  gRNA
cccaccgaucuuguacucgc

SEQ ID NO: 14768 - RNA, 20 nt, Artificial Sequence
  MKO10014768_A_Dpf1
  gRNA
cggcccugcgaguacaagau

SEQ ID NO: 14769 - RNA, 20 nt, Artificial Sequence
  MKO10014769_A_Dpf1
  gRNA
cccgguagaaguccucgcca

SEQ ID NO: 14770 - RNA, 20 nt, Artificial Sequence
  MKO10014770_A_Dpf2
  gRNA
ccgaguugacgaugacagcc

SEQ ID NO: 14771 - RNA, 20 nt, Artificial Sequence
  MKO10014771_A_Dpf2
  gRNA
ccucuaccugguuuaaucga

SEQ ID NO: 14772 - RNA, 20 nt, Artificial Sequence
  MKO10014772_A_Dpf2
  gRNA
cuguuagcaacagucgagca

SEQ ID NO: 14773 - RNA, 20 nt, Artificial Sequence
  MKO10014773_A_Dpf3
  gRNA
gcgacgauugcacccaccag

SEQ ID NO: 14774 - RNA, 20 nt, Artificial Sequence
  MKO10014774_A_Dpf3
  gRNA
acugccggagcuacaacucg

SEQ ID NO: 14775 - RNA, 20 nt, Artificial Sequence
  MKO10014775_A_Dpf3
  gRNA
uacucccucgccgcgaagca

SEQ ID NO: 14776 - RNA, 20 nt, Artificial Sequence
  MKO10014776_A_Dph1
  gRNA
ccgagucuuguaugucuucg

SEQ ID NO: 14777 - RNA, 20 nt, Artificial Sequence
  MKO10014777_A_Dph1
  gRNA
gucuugaacggaggugucca

SEQ ID NO: 14778 - RNA, 20 nt, Artificial Sequence
  MKO10014778_A_Dph1
  gRNA
agcugugaccauagugcacc

SEQ ID NO: 14779 - RNA, 20 nt, Artificial Sequence
  MKO10014779_A_Dph2
  gRNA
acguagcuauguguuagccg

SEQ ID NO: 14780 - RNA, 20 nt, Artificial Sequence
  MKO10014780_A_Dph2
  gRNA
uugagaagccccuacauaga

SEQ ID NO: 14781 - RNA, 20 nt, Artificial Sequence
  MKO10014781_A_Dph2
  gRNA
cucccgcaucuccuaguaac

SEQ ID NO: 14782 - RNA, 20 nt, Artificial Sequence
  MKO10014782_A_Dph3
  gRNA
cauggcgguguuucacgacg

SEQ ID NO: 14783 - RNA, 20 nt, Artificial Sequence
  MKO10014783_A_Dph3
  gRNA
cucgucgugaaacaccgcca

SEQ ID NO: 14784 - RNA, 20 nt, Artificial Sequence
  MKO10014784_A_Dph3
  gRNA
ucuuaggaucaguucaugug

SEQ ID NO: 14785 - RNA, 20 nt, Artificial Sequence
  MKO10014785_A_Dph5
  gRNA
gccuccauaaugaacgcugu

SEQ ID NO: 14786 - RNA, 20 nt, Artificial Sequence
  MKO10014786_A_Dph5
  gRNA
gcagccuacagcguucauua

SEQ ID NO: 14787 - RNA, 20 nt, Artificial Sequence
  MKO10014787_A_Dph5
  gRNA
gcacagcgugugcaugccau

SEQ ID NO: 14788 - RNA, 20 nt, Artificial Sequence
  MKO10014788_A_Dph6
  gRNA
auacucucugacuaucaacg

SEQ ID NO: 14789 - RNA, 20 nt, Artificial Sequence
  MKO10014789_A_Dph6
  gRNA
agaguuuauacgcaauguga

SEQ ID NO: 14790 - RNA, 20 nt, Artificial Sequence
  MKO10014790_A_Dph6
  gRNA
cuguaucgcagagccaucag

SEQ ID NO: 14791 - RNA, 20 nt, Artificial Sequence
  MKO10014791_A_Dph7
  gRNA
agacgaccuaaacgaacuug

SEQ ID NO: 14792 - RNA, 20 nt, Artificial Sequence
  MKO10014792_A_Dph7
  gRNA
agugagccucaaguucguuu

SEQ ID NO: 14793 - RNA, 20 nt, Artificial Sequence
  MKO10014793_A_Dph7
  gRNA
gaucauuagcagugauucua

SEQ ID NO: 14794 - RNA, 20 nt, Artificial Sequence
  MKO10014794_A_Dpm1
  gRNA
gcaacuucucuugucccguc

SEQ ID NO: 14795 - RNA, 20 nt, Artificial Sequence
  MKO10014795_A_Dpm1
  gRNA
gaugaucacauaguuccccg

SEQ ID NO: 14796 - RNA, 20 nt, Artificial Sequence
  MKO10014796_A_Dpm1
  gRNA
uguaccuaccugauaaauuc

SEQ ID NO: 14797 - RNA, 20 nt, Artificial Sequence
  MKO10014797_A_Dpm2
  gRNA
ggccugcggccaacgggagg

SEQ ID NO: 14798 - RNA, 20 nt, Artificial Sequence
  MKO10014798_A_Dpm2
  gRNA
cuacgccguccuccucccgu

SEQ ID NO: 14799 - RNA, 20 nt, Artificial Sequence
  MKO10014799_A_Dpm2
  gRNA
ucuucaccuacuacaccacu

SEQ ID NO: 14800 - RNA, 20 nt, Artificial Sequence
  MKO10014800_A_Dpm3
  gRNA
cgcgauagcccaccgugccc

SEQ ID NO: 14801 - RNA, 20 nt, Artificial Sequence
  MKO10014801_A_Dpm3
  gRNA
agcuacauuucacgacugcg

SEQ ID NO: 14802 - RNA, 20 nt, Artificial Sequence
  MKO10014802_A_Dpm3
  gRNA
cccgagcugauuuagcacgc

SEQ ID NO: 14803 - RNA, 20 nt, Artificial Sequence
  MKO10014803_A_Dpp10
  gRNA
ccugcuuaacgucguaugcc

SEQ ID NO: 14804 - RNA, 20 nt, Artificial Sequence
  MKO10014804_A_Dpp10
  gRNA
auggauuaccugguguuaac

SEQ ID NO: 14805 - RNA, 20 nt, Artificial Sequence
  MKO10014805_A_Dpp10
  gRNA
gggaaucgccauugcccugc

SEQ ID NO: 14806 - RNA, 20 nt, Artificial Sequence
  MKO10014806_A_Dpp3
  gRNA
aaccgaggcuucgacaucuu

SEQ ID NO: 14807 - RNA, 20 nt, Artificial Sequence
  MKO10014807_A_Dpp3
  gRNA
uucaaggucguuggccagga

SEQ ID NO: 14808 - RNA, 20 nt, Artificial Sequence
  MKO10014808_A_Dpp3
  gRNA
agaccccugcagcguagacc

SEQ ID NO: 14809 - RNA, 20 nt, Artificial Sequence
  MKO10014809_A_Dpp4
  gRNA
cagcuagugaauacguucug

SEQ ID NO: 14810 - RNA, 20 nt, Artificial Sequence
  MKO10014810_A_Dpp4
  gRNA
cugcuugcagacaccgugga

SEQ ID NO: 14811 - RNA, 20 nt, Artificial Sequence
  MKO10014811_A_Dpp4
  gRNA
ugaccgacuguuuguucucu

SEQ ID NO: 14812 - RNA, 20 nt, Artificial Sequence
  MKO10014812_A_Dpp6
  gRNA
uuugccuucuauuaacaccg

SEQ ID NO: 14813 - RNA, 20 nt, Artificial Sequence
  MKO10014813_A_Dpp6
  gRNA
acucaccggcuccacauuau

SEQ ID NO: 14814 - RNA, 20 nt, Artificial Sequence
  MKO10014814_A_Dpp6
  gRNA
cauccauaccuggggucaac

SEQ ID NO: 14815 - RNA, 20 nt, Artificial Sequence
  MKO10014815_A_Dpp7
  gRNA
caccugacacuaggaaccgc

SEQ ID NO: 14816 - RNA, 20 nt, Artificial Sequence
  MKO10014816_A_Dpp7
  gRNA
gcuuucugcagcgguacuau

SEQ ID NO: 14817 - RNA, 20 nt, Artificial Sequence
  MKO10014817_A_Dpp7
  gRNA
gaugcccccaccauagccuu

SEQ ID NO: 14818 - RNA, 20 nt, Artificial Sequence
  MKO10014818_A_Dpp8
  gRNA
aucacaggaccgacccaaac

SEQ ID NO: 14819 - RNA, 20 nt, Artificial Sequence
  MKO10014819_A_Dpp8
  gRNA
gaauaccguucgacauaaaa

SEQ ID NO: 14820 - RNA, 20 nt, Artificial Sequence
  MKO10014820_A_Dpp8
  gRNA
aucauaagcugcgaucccca

SEQ ID NO: 14821 - RNA, 20 nt, Artificial Sequence
  MKO10014821_A_Dpp9
  gRNA
gaggaguucgaccgcuucac

SEQ ID NO: 14822 - RNA, 20 nt, Artificial Sequence
  MKO10014822_A_Dpp9
  gRNA
gguguccccgaugaagccac

SEQ ID NO: 14823 - RNA, 20 nt, Artificial Sequence
  MKO10014823_A_Dpp9
  gRNA
ccgagauccccaagaaagug

SEQ ID NO: 14824 - RNA, 20 nt, Artificial Sequence
  MKO10014824_A_Dppa1
  gRNA
auggccccucaaauggcaac

SEQ ID NO: 14825 - RNA, 20 nt, Artificial Sequence
  MKO10014825_A_Dppa1
  gRNA
gucacucacuuaugauaguc

SEQ ID NO: 14826 - RNA, 20 nt, Artificial Sequence
  MKO10014826_A_Dppa1
  gRNA
gucgacagugucuacagcuu

SEQ ID NO: 14827 - RNA, 20 nt, Artificial Sequence
  MKO10014827_A_Dppa2
  gRNA
ugcguagcguagucuguguu

SEQ ID NO: 14828 - RNA, 20 nt, Artificial Sequence
  MKO10014828_A_Dppa2
  gRNA
ccuuaucucagcccguucuc

SEQ ID NO: 14829 - RNA, 20 nt, Artificial Sequence
  MKO10014829_A_Dppa2
  gRNA
accuuagaccacacaccacc

SEQ ID NO: 14830 - RNA, 20 nt, Artificial Sequence
  MKO10014830_A_Dppa3
  gRNA
ugcgguuccguagacugcgc

SEQ ID NO: 14831 - RNA, 20 nt, Artificial Sequence
  MKO10014831_A_Dppa3
  gRNA
ccgcacgccggcgcagucua

SEQ ID NO: 14832 - RNA, 20 nt, Artificial Sequence
  MKO10014832_A_Dppa3
  gRNA
agauugagcagagacaaaaa

SEQ ID NO: 14833 - RNA, 20 nt, Artificial Sequence
  MKO10014833_A_Dppa4
  gRNA
uaauacccuagcuggaguug

SEQ ID NO: 14834 - RNA, 20 nt, Artificial Sequence
  MKO10014834_A_Dppa4
  gRNA
ccccucagguuguaaaccaa

SEQ ID NO: 14835 - RNA, 20 nt, Artificial Sequence
  MKO10014835_A_Dppa4
  gRNA
cuaaccuuugacuucugaug

SEQ ID NO: 14836 - RNA, 20 nt, Artificial Sequence
  MKO10014836_A_Dppa5a
  gRNA
cccguaaagauauccccccg

SEQ ID NO: 14837 - RNA, 20 nt, Artificial Sequence
  MKO10014837_A_Dppa5a
  gRNA
gauauuucagcaccagcgac

SEQ ID NO: 14838 - RNA, 20 nt, Artificial Sequence
  MKO10014838_A_Dppa5a
  gRNA
ucgaaugucucacaucgagc

SEQ ID NO: 14839 - RNA, 20 nt, Artificial Sequence
  MKO10014839_A_Dpt
  gRNA
ccgcuacuucgaaucagugc

SEQ ID NO: 14840 - RNA, 20 nt, Artificial Sequence
  MKO10014840_A_Dpt
  gRNA
auccaucaucaccguagucc

SEQ ID NO: 14841 - RNA, 20 nt, Artificial Sequence
  MKO10014841_A_Dpt
  gRNA
cgcagucguagucagucauc

SEQ ID NO: 14842 - RNA, 20 nt, Artificial Sequence
  MKO10014842_A_Dpy19l1
  gRNA
gauggcuuuccgcacugaaa

SEQ ID NO: 14843 - RNA, 20 nt, Artificial Sequence
  MKO10014843_A_Dpy19l1
  gRNA
cgcaccucuuugaaaacgau

SEQ ID NO: 14844 - RNA, 20 nt, Artificial Sequence
  MKO10014844_A_Dpy19l1
  gRNA
ccggauuuauaccaaaauaa

SEQ ID NO: 14845 - RNA, 20 nt, Artificial Sequence
  MKO10014845_A_Dpy19l2
  gRNA
uaucgaagcaccuucguuuc

SEQ ID NO: 14846 - RNA, 20 nt, Artificial Sequence
  MKO10014846_A_Dpy19l2
  gRNA
uaugauugugcgauaccagu

SEQ ID NO: 14847 - RNA, 20 nt, Artificial Sequence
  MKO10014847_A_Dpy19l2
  gRNA
uauagguagucauagccuac

SEQ ID NO: 14848 - RNA, 20 nt, Artificial Sequence
  MKO10014848_A_Dpy19l3
  gRNA
acuucuuacauccguuuacc

SEQ ID NO: 14849 - RNA, 20 nt, Artificial Sequence
  MKO10014849_A_Dpy19l3
  gRNA
gccgggauuaccuugcagga

SEQ ID NO: 14850 - RNA, 20 nt, Artificial Sequence
  MKO10014850_A_Dpy19l3
  gRNA
cccugcaugagaacgauuug

SEQ ID NO: 14851 - RNA, 20 nt, Artificial Sequence
  MKO10014851_A_Dpy19l4
  gRNA
ugucucgcagccguuauuag

SEQ ID NO: 14852 - RNA, 20 nt, Artificial Sequence
  MKO10014852_A_Dpy19l4
  gRNA
gccauaccucucucgaauga

SEQ ID NO: 14853 - RNA, 20 nt, Artificial Sequence
  MKO10014853_A_Dpy19l4
  gRNA
cgagcgagagaucaccuucc

SEQ ID NO: 14854 - RNA, 20 nt, Artificial Sequence
  MKO10014854_A_Dpy30
  gRNA
gcaagucccuguaauaagau

SEQ ID NO: 14855 - RNA, 20 nt, Artificial Sequence
  MKO10014855_A_Dpy30
  gRNA
aguugugccuaucuuauuac

SEQ ID NO: 14856 - RNA, 20 nt, Artificial Sequence
  MKO10014856_A_Dpy30
  gRNA
gugagcccguacucagagug

SEQ ID NO: 14857 - RNA, 20 nt, Artificial Sequence
  MKO10014857_A_Dpyd
  gRNA
gacaucaagcacacgacucu

SEQ ID NO: 14858 - RNA, 20 nt, Artificial Sequence
  MKO10014858_A_Dpyd
  gRNA
uaucacaaguaucgccaaca

SEQ ID NO: 14859 - RNA, 20 nt, Artificial Sequence
  MKO10014859_A_Dpyd
  gRNA
auuccacaaguaagaccaag

SEQ ID NO: 14860 - RNA, 20 nt, Artificial Sequence
  MKO10014860_A_Dpysl2
  gRNA
aguaugcacgucaaucccuc

SEQ ID NO: 14861 - RNA, 20 nt, Artificial Sequence
  MKO10014861_A_Dpysl2
  gRNA
ucaccccuccugguacaauc

SEQ ID NO: 14862 - RNA, 20 nt, Artificial Sequence
  MKO10014862_A_Dpysl2
  gRNA
cugugacuauucgcugcacg

SEQ ID NO: 14863 - RNA, 20 nt, Artificial Sequence
  MKO10014863_A_Dpysl3
  gRNA
ggcaggcguuaacuccuuca

SEQ ID NO: 14864 - RNA, 20 nt, Artificial Sequence
  MKO10014864_A_Dpysl3
  gRNA
ccuaugaaaaguggcgugag

SEQ ID NO: 14865 - RNA, 20 nt, Artificial Sequence
  MKO10014865_A_Dpysl3
  gRNA
cuggaaugacagcgucaagc

SEQ ID NO: 14866 - RNA, 20 nt, Artificial Sequence
  MKO10014866_A_Dpysl4
  gRNA
ggagaaaaucucaucguccc

SEQ ID NO: 14867 - RNA, 20 nt, Artificial Sequence
  MKO10014867_A_Dpysl4
  gRNA
agcgaccgccuucucaucaa

SEQ ID NO: 14868 - RNA, 20 nt, Artificial Sequence
  MKO10014868_A_Dpysl4
  gRNA
uuggugcucucgugccagcg

SEQ ID NO: 14869 - RNA, 20 nt, Artificial Sequence
  MKO10014869_A_Dpysl5
  gRNA
caggacgugaccgaugauca

SEQ ID NO: 14870 - RNA, 20 nt, Artificial Sequence
  MKO10014870_A_Dpysl5
  gRNA
gaucgccccgaugucccugc

SEQ ID NO: 14871 - RNA, 20 nt, Artificial Sequence
  MKO10014871_A_Dpysl5
  gRNA
uuccuucaggcggcccucgu

SEQ ID NO: 14872 - RNA, 20 nt, Artificial Sequence
  MKO10014872_A_Dpys
  gRNA
aucacaugcacgacguauaa

SEQ ID NO: 14873 - RNA, 20 nt, Artificial Sequence
  MKO10014873_A_Dpys
  gRNA
aaaacccuugcccgagauaa

SEQ ID NO: 14874 - RNA, 20 nt, Artificial Sequence
  MKO10014874_A_Dpys
  gRNA
ccaguugcgccaagucucaa

SEQ ID NO: 14875 - RNA, 20 nt, Artificial Sequence
  MKO10014875_A_Dqx1
  gRNA
ggcaagacugcuucgggcaa

SEQ ID NO: 14876 - RNA, 20 nt, Artificial Sequence
  MKO10014876_A_Dqx1
  gRNA
gauuggauacagcaucccuc

SEQ ID NO: 14877 - RNA, 20 nt, Artificial Sequence
  MKO10014877_A_Dqx1
  gRNA
gcagcuuccaccaggucggu

SEQ ID NO: 14878 - RNA, 20 nt, Artificial Sequence
  MKO10014878_A_Dr1
  gRNA
gauacgauggcuuccucguc

SEQ ID NO: 14879 - RNA, 20 nt, Artificial Sequence
  MKO10014879_A_Dr1
  gRNA
aucaucgucguugccagacg

SEQ ID NO: 14880 - RNA, 20 nt, Artificial Sequence
  MKO10014880_A_Dr1
  gRNA
gccagcgcguccacucaagc

SEQ ID NO: 14881 - RNA, 20 nt, Artificial Sequence
  MKO10014881_A_Dram1
  gRNA
ccaugauggcggugcgcuuc

SEQ ID NO: 14882 - RNA, 20 nt, Artificial Sequence
  MKO10014882_A_Dram1
  gRNA
uguaggagaugaucgauugc

SEQ ID NO: 14883 - RNA, 20 nt, Artificial Sequence
  MKO10014883_A_Dram1
  gRNA
ucccaccaauccaagcgcca

SEQ ID NO: 14884 - RNA, 20 nt, Artificial Sequence
  MKO10014884_A_Dram2
  gRNA
uuccgucggcccuuguaauu

SEQ ID NO: 14885 - RNA, 20 nt, Artificial Sequence
  MKO10014885_A_Dram2
  gRNA
auucugcugccguaguaacc

SEQ ID NO: 14886 - RNA, 20 nt, Artificial Sequence
  MKO10014886_A_Dram2
  gRNA
acccugcauugccuuauauc

SEQ ID NO: 14887 - RNA, 20 nt, Artificial Sequence
  MKO10014887_A_Drap1
  gRNA
uucccgaaggggccggaaac

SEQ ID NO: 14888 - RNA, 20 nt, Artificial Sequence
  MKO10014888_A_Drap1
  gRNA
gacccuuguccccauccacg

SEQ ID NO: 14889 - RNA, 20 nt, Artificial Sequence
  MKO10014889_A_Drap1
  gRNA
ccuguugaagaaggcuugcc

SEQ ID NO: 14890 - RNA, 20 nt, Artificial Sequence
  MKO10014890_A_Draxin
  gRNA
cgaggucucguuaccaucac

SEQ ID NO: 14891 - RNA, 20 nt, Artificial Sequence
  MKO10014891_A_Draxin
  gRNA
uaacgagaccucgccagcug

SEQ ID NO: 14892 - RNA, 20 nt, Artificial Sequence
  MKO10014892_A_Draxin
  gRNA
uuucgacgacugcaugugca

SEQ ID NO: 14893 - RNA, 20 nt, Artificial Sequence
  MKO10014893_A_Drc1
  gRNA
uugaugaaaucacggcgaag

SEQ ID NO: 14894 - RNA, 20 nt, Artificial Sequence
  MKO10014894_A_Drc1
  gRNA
cgaguuggugacaaauauuc

SEQ ID NO: 14895 - RNA, 20 nt, Artificial Sequence
  MKO10014895_A_Drc1
  gRNA
uucuugccguucugacucaa

SEQ ID NO: 14896 - RNA, 20 nt, Artificial Sequence
  MKO10014896_A_Drd1a
  gRNA
ucauccugauuagcguagca

SEQ ID NO: 14897 - RNA, 20 nt, Artificial Sequence
  MKO10014897_A_Drd1a
  gRNA
aaguccaugcuacgcuaauc

SEQ ID NO: 14898 - RNA, 20 nt, Artificial Sequence
  MKO10014898_A_Drd1a
  gRNA
auaguccaauaugaccgaua

SEQ ID NO: 14899 - RNA, 20 nt, Artificial Sequence
  MKO10014899_A_Drd2
  gRNA
acaucguucuccgcaagcgu

SEQ ID NO: 14900 - RNA, 20 nt, Artificial Sequence
  MKO10014900_A_Drd2
  gRNA
ugacccgcuuccgacgcuug

SEQ ID NO: 14901 - RNA, 20 nt, Artificial Sequence
  MKO10014901_A_Drd2
  gRNA
caugacaguaacucggcgcu

SEQ ID NO: 14902 - RNA, 20 nt, Artificial Sequence
  MKO10014902_A_Drd3
  gRNA
caugagcgccacacgucgac

SEQ ID NO: 14903 - RNA, 20 nt, Artificial Sequence
  MKO10014903_A_Drd3
  gRNA
gcagagcuccugucgacgug

SEQ ID NO: 14904 - RNA, 20 nt, Artificial Sequence
  MKO10014904_A_Drd3
  gRNA
cccacuuaccauuugucccg

SEQ ID NO: 14905 - RNA, 20 nt, Artificial Sequence
  MKO10014905_A_Drd4
  gRNA
ucgaaacuccgcguugaaga

SEQ ID NO: 14906 - RNA, 20 nt, Artificial Sequence
  MKO10014906_A_Drd4
  gRNA
cucgcucgugugcgugagcg

SEQ ID NO: 14907 - RNA, 20 nt, Artificial Sequence
  MKO10014907_A_Drd4
  gRNA
cgcggccgggcacaucauug

SEQ ID NO: 14908 - RNA, 20 nt, Artificial Sequence
  MKO10014908_A_Drd5
  gRNA
gcgcaauggcaccgcacauc

SEQ ID NO: 14909 - RNA, 20 nt, Artificial Sequence
  MKO10014909_A_Drd5
  gRNA
cccgcgcagguggucaccgc

SEQ ID NO: 14910 - RNA, 20 nt, Artificial Sequence
  MKO10014910_A_Drd5
  gRNA
gggucaucuugcgcucguag

SEQ ID NO: 14911 - RNA, 20 nt, Artificial Sequence
  MKO10014911_A_Drg1
  gRNA
aagacaggugaugcucgaau

SEQ ID NO: 14912 - RNA, 20 nt, Artificial Sequence
  MKO10014912_A_Drg1
  gRNA
guucucuucgaaguuuagca

SEQ ID NO: 14913 - RNA, 20 nt, Artificial Sequence
  MKO10014913_A_Drg1
  gRNA
agaggucgucaagucauugc

SEQ ID NO: 14914 - RNA, 20 nt, Artificial Sequence
  MKO10014914_A_Drg2
  gRNA
gacaucagcugugcgugcua

SEQ ID NO: 14915 - RNA, 20 nt, Artificial Sequence
  MKO10014915_A_Drg2
  gRNA
uccagccaccgaguaccacc

SEQ ID NO: 14916 - RNA, 20 nt, Artificial Sequence
  MKO10014916_A_Drg2
  gRNA
ucaccugccggccacggccu

SEQ ID NO: 14917 - RNA, 20 nt, Artificial Sequence
  MKO10014917_A_Drosha
  gRNA
ucaagcacuacgacgaccac

SEQ ID NO: 14918 - RNA, 20 nt, Artificial Sequence
  MKO10014918_A_Drosha
  gRNA
cauagaaugucguaccaccc

SEQ ID NO: 14919 - RNA, 20 nt, Artificial Sequence
  MKO10014919_A_Drosha
  gRNA
gcagaucaccgucucuagaa

SEQ ID NO: 14920 - RNA, 20 nt, Artificial Sequence
  MKO10014920_A_Drp2
  gRNA
uacgugcagcgcucgccuag

SEQ ID NO: 14921 - RNA, 20 nt, Artificial Sequence
  MKO10014921_A_Drp2
  gRNA
gcuuccauacaaagcgacua

SEQ ID NO: 14922 - RNA, 20 nt, Artificial Sequence
  MKO10014922_A_Drp2
  gRNA
cgcuccgagagauuauugac

SEQ ID NO: 14923 - RNA, 20 nt, Artificial Sequence
  MKO10014923_A_Dsc1
  gRNA
agaugcucaccuuugccuac

SEQ ID NO: 14924 - RNA, 20 nt, Artificial Sequence
  MKO10014924_A_Dsc1
  gRNA
ucggguacaauagauguccc

SEQ ID NO: 14925 - RNA, 20 nt, Artificial Sequence
  MKO10014925_A_Dsc1
  gRNA
ucacguucccucucaucuua

SEQ ID NO: 14926 - RNA, 20 nt, Artificial Sequence
  MKO10014926_A_Dsc2
  gRNA
cuguaaagaagucguccucc

SEQ ID NO: 14927 - RNA, 20 nt, Artificial Sequence
  MKO10014927_A_Dsc2
  gRNA
cuacacgaccagugcaauac

SEQ ID NO: 14928 - RNA, 20 nt, Artificial Sequence
  MKO10014928_A_Dsc2
  gRNA
aguaaagcuucuuugccccg

SEQ ID NO: 14929 - RNA, 20 nt, Artificial Sequence
  MKO10014929_A_Dsc3
  gRNA
ucuauauuguacucggccug

SEQ ID NO: 14930 - RNA, 20 nt, Artificial Sequence
  MKO10014930_A_Dsc3
  gRNA
ucauauuccucacgauccac

SEQ ID NO: 14931 - RNA, 20 nt, Artificial Sequence
  MKO10014931_A_Dsc3
  gRNA
ucauguaccuucaacacuag

SEQ ID NO: 14932 - RNA, 20 nt, Artificial Sequence
  MKO10014932_A_Dscaml1
  gRNA
aauacguuagcgucgugucu

SEQ ID NO: 14933 - RNA, 20 nt, Artificial Sequence
  MKO10014933_A_Dscaml1
  gRNA
aucguagaugucgucccccg

SEQ ID NO: 14934 - RNA, 20 nt, Artificial Sequence
  MKO10014934_A_Dscaml1
  gRNA
cucgucagagcaacggagcu

SEQ ID NO: 14935 - RNA, 20 nt, Artificial Sequence
  MKO10014935_A_Dscam
  gRNA
ugcgguggucaaacccgucc

SEQ ID NO: 14936 - RNA, 20 nt, Artificial Sequence
  MKO10014936_A_Dscam
  gRNA
ccaacuuacguuucacguac

SEQ ID NO: 14937 - RNA, 20 nt, Artificial Sequence
  MKO10014937_A_Dscam
  gRNA
agaucuccucgcccguugcu

SEQ ID NO: 14938 - RNA, 20 nt, Artificial Sequence
  MKO10014938_A_Dscc1
  gRNA
gucugcuaucuucaggucgu

SEQ ID NO: 14939 - RNA, 20 nt, Artificial Sequence
  MKO10014939_A_Dscc1
  gRNA
cgguaccuccgugugaacga

SEQ ID NO: 14940 - RNA, 20 nt, Artificial Sequence
  MKO10014940_A_Dscc1
  gRNA
uacacuaccuccaaucucac

SEQ ID NO: 14941 - RNA, 20 nt, Artificial Sequence
  MKO10014941_A_Dscr3
  gRNA
aaccuugcagaacgucaaag

SEQ ID NO: 14942 - RNA, 20 nt, Artificial Sequence
  MKO10014942_A_Dscr3
  gRNA
uguugacuucacgaucacuc

SEQ ID NO: 14943 - RNA, 20 nt, Artificial Sequence
  MKO10014943_A_Dscr3
  gRNA
uccuggcuucagcacgucua

SEQ ID NO: 14944 - RNA, 20 nt, Artificial Sequence
  MKO10014944_A_Dsel
  gRNA
uuugccccaugaucgaaucu

SEQ ID NO: 14945 - RNA, 20 nt, Artificial Sequence
  MKO10014945_A_Dsel
  gRNA
aauuagaaagcaucgaccua

SEQ ID NO: 14946 - RNA, 20 nt, Artificial Sequence
  MKO10014946_A_Dsel
  gRNA
caaacaccaauacguuguua

SEQ ID NO: 14947 - RNA, 20 nt, Artificial Sequence
  MKO10014947_A_Dse
  gRNA
uauagagaccgucucgcugc

SEQ ID NO: 14948 - RNA, 20 nt, Artificial Sequence
  MKO10014948_A_Dse
  gRNA
uguaaugcuuacccgccuuu

SEQ ID NO: 14949 - RNA, 20 nt, Artificial Sequence
  MKO10014949_A_Dse
  gRNA
cgcuacacaccgaauuucuc

SEQ ID NO: 14950 - RNA, 20 nt, Artificial Sequence
  MKO10014950_A_Dsg1a
  gRNA
uucauuauuaaucaaaaaac

SEQ ID NO: 14951 - RNA, 20 nt, Artificial Sequence
  MKO10014951_A_Dsg1a
  gRNA
uaacagugaauuucaaaucc

SEQ ID NO: 14952 - RNA, 20 nt, Artificial Sequence
  MKO10014952_A_Dsg1a
  gRNA
uucucacuuacuuuggcaau

SEQ ID NO: 14953 - RNA, 20 nt, Artificial Sequence
  MKO10014953_A_Dsg1b
  gRNA
ucaaguggcacuccaucaga

SEQ ID NO: 14954 - RNA, 20 nt, Artificial Sequence
  MKO10014954_A_Dsg1b
  gRNA
accaguaacauaccgcaucu

SEQ ID NO: 14955 - RNA, 20 nt, Artificial Sequence
  MKO10014955_A_Dsg1b
  gRNA
acucugacucuaagcuccag

SEQ ID NO: 14956 - RNA, 20 nt, Artificial Sequence
  MKO10014956_A_Dsg1c
  gRNA
uaacagugaauuucaaaucc

SEQ ID NO: 14957 - RNA, 20 nt, Artificial Sequence
  MKO10014957_A_Dsg1c
  gRNA
uucucacuuacuuuggcaau

SEQ ID NO: 14958 - RNA, 20 nt, Artificial Sequence
  MKO10014958_A_Dsg1c
  gRNA
agagaucauaacgccaaaaa

SEQ ID NO: 14959 - RNA, 20 nt, Artificial Sequence
  MKO10014959_A_Dsg2
  gRNA
ggaauuacagaaccgccuuu

SEQ ID NO: 14960 - RNA, 20 nt, Artificial Sequence
  MKO10014960_A_Dsg2
  gRNA
ucaaagacgaauaugccgaa

SEQ ID NO: 14961 - RNA, 20 nt, Artificial Sequence
  MKO10014961_A_Dsg2
  gRNA
aacuuugaugcguaguucca

SEQ ID NO: 14962 - RNA, 20 nt, Artificial Sequence
  MKO10014962_A_Dsg3
  gRNA
aaaauuaccuaccgcauuuc

SEQ ID NO: 14963 - RNA, 20 nt, Artificial Sequence
  MKO10014963_A_Dsg3
  gRNA
gguuuccucacgaucaacua

SEQ ID NO: 14964 - RNA, 20 nt, Artificial Sequence
  MKO10014964_A_Dsg3
  gRNA
auauggcucaccuuggcaau

SEQ ID NO: 14965 - RNA, 20 nt, Artificial Sequence
  MKO10014965_A_Dsg4
  gRNA
uugauggugaacacuccgua

SEQ ID NO: 14966 - RNA, 20 nt, Artificial Sequence
  MKO10014966_A_Dsg4
  gRNA
ccccgcuccagagauucgau

SEQ ID NO: 14967 - RNA, 20 nt, Artificial Sequence
  MKO10014967_A_Dsg4
  gRNA
guuguccucgcccucccgac

SEQ ID NO: 14968 - RNA, 20 nt, Artificial Sequence
  MKO10014968_A_Dsn1
  gRNA
cgccuugcgucaucauuucc

SEQ ID NO: 14969 - RNA, 20 nt, Artificial Sequence
  MKO10014969_A_Dsn1
  gRNA
gaugacgcaaggcguuucag

SEQ ID NO: 14970 - RNA, 20 nt, Artificial Sequence
  MKO10014970_A_Dsn1
  gRNA
gggcgcccagccguuggcuc

SEQ ID NO: 14971 - RNA, 20 nt, Artificial Sequence
  MKO10014971_A_Dspp
  gRNA
guuagauucgucgcugcucu

SEQ ID NO: 14972 - RNA, 20 nt, Artificial Sequence
  MKO10014972_A_Dspp
  gRNA
ugcacuuaccggaauggccc

SEQ ID NO: 14973 - RNA, 20 nt, Artificial Sequence
  MKO10014973_A_Dspp
  gRNA
aagagcagcgacgaaucuaa

SEQ ID NO: 14974 - RNA, 20 nt, Artificial Sequence
  MKO10014974_A_Dsp
  gRNA
acaccauuggggacuaccgc

SEQ ID NO: 14975 - RNA, 20 nt, Artificial Sequence
  MKO10014975_A_Dsp
  gRNA
uuuggugaacucgucccagc

SEQ ID NO: 14976 - RNA, 20 nt, Artificial Sequence
  MKO10014976_A_Dsp
  gRNA
cgaguucaccaaacgccuca

SEQ ID NO: 14977 - RNA, 20 nt, Artificial Sequence
  MKO10014977_A_Dstn
  gRNA
aaugaucuaugcaagcucga

SEQ ID NO: 14978 - RNA, 20 nt, Artificial Sequence
  MKO10014978_A_Dstn
  gRNA
auuccgacaaaaugcuugaa

SEQ ID NO: 14979 - RNA, 20 nt, Artificial Sequence
  MKO10014979_A_Dstn
  gRNA
cuacacaggggauccuucaa

SEQ ID NO: 14980 - RNA, 20 nt, Artificial Sequence
  MKO10014980_A_Dstyk
  gRNA
gcugcuacagaaccgccuag

SEQ ID NO: 14981 - RNA, 20 nt, Artificial Sequence
  MKO10014981_A_Dstyk
  gRNA
cgucgccuccgcuucaccua

SEQ ID NO: 14982 - RNA, 20 nt, Artificial Sequence
  MKO10014982_A_Dstyk
  gRNA
uggcaccgugcccgagccac

SEQ ID NO: 14983 - RNA, 20 nt, Artificial Sequence
  MKO10014983_A_Dst
  gRNA
gcacgugaacgaucucuacg

SEQ ID NO: 14984 - RNA, 20 nt, Artificial Sequence
  MKO10014984_A_Dst
  gRNA
cgacuauuugaaaagacgcc

SEQ ID NO: 14985 - RNA, 20 nt, Artificial Sequence
  MKO10014985_A_Dst
  gRNA
cuguccuuagccccgggaga

SEQ ID NO: 14986 - RNA, 20 nt, Artificial Sequence
  MKO10014986_A_Dtd1
  gRNA
agucgggcuuguuccccuug

SEQ ID NO: 14987 - RNA, 20 nt, Artificial Sequence
  MKO10014987_A_Dtd1
  gRNA
ggagagcagauaagcgccau

SEQ ID NO: 14988 - RNA, 20 nt, Artificial Sequence
  MKO10014988_A_Dtd1
  gRNA
gaacaagcccgacuuccacc

SEQ ID NO: 14989 - RNA, 20 nt, Artificial Sequence
  MKO10014989_A_Dtd2
  gRNA
caucggccgggcgcacuugc

SEQ ID NO: 14990 - RNA, 20 nt, Artificial Sequence
  MKO10014990_A_Dtd2
  gRNA
gcgguggcgcacggcacgua

SEQ ID NO: 14991 - RNA, 20 nt, Artificial Sequence
  MKO10014991_A_Dtd2
  gRNA
cacacgaccaccguccgcca

SEQ ID NO: 14992 - RNA, 20 nt, Artificial Sequence
  MKO10014992_A_Dtl
  gRNA
aacgaugaacacacgucuua

SEQ ID NO: 14993 - RNA, 20 nt, Artificial Sequence
  MKO10014993_A_Dtl
  gRNA
ugcuaauauaugcuccauac

SEQ ID NO: 14994 - RNA, 20 nt, Artificial Sequence
  MKO10014994_A_Dtl
  gRNA
ccucuacaaucccuucuaag

SEQ ID NO: 14995 - RNA, 20 nt, Artificial Sequence
  MKO10014995_A_Dtna
  gRNA
cgaaaacgcuuugaauaacc

SEQ ID NO: 14996 - RNA, 20 nt, Artificial Sequence
  MKO10014996_A_Dtna
  gRNA
uuccguuguagugcaccugg

SEQ ID NO: 14997 - RNA, 20 nt, Artificial Sequence
  MKO10014997_A_Dtna
  gRNA
cucaguauuugcugucaaaa

SEQ ID NO: 14998 - RNA, 20 nt, Artificial Sequence
  MKO10014998_A_Dtnbp1
  gRNA
cgcuuaccgaaguacucugc

SEQ ID NO: 14999 - RNA, 20 nt, Artificial Sequence
  MKO10014999_A_Dtnbp1
  gRNA
ucuaguccagcagaguacuu

SEQ ID NO: 15000 - RNA, 20 nt, Artificial Sequence
  MKO10015000_A_Dtnbp1
  gRNA
gcugccccugcagcucguuc

SEQ ID NO: 15001 - RNA, 20 nt, Artificial Sequence
  MKO10015001_A_Dtnb
  gRNA
agguacgagccugucguagg

SEQ ID NO: 15002 - RNA, 20 nt, Artificial Sequence
  MKO10015002_A_Dtnb
  gRNA
uucuacucaccagaucagcg

SEQ ID NO: 15003 - RNA, 20 nt, Artificial Sequence
  MKO10015003_A_Dtnb
  gRNA
gcuauguuagcaaccaugug

SEQ ID NO: 15004 - RNA, 20 nt, Artificial Sequence
  MKO10015004_A_Dtwd1
  gRNA
acucaagaggacuacggacg

SEQ ID NO: 15005 - RNA, 20 nt, Artificial Sequence
  MKO10015005_A_Dtwd1
  gRNA
accagaucgccucugaugag

SEQ ID NO: 15006 - RNA, 20 nt, Artificial Sequence
  MKO10015006_A_Dtwd1
  gRNA
guacgaagggaaggaucacg

SEQ ID NO: 15007 - RNA, 20 nt, Artificial Sequence
  MKO10015007_A_Dtwd2
  gRNA
cgcuccucuucguccggcgu

SEQ ID NO: 15008 - RNA, 20 nt, Artificial Sequence
  MKO10015008_A_Dtwd2
  gRNA
cgccuuggcgucaccgacgc

SEQ ID NO: 15009 - RNA, 20 nt, Artificial Sequence
  MKO10015009_A_Dtwd2
  gRNA
cgcucagauucgccucagca

SEQ ID NO: 15010 - RNA, 20 nt, Artificial Sequence
  MKO10015010_A_Dtx1
  gRNA
ucguagaaguugcgucgcac

SEQ ID NO: 15011 - RNA, 20 nt, Artificial Sequence
  MKO10015011_A_Dtx1
  gRNA
caacuucuacgauccaucgu

SEQ ID NO: 15012 - RNA, 20 nt, Artificial Sequence
  MKO10015012_A_Dtx1
  gRNA
cuccccgugaagaacuugaa

SEQ ID NO: 15013 - RNA, 20 nt, Artificial Sequence
  MKO10015013_A_Dtx2
  gRNA
uggcgguagcggcccgacac

SEQ ID NO: 15014 - RNA, 20 nt, Artificial Sequence
  MKO10015014_A_Dtx2
  gRNA
cccaagcucgucucugccgc

SEQ ID NO: 15015 - RNA, 20 nt, Artificial Sequence
  MKO10015015_A_Dtx2
  gRNA
ccacuuggcgucgcacacuc

SEQ ID NO: 15016 - RNA, 20 nt, Artificial Sequence
  MKO10015016_A_Dtx3l
  gRNA
gcccgucguguacccagaug

SEQ ID NO: 15017 - RNA, 20 nt, Artificial Sequence
  MKO10015017_A_Dtx3l
  gRNA
aguuagaaacgagcccgucc

SEQ ID NO: 15018 - RNA, 20 nt, Artificial Sequence
  MKO10015018_A_Dtx3l
  gRNA
ggcucccgcuccacaucggg

SEQ ID NO: 15019 - RNA, 20 nt, Artificial Sequence
  MKO10015019_A_Dtx3
  gRNA
agaccagcauccguccguuc

SEQ ID NO: 15020 - RNA, 20 nt, Artificial Sequence
  MKO10015020_A_Dtx3
  gRNA
ccgauucuacgggcagcuug

SEQ ID NO: 15021 - RNA, 20 nt, Artificial Sequence
  MKO10015021_A_Dtx3
  gRNA
cgggagguaggccacccgug

SEQ ID NO: 15022 - RNA, 20 nt, Artificial Sequence
  MKO10015022_A_Dtx4
  gRNA
ucauaguaguuucgucgaac

SEQ ID NO: 15023 - RNA, 20 nt, Artificial Sequence
  MKO10015023_A_Dtx4
  gRNA
cggcucguguucgagacccc

SEQ ID NO: 15024 - RNA, 20 nt, Artificial Sequence
  MKO10015024_A_Dtx4
  gRNA
gccauguucuuucguacugc

SEQ ID NO: 15025 - RNA, 20 nt, Artificial Sequence
  MKO10015025_A_Dtymk
  gRNA
ugcgggcgauggcgucgcgu

SEQ ID NO: 15026 - RNA, 20 nt, Artificial Sequence
  MKO10015026_A_Dtymk
  gRNA
ucccggucucauaucgcuca

SEQ ID NO: 15027 - RNA, 20 nt, Artificial Sequence
  MKO10015027_A_Dtymk
  gRNA
gcggagcugcugcguuuccc

SEQ ID NO: 15028 - RNA, 20 nt, Artificial Sequence
  MKO10015028_A_Duox1
  gRNA
acuguacgguuccgaagaga

SEQ ID NO: 15029 - RNA, 20 nt, Artificial Sequence
  MKO10015029_A_Duox1
  gRNA
acccccgacaccuuaguaac

SEQ ID NO: 15030 - RNA, 20 nt, Artificial Sequence
  MKO10015030_A_Duox1
  gRNA
gucucaccauacaccccccg

SEQ ID NO: 15031 - RNA, 20 nt, Artificial Sequence
  MKO10015031_A_Duox2
  gRNA
aagugcagcgcuacgacggc

SEQ ID NO: 15032 - RNA, 20 nt, Artificial Sequence
  MKO10015032_A_Duox2
  gRNA
gcggcugcgucgccuaauac

SEQ ID NO: 15033 - RNA, 20 nt, Artificial Sequence
  MKO10015033_A_Duox2
  gRNA
aaucugaaguaccaccagcg

SEQ ID NO: 15034 - RNA, 20 nt, Artificial Sequence
  MKO10015034_A_Duoxa1
  gRNA
acagggcgauaugagugacg

SEQ ID NO: 15035 - RNA, 20 nt, Artificial Sequence
  MKO10015035_A_Duoxa1
  gRNA
aucgcccuguccccugcgcu

SEQ ID NO: 15036 - RNA, 20 nt, Artificial Sequence
  MKO10015036_A_Duoxa1
  gRNA
ggcgucaacaucacccucac

SEQ ID NO: 15037 - RNA, 20 nt, Artificial Sequence
  MKO10015037_A_Duoxa2
  gRNA
ggcguuaacauuacacuccg

SEQ ID NO: 15038 - RNA, 20 nt, Artificial Sequence
  MKO10015038_A_Duoxa2
  gRNA
acuacaaugagcguuucacu

SEQ ID NO: 15039 - RNA, 20 nt, Artificial Sequence
  MKO10015039_A_Duoxa2
  gRNA
gagcggcacgcuggaaaucg

SEQ ID NO: 15040 - RNA, 20 nt, Artificial Sequence
  MKO10015040_A_Dupd1
  gRNA
uuucacgcacgugcugaacg

SEQ ID NO: 15041 - RNA, 20 nt, Artificial Sequence
  MKO10015041_A_Dupd1
  gRNA
caucgaguaccacggcgucg

SEQ ID NO: 15042 - RNA, 20 nt, Artificial Sequence
  MKO10015042_A_Dupd1
  gRNA
ccaguauacacacgucaaug

SEQ ID NO: 15043 - RNA, 20 nt, Artificial Sequence
  MKO10015043_A_Dus1l
  gRNA
gccgccuggacaaacaccuc

SEQ ID NO: 15044 - RNA, 20 nt, Artificial Sequence
  MKO10015044_A_Dus1l
  gRNA
aacggccuugauguguuccc

SEQ ID NO: 15045 - RNA, 20 nt, Artificial Sequence
  MKO10015045_A_Dus1l
  gRNA
caucacaguaaucuugugcu

SEQ ID NO: 15046 - RNA, 20 nt, Artificial Sequence
  MKO10015046_A_Dus2
  gRNA
cguuuacaacucgcuugcac

SEQ ID NO: 15047 - RNA, 20 nt, Artificial Sequence
  MKO10015047_A_Dus2
  gRNA
accuuaguggaauacucuuu

SEQ ID NO: 15048 - RNA, 20 nt, Artificial Sequence
  MKO10015048_A_Dus2
  gRNA
cagugcaagcgaguuguaaa

SEQ ID NO: 15049 - RNA, 20 nt, Artificial Sequence
  MKO10015049_A_Dus3l
  gRNA
uuucgaagagcacgcagcgg

SEQ ID NO: 15050 - RNA, 20 nt, Artificial Sequence
  MKO10015050_A_Dus3l
  gRNA
caugcccagcuagauaccgu

SEQ ID NO: 15051 - RNA, 20 nt, Artificial Sequence
  MKO10015051_A_Dus3l
  gRNA
cgccgcauuugcaagcgcuu

SEQ ID NO: 15052 - RNA, 20 nt, Artificial Sequence
  MKO10015052_A_Dus4l
  gRNA
uuauaggauccacgaugacc

SEQ ID NO: 15053 - RNA, 20 nt, Artificial Sequence
  MKO10015053_A_Dus4l
  gRNA
gccagagcuuguucacgaua

SEQ ID NO: 15054 - RNA, 20 nt, Artificial Sequence
  MKO10015054_A_Dus4l
  gRNA
uaugucuccauuagcaacua

SEQ ID NO: 15055 - RNA, 20 nt, Artificial Sequence
  MKO10015055_A_Dusp10
  gRNA
uuggcgucacgccguuguuu

SEQ ID NO: 15056 - RNA, 20 nt, Artificial Sequence
  MKO10015056_A_Dusp10
  gRNA
gucccgucaucaucgauugc

SEQ ID NO: 15057 - RNA, 20 nt, Artificial Sequence
  MKO10015057_A_Dusp10
  gRNA
gacgcuuacaaauucgucaa

SEQ ID NO: 15058 - RNA, 20 nt, Artificial Sequence
  MKO10015058_A_Dusp11
  gRNA
aaagcaaugaaacgaguccc

SEQ ID NO: 15059 - RNA, 20 nt, Artificial Sequence
  MKO10015059_A_Dusp11
  gRNA
acugcacccauggcuuaaau

SEQ ID NO: 15060 - RNA, 20 nt, Artificial Sequence
  MKO10015060_A_Dusp11
  gRNA
ucagcgcuauuauaaaguag

SEQ ID NO: 15061 - RNA, 20 nt, Artificial Sequence
  MKO10015061_A_Dusp12
  gRNA
aucuacucuguugggcguua

SEQ ID NO: 15062 - RNA, 20 nt, Artificial Sequence
  MKO10015062_A_Dusp12
  gRNA
cgccguucucuugugagcaa

SEQ ID NO: 15063 - RNA, 20 nt, Artificial Sequence
  MKO10015063_A_Dusp12
  gRNA
uagccucuggcuugaccguc

SEQ ID NO: 15064 - RNA, 20 nt, Artificial Sequence
  MKO10015064_A_Dusp13
  gRNA
caaauaaccgauuugagcug

SEQ ID NO: 15065 - RNA, 20 nt, Artificial Sequence
  MKO10015065_A_Dusp13
  gRNA
gaccugcaccccgaaguugc

SEQ ID NO: 15066 - RNA, 20 nt, Artificial Sequence
  MKO10015066_A_Dusp13
  gRNA
caugugcugaaugccgccca

SEQ ID NO: 15067 - RNA, 20 nt, Artificial Sequence
  MKO10015067_A_Dusp14
  gRNA
cccgacacuugaugccuuau

SEQ ID NO: 15068 - RNA, 20 nt, Artificial Sequence
  MKO10015068_A_Dusp14
  gRNA
gacuacgagagccagcucuu

SEQ ID NO: 15069 - RNA, 20 nt, Artificial Sequence
  MKO10015069_A_Dusp14
  gRNA
caauacagaggguggccgag

SEQ ID NO: 15070 - RNA, 20 nt, Artificial Sequence
  MKO10015070_A_Dusp15
  gRNA
ggaacuuacauggguaccuc

SEQ ID NO: 15071 - RNA, 20 nt, Artificial Sequence
  MKO10015071_A_Dusp15
  gRNA
uaucagacacugagauucga

SEQ ID NO: 15072 - RNA, 20 nt, Artificial Sequence
  MKO10015072_A_Dusp15
  gRNA
guuuggaguaccugcaacag

SEQ ID NO: 15073 - RNA, 20 nt, Artificial Sequence
  MKO10015073_A_Dusp16
  gRNA
ugcuuaccuguugcgaacau

SEQ ID NO: 15074 - RNA, 20 nt, Artificial Sequence
  MKO10015074_A_Dusp16
  gRNA
ccuuguugaggacaucucgc

SEQ ID NO: 15075 - RNA, 20 nt, Artificial Sequence
  MKO10015075_A_Dusp16
  gRNA
gugcuuauccacugcuuagc

SEQ ID NO: 15076 - RNA, 20 nt, Artificial Sequence
  MKO10015076_A_Dusp18
  gRNA
gcgacgggcgcaucgaccac

SEQ ID NO: 15077 - RNA, 20 nt, Artificial Sequence
  MKO10015077_A_Dusp18
  gRNA
cguugccgaccguauccauu

SEQ ID NO: 15078 - RNA, 20 nt, Artificial Sequence
  MKO10015078_A_Dusp18
  gRNA
ugcgagaggccucugaucga

SEQ ID NO: 15079 - RNA, 20 nt, Artificial Sequence
  MKO10015079_A_Dusp19
  gRNA
ccauccauauguccgaaucc

SEQ ID NO: 15080 - RNA, 20 nt, Artificial Sequence
  MKO10015080_A_Dusp19
  gRNA
ucgccucuuucaccaacgac

SEQ ID NO: 15081 - RNA, 20 nt, Artificial Sequence
  MKO10015081_A_Dusp19
  gRNA
aaguuggcguuauuaagccc

SEQ ID NO: 15082 - RNA, 20 nt, Artificial Sequence
  MKO10015082_A_Dusp1
  gRNA
cggccacgcaguucagcguu

SEQ ID NO: 15083 - RNA, 20 nt, Artificial Sequence
  MKO10015083_A_Dusp1
  gRNA
ggccagggugccgucgcgcu

SEQ ID NO: 15084 - RNA, 20 nt, Artificial Sequence
  MKO10015084_A_Dusp1
  gRNA
cuacuaaccugaucguagag

SEQ ID NO: 15085 - RNA, 20 nt, Artificial Sequence
  MKO10015085_A_Dusp21
  gRNA
cgcaugaucuacucuccuau

SEQ ID NO: 15086 - RNA, 20 nt, Artificial Sequence
  MKO10015086_A_Dusp21
  gRNA
gaauuaggagcaucgcucac

SEQ ID NO: 15087 - RNA, 20 nt, Artificial Sequence
  MKO10015087_A_Dusp21
  gRNA
acgaguucaagcuguuuagu

SEQ ID NO: 15088 - RNA, 20 nt, Artificial Sequence
  MKO10015088_A_Dusp22
  gRNA
uuucugugcacgauacugcc

SEQ ID NO: 15089 - RNA, 20 nt, Artificial Sequence
  MKO10015089_A_Dusp22
  gRNA
ugucugccgcuggaauacac

SEQ ID NO: 15090 - RNA, 20 nt, Artificial Sequence
  MKO10015090_A_Dusp22
  gRNA
auccugccgggccuguacau

SEQ ID NO: 15091 - RNA, 20 nt, Artificial Sequence
  MKO10015091_A_Dusp23
  gRNA
auccauugagacguaugaac

SEQ ID NO: 15092 - RNA, 20 nt, Artificial Sequence
  MKO10015092_A_Dusp23
  gRNA
gagauccggcgccugcgacc

SEQ ID NO: 15093 - RNA, 20 nt, Artificial Sequence
  MKO10015093_A_Dusp23
  gRNA
aaaagucagggaugcgcauu

SEQ ID NO: 15094 - RNA, 20 nt, Artificial Sequence
  MKO10015094_A_Dusp26
  gRNA
ccgaagcucacggcgguugu

SEQ ID NO: 15095 - RNA, 20 nt, Artificial Sequence
  MKO10015095_A_Dusp26
  gRNA
ugaaaaugugccccgguaac

SEQ ID NO: 15096 - RNA, 20 nt, Artificial Sequence
  MKO10015096_A_Dusp26
  gRNA
guaaccaugcugacgaaguc

SEQ ID NO: 15097 - RNA, 20 nt, Artificial Sequence
  MKO10015097_A_Dusp27
  gRNA
ccccuucugucagugcggau

SEQ ID NO: 15098 - RNA, 20 nt, Artificial Sequence
  MKO10015098_A_Dusp27
  gRNA
cggaagauaccgcucugacu

SEQ ID NO: 15099 - RNA, 20 nt, Artificial Sequence
  MKO10015099_A_Dusp27
  gRNA
cacauucugaaugccgcaca

SEQ ID NO: 15100 - RNA, 20 nt, Artificial Sequence
  MKO10015100_A_Dusp28
  gRNA
uacgcguaguuccgccacuc

SEQ ID NO: 15101 - RNA, 20 nt, Artificial Sequence
  MKO10015101_A_Dusp28
  gRNA
gucgcgcaccgcggcuucca

SEQ ID NO: 15102 - RNA, 20 nt, Artificial Sequence
  MKO10015102_A_Dusp28
  gRNA
gauggugaagagcgcccgcc

SEQ ID NO: 15103 - RNA, 20 nt, Artificial Sequence
  MKO10015103_A_Dusp2
  gRNA
acgaccgugugcuucuugcg

SEQ ID NO: 15104 - RNA, 20 nt, Artificial Sequence
  MKO10015104_A_Dusp2
  gRNA
uguugcccgaccgcgcacuc

SEQ ID NO: 15105 - RNA, 20 nt, Artificial Sequence
  MKO10015105_A_Dusp2
  gRNA
ccucguccagccguacccgg

SEQ ID NO: 15106 - RNA, 20 nt, Artificial Sequence
  MKO10015106_A_Dusp3
  gRNA
cgugagaucggccccaacga

SEQ ID NO: 15107 - RNA, 20 nt, Artificial Sequence
  MKO10015107_A_Dusp3
  gRNA
guccagcucguucgaacucu

SEQ ID NO: 15108 - RNA, 20 nt, Artificial Sequence
  MKO10015108_A_Dusp3
  gRNA
cgcggcaauggacaagcacc

SEQ ID NO: 15109 - RNA, 20 nt, Artificial Sequence
  MKO10015109_A_Dusp4
  gRNA
cagccuaccgauguacucga

SEQ ID NO: 15110 - RNA, 20 nt, Artificial Sequence
  MKO10015110_A_Dusp4
  gRNA
agcgcacguucaccgagccu

SEQ ID NO: 15111 - RNA, 20 nt, Artificial Sequence
  MKO10015111_A_Dusp4
  gRNA
cacggugucgcuggucgugc

SEQ ID NO: 15112 - RNA, 20 nt, Artificial Sequence
  MKO10015112_A_Dusp5
  gRNA
uucgccgcgucgagcgugcg

SEQ ID NO: 15113 - RNA, 20 nt, Artificial Sequence
  MKO10015113_A_Dusp5
  gRNA
cgagccgcgcacgcucgacg

SEQ ID NO: 15114 - RNA, 20 nt, Artificial Sequence
  MKO10015114_A_Dusp5
  gRNA
cccugcugaauguuucccgc

SEQ ID NO: 15115 - RNA, 20 nt, Artificial Sequence
  MKO10015115_A_Dusp6
  gRNA
acgacgagaauagcagcgac

SEQ ID NO: 15116 - RNA, 20 nt, Artificial Sequence
  MKO10015116_A_Dusp6
  gRNA
auucucgucguacagcacca

SEQ ID NO: 15117 - RNA, 20 nt, Artificial Sequence
  MKO10015117_A_Dusp6
  gRNA
aaugucguaagcaucguuca

SEQ ID NO: 15118 - RNA, 20 nt, Artificial Sequence
  MKO10015118_A_Dusp7
  gRNA
cgaaucgucgcacauugaga

SEQ ID NO: 15119 - RNA, 20 nt, Artificial Sequence
  MKO10015119_A_Dusp7
  gRNA
caucggagcgggagcgacga

SEQ ID NO: 15120 - RNA, 20 nt, Artificial Sequence
  MKO10015120_A_Dusp7
  gRNA
aacacgcucgaguccacgug

SEQ ID NO: 15121 - RNA, 20 nt, Artificial Sequence
  MKO10015121_A_Dusp8
  gRNA
ugucuucugacgacgcauac

SEQ ID NO: 15122 - RNA, 20 nt, Artificial Sequence
  MKO10015122_A_Dusp8
  gRNA
ccccucaccaauaaacucga

SEQ ID NO: 15123 - RNA, 20 nt, Artificial Sequence
  MKO10015123_A_Dusp8
  gRNA
cacacgagaugccagcgugc

SEQ ID NO: 15124 - RNA, 20 nt, Artificial Sequence
  MKO10015124_A_Dusp9
  gRNA
ccgacaugcucccccuccgc

SEQ ID NO: 15125 - RNA, 20 nt, Artificial Sequence
  MKO10015125_A_Dusp9
  gRNA
acucaacgaugccuacgacu

SEQ ID NO: 15126 - RNA, 20 nt, Artificial Sequence
  MKO10015126_A_Dusp9
  gRNA
cuuccgcuugaccaagucgu

SEQ ID NO: 15127 - RNA, 20 nt, Artificial Sequence
  MKO10015127_A_Duu
  gRNA
ucaccugaauaggucguagc

SEQ ID NO: 15128 - RNA, 20 nt, Artificial Sequence
  MKO10015128_A_Duu
  gRNA
gcgcuucucugcgcuucgug

SEQ ID NO: 15129 - RNA, 20 nt, Artificial Sequence
  MKO10015129_A_Duu
  gRNA
ggggucgugcuguuuaacuu

SEQ ID NO: 15130 - RNA, 20 nt, Artificial Sequence
  MKO10015130_A_Duxbl1
  gRNA
uuccuuagccagauguccuc

SEQ ID NO: 15131 - RNA, 20 nt, Artificial Sequence
  MKO10015131_A_Duxbl1
  gRNA
gccuacuggaaaaagaagcc

SEQ ID NO: 15132 - RNA, 20 nt, Artificial Sequence
  MKO10015132_A_Duxbl1
  gRNA
guuuauccugcuccugcucu

SEQ ID NO: 15133 - RNA, 20 nt, Artificial Sequence
  MKO10015133_A_Duxbl2
  gRNA
uuccuuagccagauguccuc

SEQ ID NO: 15134 - RNA, 20 nt, Artificial Sequence
  MKO10015134_A_Duxbl2
  gRNA
gccuacuggaaaaagaagcc

SEQ ID NO: 15135 - RNA, 20 nt, Artificial Sequence
  MKO10015135_A_Duxbl2
  gRNA
guuuauccugcuccugcucu

SEQ ID NO: 15136 - RNA, 20 nt, Artificial Sequence
  MKO10015136_A_Duxbl3
  gRNA
uuccuuagccagauguccuc

SEQ ID NO: 15137 - RNA, 20 nt, Artificial Sequence
  MKO10015137_A_Duxbl3
  gRNA
gccuacuggaaaaagaagcc

SEQ ID NO: 15138 - RNA, 20 nt, Artificial Sequence
  MKO10015138_A_Duxbl3
  gRNA
guuuauccugcuccugcucu

SEQ ID NO: 15139 - RNA, 20 nt, Artificial Sequence
  MKO10015139_A_Dux
  gRNA
aucugagacccccauucgcu

SEQ ID NO: 15140 - RNA, 20 nt, Artificial Sequence
  MKO10015140_A_Dux
  gRNA
gccuucugccagaugagcgc

SEQ ID NO: 15141 - RNA, 20 nt, Artificial Sequence
  MKO10015141_A_Dux
  gRNA
gaaggagcuggccaagcgaa

SEQ ID NO: 15142 - RNA, 20 nt, Artificial Sequence
  MKO10015142_A_Dvl1
  gRNA
ccgacgucgaaaccgcgaug

SEQ ID NO: 15143 - RNA, 20 nt, Artificial Sequence
  MKO10015143_A_Dvl1
  gRNA
ccucaucgcgguuucgacgu

SEQ ID NO: 15144 - RNA, 20 nt, Artificial Sequence
  MKO10015144_A_Dvl1
  gRNA
acccgagaggggaucggcgg

SEQ ID NO: 15145 - RNA, 20 nt, Artificial Sequence
  MKO10015145_A_Dvl2
  gRNA
ccgaaucugucguaucacug

SEQ ID NO: 15146 - RNA, 20 nt, Artificial Sequence
  MKO10015146_A_Dvl2
  gRNA
cucgaggcuggagcgccacc

SEQ ID NO: 15147 - RNA, 20 nt, Artificial Sequence
  MKO10015147_A_Dvl2
  gRNA
gcccgccuaccuugcuucaa

SEQ ID NO: 15148 - RNA, 20 nt, Artificial Sequence
  MKO10015148_A_Dvl3
  gRNA
gaugaacugucauagccgcc

SEQ ID NO: 15149 - RNA, 20 nt, Artificial Sequence
  MKO10015149_A_Dvl3
  gRNA
ccacaaagggugagcggcga

SEQ ID NO: 15150 - RNA, 20 nt, Artificial Sequence
  MKO10015150_A_Dvl3
  gRNA
gcuccgggccaucccuccgu

SEQ ID NO: 15151 - RNA, 20 nt, Artificial Sequence
  MKO10015151_A_Dxo
  gRNA
ugcugaccacgccguaugag

SEQ ID NO: 15152 - RNA, 20 nt, Artificial Sequence
  MKO10015152_A_Dxo
  gRNA
ggccuuaccugggaucgucc

SEQ ID NO: 15153 - RNA, 20 nt, Artificial Sequence
  MKO10015153_A_Dxo
  gRNA
uggggaaguuaacaccaacg

SEQ ID NO: 15154 - RNA, 20 nt, Artificial Sequence
  MKO10015154_A_Dydc1
  gRNA
accgaucgcugaucuccgcu

SEQ ID NO: 15155 - RNA, 20 nt, Artificial Sequence
  MKO10015155_A_Dydc1
  gRNA
acggggcgccuaacuugagc

SEQ ID NO: 15156 - RNA, 20 nt, Artificial Sequence
  MKO10015156_A_Dydc1
  gRNA
aagucagaagauuucgagac

SEQ ID NO: 15157 - RNA, 20 nt, Artificial Sequence
  MKO10015157_A_Dydc2
  gRNA
caucucagaaaucacacgcg

SEQ ID NO: 15158 - RNA, 20 nt, Artificial Sequence
  MKO10015158_A_Dydc2
  gRNA
cagugacccaauagaguacc

SEQ ID NO: 15159 - RNA, 20 nt, Artificial Sequence
  MKO10015159_A_Dydc2
  gRNA
agcacgugacagaagcgcug

SEQ ID NO: 15160 - RNA, 20 nt, Artificial Sequence
  MKO10015160_A_Dym
  gRNA
guugaaaacaacccucgaac

SEQ ID NO: 15161 - RNA, 20 nt, Artificial Sequence
  MKO10015161_A_Dym
  gRNA
aaaucuugcugcgcuaacua

SEQ ID NO: 15162 - RNA, 20 nt, Artificial Sequence
  MKO10015162_A_Dym
  gRNA
guucauccgugagcugucug

SEQ ID NO: 15163 - RNA, 20 nt, Artificial Sequence
  MKO10015163_A_Dynap
  gRNA
gguauuguuggaauugccaa

SEQ ID NO: 15164 - RNA, 20 nt, Artificial Sequence
  MKO10015164_A_Dynap
  gRNA
guuccuuccguugaacagua

SEQ ID NO: 15165 - RNA, 20 nt, Artificial Sequence
  MKO10015165_A_Dynap
  gRNA
guggugucaggucuagguga

SEQ ID NO: 15166 - RNA, 20 nt, Artificial Sequence
  MKO10015166_A_Dync1h1
  gRNA
cuucgcaacguucgugauga

SEQ ID NO: 15167 - RNA, 20 nt, Artificial Sequence
  MKO10015167_A_Dync1h1
  gRNA
gcgaagcagugcuaugagcg

SEQ ID NO: 15168 - RNA, 20 nt, Artificial Sequence
  MKO10015168_A_Dync1h1
  gRNA
ggaaacguuugccgugcuuc

SEQ ID NO: 15169 - RNA, 20 nt, Artificial Sequence
  MKO10015169_A_Dync1i1
  gRNA
cguucaagaugacuccgauc

SEQ ID NO: 15170 - RNA, 20 nt, Artificial Sequence
  MKO10015170_A_Dync1i1
  gRNA
ccgucguuugcgauccagau

SEQ ID NO: 15171 - RNA, 20 nt, Artificial Sequence
  MKO10015171_A_Dync1i1
  gRNA
aagccaagacucgggcgauc

SEQ ID NO: 15172 - RNA, 20 nt, Artificial Sequence
  MKO10015172_A_Dync1i2
  gRNA
guguaugugacgauuucucg

SEQ ID NO: 15173 - RNA, 20 nt, Artificial Sequence
  MKO10015173_A_Dync1i2
  gRNA
gagauggcgccgugggaucu

SEQ ID NO: 15174 - RNA, 20 nt, Artificial Sequence
  MKO10015174_A_Dync1i2
  gRNA
ucuuuggguugagcuguaac

SEQ ID NO: 15175 - RNA, 20 nt, Artificial Sequence
  MKO10015175_A_Dync1li1
  gRNA
uucguacagacuacgagcac

SEQ ID NO: 15176 - RNA, 20 nt, Artificial Sequence
  MKO10015176_A_Dync1li1
  gRNA
agugcucguagucuguacga

SEQ ID NO: 15177 - RNA, 20 nt, Artificial Sequence
  MKO10015177_A_Dync1li1
  gRNA
ucgcgcuccaagcucccgac

SEQ ID NO: 15178 - RNA, 20 nt, Artificial Sequence
  MKO10015178_A_Dync1li2
  gRNA
gccguccggcaaaaacauuc

SEQ ID NO: 15179 - RNA, 20 nt, Artificial Sequence
  MKO10015179_A_Dync1li2
  gRNA
uugccgacaugucucgaccu

SEQ ID NO: 15180 - RNA, 20 nt, Artificial Sequence
  MKO10015180_A_Dync1li2
  gRNA
agagacuccauuaucgucca

SEQ ID NO: 15181 - RNA, 20 nt, Artificial Sequence
  MKO10015181_A_Dync2h1
  gRNA
ccuuuaccaagcaguacgac

SEQ ID NO: 15182 - RNA, 20 nt, Artificial Sequence
  MKO10015182_A_Dync2h1
  gRNA
gucacguaugcugcaucucc

SEQ ID NO: 15183 - RNA, 20 nt, Artificial Sequence
  MKO10015183_A_Dync2h1
  gRNA
gagcuuguucuauccaaaac

SEQ ID NO: 15184 - RNA, 20 nt, Artificial Sequence
  MKO10015184_A_Dync2li1
  gRNA
guacguguacuccaacgcua

SEQ ID NO: 15185 - RNA, 20 nt, Artificial Sequence
  MKO10015185_A_Dync2li1
  gRNA
agcaaagccgaccuuagcgu

SEQ ID NO: 15186 - RNA, 20 nt, Artificial Sequence
  MKO10015186_A_Dync2li1
  gRNA
caaucacagucgacaccuua

SEQ ID NO: 15187 - RNA, 20 nt, Artificial Sequence
  MKO10015187_A_Dynll1
  gRNA
ggguccucaccuucuugaua

SEQ ID NO: 15188 - RNA, 20 nt, Artificial Sequence
  MKO10015188_A_Dynll1
  gRNA
cacagguaaccaugugcgac

SEQ ID NO: 15189 - RNA, 20 nt, Artificial Sequence
  MKO10015189_A_Dynll1
  gRNA
acaagaaguacaacccuacc

SEQ ID NO: 15190 - RNA, 20 nt, Artificial Sequence
  MKO10015190_A_Dynll2
  gRNA
uguaucgugggccggaauuu

SEQ ID NO: 15191 - RNA, 20 nt, Artificial Sequence
  MKO10015191_A_Dynll2
  gRNA
ccaccuagcccgacuugaag

SEQ ID NO: 15192 - RNA, 20 nt, Artificial Sequence
  MKO10015192_A_Dynll2
  gRNA
gcagugucacgaugucugac

SEQ ID NO: 15193 - RNA, 20 nt, Artificial Sequence
  MKO10015193_A_Dynlrb1
  gRNA
agcgaauucgaaggaagguu

SEQ ID NO: 15194 - RNA, 20 nt, Artificial Sequence
  MKO10015194_A_Dynlrb1
  gRNA
uuggcauacuguguaguggu

SEQ ID NO: 15195 - RNA, 20 nt, Artificial Sequence
  MKO10015195_A_Dynlrb1
  gRNA
cagacaguggcuuauucagu

SEQ ID NO: 15196 - RNA, 20 nt, Artificial Sequence
  MKO10015196_A_Dynlrb2
  gRNA
cuccacaacgguucaguaug

SEQ ID NO: 15197 - RNA, 20 nt, Artificial Sequence
  MKO10015197_A_Dynlrb2
  gRNA
cauuccaauccgaacaaccc

SEQ ID NO: 15198 - RNA, 20 nt, Artificial Sequence
  MKO10015198_A_Dynlrb2
  gRNA
cgaugaccccuuugugacuc

SEQ ID NO: 15199 - RNA, 20 nt, Artificial Sequence
  MKO10015199_A_Dynlt1a
  gRNA
ugaagugagcagcauuguaa

SEQ ID NO: 15200 - RNA, 20 nt, Artificial Sequence
  MKO10015200_A_Dynlt1a
  gRNA
uaggcuauagaaagcgccau

SEQ ID NO: 15201 - RNA, 20 nt, Artificial Sequence
  MKO10015201_A_Dynlt1a
  gRNA
ccauuaccaauguauuuaaa

SEQ ID NO: 15202 - RNA, 20 nt, Artificial Sequence
  MKO10015202_A_Dynlt1b
  gRNA
ugaagugagcagcauuguaa

SEQ ID NO: 15203 - RNA, 20 nt, Artificial Sequence
  MKO10015203_A_Dynlt1b
  gRNA
ccauuaccaauguauuuaaa

SEQ ID NO: 15204 - RNA, 20 nt, Artificial Sequence
  MKO10015204_A_Dynlt1b
  gRNA
uaggcuauagaaagcgccau

SEQ ID NO: 15205 - RNA, 20 nt, Artificial Sequence
  MKO10015205_A_Dynlt1c
  gRNA
ugaagugagcagcauuguaa

SEQ ID NO: 15206 - RNA, 20 nt, Artificial Sequence
  MKO10015206_A_Dynlt1c
  gRNA
ccauuaccaauguauuuaaa

SEQ ID NO: 15207 - RNA, 20 nt, Artificial Sequence
  MKO10015207_A_Dynlt1c
  gRNA
uaggcuauagaaagcgccau

SEQ ID NO: 15208 - RNA, 20 nt, Artificial Sequence
  MKO10015208_A_Dynlt1f
  gRNA
ugaagugagcagcauuguaa

SEQ ID NO: 15209 - RNA, 20 nt, Artificial Sequence
  MKO10015209_A_Dynlt1f
  gRNA
uaggcuauagaaagcgccau

SEQ ID NO: 15210 - RNA, 20 nt, Artificial Sequence
  MKO10015210_A_Dynlt1f
  gRNA
ccauuaccaauguauuuaaa

SEQ ID NO: 15211 - RNA, 20 nt, Artificial Sequence
  MKO10015211_A_Dynlt3
  gRNA
ccacuaugcuugcaguccau

SEQ ID NO: 15212 - RNA, 20 nt, Artificial Sequence
  MKO10015212_A_Dynlt3
  gRNA
agcccauaauauagucaaag

SEQ ID NO: 15213 - RNA, 20 nt, Artificial Sequence
  MKO10015213_A_Dynlt3
  gRNA
gggaaagcuuacaaguacau

SEQ ID NO: 15214 - RNA, 20 nt, Artificial Sequence
  MKO10015214_A_Dyrk1a
  gRNA
cuuccgcuccuucuuaugac

SEQ ID NO: 15215 - RNA, 20 nt, Artificial Sequence
  MKO10015215_A_Dyrk1a
  gRNA
ggacgauuccagucauaaga

SEQ ID NO: 15216 - RNA, 20 nt, Artificial Sequence
  MKO10015216_A_Dyrk1a
  gRNA
cucuguaacaugacaauguc

SEQ ID NO: 15217 - RNA, 20 nt, Artificial Sequence
  MKO10015217_A_Dyrk1b
  gRNA
cacgacuacauugugcgcag

SEQ ID NO: 15218 - RNA, 20 nt, Artificial Sequence
  MKO10015218_A_Dyrk1b
  gRNA
agccccgcugcgcaagcucu

SEQ ID NO: 15219 - RNA, 20 nt, Artificial Sequence
  MKO10015219_A_Dyrk1b
  gRNA
uccaccgagagcuugcgcag

SEQ ID NO: 15220 - RNA, 20 nt, Artificial Sequence
  MKO10015220_A_Dyrk2
  gRNA
ggggcccuuaccggucgggu

SEQ ID NO: 15221 - RNA, 20 nt, Artificial Sequence
  MKO10015221_A_Dyrk2
  gRNA
aacccgucaggaguuccgcg

SEQ ID NO: 15222 - RNA, 20 nt, Artificial Sequence
  MKO10015222_A_Dyrk2
  gRNA
cuuccccggggaucggcgcg

SEQ ID NO: 15223 - RNA, 20 nt, Artificial Sequence
  MKO10015223_A_Dyrk3
  gRNA
aucgucguagccaccguuau

SEQ ID NO: 15224 - RNA, 20 nt, Artificial Sequence
  MKO10015224_A_Dyrk3
  gRNA
gguugcacuucaccgcgcuc

SEQ ID NO: 15225 - RNA, 20 nt, Artificial Sequence
  MKO10015225_A_Dyrk3
  gRNA
cgccguuaccuccgcugcug

SEQ ID NO: 15226 - RNA, 20 nt, Artificial Sequence
  MKO10015226_A_Dyrk4
  gRNA
agugaaccgauguccacaaa

SEQ ID NO: 15227 - RNA, 20 nt, Artificial Sequence
  MKO10015227_A_Dyrk4
  gRNA
augggacuuuguugccaauc

SEQ ID NO: 15228 - RNA, 20 nt, Artificial Sequence
  MKO10015228_A_Dyrk4
  gRNA
cuuacucaccugauacugca

SEQ ID NO: 15229 - RNA, 20 nt, Artificial Sequence
  MKO10015229_A_Dysf
  gRNA
guggcguguaggacaccugc

SEQ ID NO: 15230 - RNA, 20 nt, Artificial Sequence
  MKO10015230_A_Dysf
  gRNA
uagcagaggugcguugaagc

SEQ ID NO: 15231 - RNA, 20 nt, Artificial Sequence
  MKO10015231_A_Dysf
  gRNA
agaacagugugaaccccgug

SEQ ID NO: 15232 - RNA, 20 nt, Artificial Sequence
  MKO10015232_A_Dytn
  gRNA
cgggagcuguuucagcgcac

SEQ ID NO: 15233 - RNA, 20 nt, Artificial Sequence
  MKO10015233_A_Dytn
  gRNA
uugcacagaucguaauuuga

SEQ ID NO: 15234 - RNA, 20 nt, Artificial Sequence
  MKO10015234_A_Dytn
  gRNA
uauucuuaaacgucaaccug

SEQ ID NO: 15235 - RNA, 20 nt, Artificial Sequence
  MKO10015235_A_Dyx1c1
  gRNA
cgcacgcagacgccccgcaa

SEQ ID NO: 15236 - RNA, 20 nt, Artificial Sequence
  MKO10015236_A_Dyx1c1
  gRNA
cgcgaugcugacguauucug

SEQ ID NO: 15237 - RNA, 20 nt, Artificial Sequence
  MKO10015237_A_Dyx1c1
  gRNA
gucccugcgccucgcuccgc

SEQ ID NO: 15238 - RNA, 20 nt, Artificial Sequence
  MKO10015238_A_Dzank1
  gRNA
gucgagcacucgcucccuca

SEQ ID NO: 15239 - RNA, 20 nt, Artificial Sequence
  MKO10015239_A_Dzank1
  gRNA
ucgcuucgcagagaguccac

SEQ ID NO: 15240 - RNA, 20 nt, Artificial Sequence
  MKO10015240_A_Dzank1
  gRNA
ccauaccugcaagccgucua

SEQ ID NO: 15241 - RNA, 20 nt, Artificial Sequence
  MKO10015241_A_Dzip1l
  gRNA
ccagaacuccacguuagaag

SEQ ID NO: 15242 - RNA, 20 nt, Artificial Sequence
  MKO10015242_A_Dzip1l
  gRNA
gugggguaccucuucuaacg

SEQ ID NO: 15243 - RNA, 20 nt, Artificial Sequence
  MKO10015243_A_Dzip1l
  gRNA
agcuucgggccaagcucaag

SEQ ID NO: 15244 - RNA, 20 nt, Artificial Sequence
  MKO10015244_A_Dzip1
  gRNA
cgaauaccugaugcacucgc

SEQ ID NO: 15245 - RNA, 20 nt, Artificial Sequence
  MKO10015245_A_Dzip1
  gRNA
gcggcugagcgccaucgacg

SEQ ID NO: 15246 - RNA, 20 nt, Artificial Sequence
  MKO10015246_A_Dzip1
  gRNA
ggagaaggagaaguuacucg

SEQ ID NO: 15247 - RNA, 20 nt, Artificial Sequence
  MKO10015247_A_Dzip3
  gRNA
auuucuaauagugcguuaac

SEQ ID NO: 15248 - RNA, 20 nt, Artificial Sequence
  MKO10015248_A_Dzip3
  gRNA
augauguuaccugcauaguc

SEQ ID NO: 15249 - RNA, 20 nt, Artificial Sequence
  MKO10015249_A_Dzip3
  gRNA
guuacaacucauagccagac

SEQ ID NO: 15250 - RNA, 20 nt, Artificial Sequence
  MKO10015250_A_E030002O03Rik
  gRNA
auccuucaaucugcuacgcc

SEQ ID NO: 15251 - RNA, 20 nt, Artificial Sequence
  MKO10015251_A_E030002O03Rik
  gRNA
gggugcugagucacgacccc

SEQ ID NO: 15252 - RNA, 20 nt, Artificial Sequence
  MKO10015252_A_E030002O03Rik
  gRNA
uccaauugagcuuuaccaca

SEQ ID NO: 15253 - RNA, 20 nt, Artificial Sequence
  MKO10015253_A_E030018B13Rik
  gRNA
aguguguucagcacucacgc

SEQ ID NO: 15254 - RNA, 20 nt, Artificial Sequence
  MKO10015254_A_E030018B13Rik
  gRNA
augaugcuucagggaaguuc

SEQ ID NO: 15255 - RNA, 20 nt, Artificial Sequence
  MKO10015255_A_E030018B13Rik
  gRNA
ggagugguccugcaucacau

SEQ ID NO: 15256 - RNA, 20 nt, Artificial Sequence
  MKO10015256_A_E030019B06Rik
  gRNA
accacuggauacucgucaac

SEQ ID NO: 15257 - RNA, 20 nt, Artificial Sequence
  MKO10015257_A_E030019B06Rik
  gRNA
accuguugacgaguauccag

SEQ ID NO: 15258 - RNA, 20 nt, Artificial Sequence
  MKO10015258_A_E030019B06Rik
  gRNA
ggagagagaaaucucgugac

SEQ ID NO: 15259 - RNA, 20 nt, Artificial Sequence
  MKO10015259_A_E030030I06Rik
  gRNA
ccgaucagaguacgagugcu

SEQ ID NO: 15260 - RNA, 20 nt, Artificial Sequence
  MKO10015260_A_E030030I06Rik
  gRNA
cucgcuggcgcuucggaauc

SEQ ID NO: 15261 - RNA, 20 nt, Artificial Sequence
  MKO10015261_A_E030030I06Rik
  gRNA
cuccggaacagcuaggacgc

SEQ ID NO: 15262 - RNA, 20 nt, Artificial Sequence
  MKO10015262_A_E130012A19Rik
  gRNA
uuacgcgaagggguucgccc

SEQ ID NO: 15263 - RNA, 20 nt, Artificial Sequence
  MKO10015263_A_E130012A19Rik
  gRNA
cguaacaccaaaguuucgag

SEQ ID NO: 15264 - RNA, 20 nt, Artificial Sequence
  MKO10015264_A_E130012A19Rik
  gRNA
ucgggcccucggcgcaaacu

SEQ ID NO: 15265 - RNA, 20 nt, Artificial Sequence
  MKO10015265_A_E130308A19Rik
  gRNA
gcgguccaggccucggcgaa

SEQ ID NO: 15266 - RNA, 20 nt, Artificial Sequence
  MKO10015266_A_E130308A19Rik
  gRNA
ucgcuucaugccauucgccg

SEQ ID NO: 15267 - RNA, 20 nt, Artificial Sequence
  MKO10015267_A_E130308A19Rik
  gRNA
ucguguuguugagccagacg

SEQ ID NO: 15268 - RNA, 20 nt, Artificial Sequence
  MKO10015268_A_E130309D02Rik
  gRNA
caacacggggauccgacaca

SEQ ID NO: 15269 - RNA, 20 nt, Artificial Sequence
  MKO10015269_A_E130309D02Rik
  gRNA
gcugauccgguggugcguga

SEQ ID NO: 15270 - RNA, 20 nt, Artificial Sequence
  MKO10015270_A_E130309D02Rik
  gRNA
uucuucccagcggacgcccg

SEQ ID NO: 15271 - RNA, 20 nt, Artificial Sequence
  MKO10015271_A_E130309D14Rik
  gRNA
guugugcacgccggcggacc

SEQ ID NO: 15272 - RNA, 20 nt, Artificial Sequence
  MKO10015272_A_E130309D14Rik
  gRNA
cguggcgacugcgcucucgc

SEQ ID NO: 15273 - RNA, 20 nt, Artificial Sequence
  MKO10015273_A_E130309D14Rik
  gRNA
ucccgcgcuagcugcgcuca

SEQ ID NO: 15274 - RNA, 20 nt, Artificial Sequence
  MKO10015274_A_E130309F12Rik
  gRNA
accugagccccuuacuccga

SEQ ID NO: 15275 - RNA, 20 nt, Artificial Sequence
  MKO10015275_A_E130309F12Rik
  gRNA
agaacgcaguagagcaccag

SEQ ID NO: 15276 - RNA, 20 nt, Artificial Sequence
  MKO10015276_A_E130309F12Rik
  gRNA
cgaaugcacugacaccuuuc

SEQ ID NO: 15277 - RNA, 20 nt, Artificial Sequence
  MKO10015277_A_E130311K13Rik
  gRNA
acuuucgcagaagaaccacg

SEQ ID NO: 15278 - RNA, 20 nt, Artificial Sequence
  MKO10015278_A_E130311K13Rik
  gRNA
acucaguuauccgcuguaau

SEQ ID NO: 15279 - RNA, 20 nt, Artificial Sequence
  MKO10015279_A_E130311K13Rik
  gRNA
aagacaguuaucacgacagc

SEQ ID NO: 15280 - RNA, 20 nt, Artificial Sequence
  MKO10015280_A_E230008N13Rik
  gRNA
ggggucauaguuucccccuc

SEQ ID NO: 15281 - RNA, 20 nt, Artificial Sequence
  MKO10015281_A_E230008N13Rik
  gRNA
aaacuaugaccccucgccag

SEQ ID NO: 15282 - RNA, 20 nt, Artificial Sequence
  MKO10015282_A_E230008N13Rik
  gRNA
agcagucaagaugucgccag

SEQ ID NO: 15283 - RNA, 20 nt, Artificial Sequence
  MKO10015283_A_E230019M04Rik
  gRNA
gacauauaccuaggauugac

SEQ ID NO: 15284 - RNA, 20 nt, Artificial Sequence
  MKO10015284_A_E230019M04Rik
  gRNA
uacaucuacuauuagagcua

SEQ ID NO: 15285 - RNA, 20 nt, Artificial Sequence
  MKO10015285_A_E230019M04Rik
  gRNA
ugaaacuuaccaccagcucc

SEQ ID NO: 15286 - RNA, 20 nt, Artificial Sequence
  MKO10015286_A_E230025N22Rik
  gRNA
uaauccuagauuaaccguau

SEQ ID NO: 15287 - RNA, 20 nt, Artificial Sequence
  MKO10015287_A_E230025N22Rik
  gRNA
caccagccaauacucgcagc

SEQ ID NO: 15288 - RNA, 20 nt, Artificial Sequence
  MKO10015288_A_E230025N22Rik
  gRNA
cugcccccugcugcgaguau

SEQ ID NO: 15289 - RNA, 20 nt, Artificial Sequence
  MKO10015289_A_E2f1
  gRNA
gggauugguaagcggcuuga

SEQ ID NO: 15290 - RNA, 20 nt, Artificial Sequence
  MKO10015290_A_E2f1
  gRNA
acugaccaucaguaccucgc

SEQ ID NO: 15291 - RNA, 20 nt, Artificial Sequence
  MKO10015291_A_E2f1
  gRNA
uucugcuacaggugaaacgg

SEQ ID NO: 15292 - RNA, 20 nt, Artificial Sequence
  MKO10015292_A_E2f2
  gRNA
gacacgcuaugacacgucgc

SEQ ID NO: 15293 - RNA, 20 nt, Artificial Sequence
  MKO10015293_A_E2f2
  gRNA
ccgugccguaggcaacuuca

SEQ ID NO: 15294 - RNA, 20 nt, Artificial Sequence
  MKO10015294_A_E2f2
  gRNA
cccugaauuccggaccccca

SEQ ID NO: 15295 - RNA, 20 nt, Artificial Sequence
  MKO10015295_A_E2f3
  gRNA
acuucaagucucguuucugg

SEQ ID NO: 15296 - RNA, 20 nt, Artificial Sequence
  MKO10015296_A_E2f3
  gRNA
cuccuuaccucuauugaguc

SEQ ID NO: 15297 - RNA, 20 nt, Artificial Sequence
  MKO10015297_A_E2f3
  gRNA
agucuaagaacaacguccag

SEQ ID NO: 15298 - RNA, 20 nt, Artificial Sequence
  MKO10015298_A_E2f4
  gRNA
ugucguagauccgccguuuc

SEQ ID NO: 15299 - RNA, 20 nt, Artificial Sequence
  MKO10015299_A_E2f4
  gRNA
ugguucaggggcgucgggcc

SEQ ID NO: 15300 - RNA, 20 nt, Artificial Sequence
  MKO10015300_A_E2f4
  gRNA
accucuagacuggugcccga

SEQ ID NO: 15301 - RNA, 20 nt, Artificial Sequence
  MKO10015301_A_E2f5
  gRNA
aauugaagaucucgaauuga

SEQ ID NO: 15302 - RNA, 20 nt, Artificial Sequence
  MKO10015302_A_E2f5
  gRNA
aagaaguuaucgauagauua

SEQ ID NO: 15303 - RNA, 20 nt, Artificial Sequence
  MKO10015303_A_E2f5
  gRNA
uuugccaggugauacacugu

SEQ ID NO: 15304 - RNA, 20 nt, Artificial Sequence
  MKO10015304_A_E2f6
  gRNA
acuagcguauguaaccuauc

SEQ ID NO: 15305 - RNA, 20 nt, Artificial Sequence
  MKO10015305_A_E2f6
  gRNA
gucuuccauggccgacaggu

SEQ ID NO: 15306 - RNA, 20 nt, Artificial Sequence
  MKO10015306_A_E2f6
  gRNA
caacucacauccaccgaaug

SEQ ID NO: 15307 - RNA, 20 nt, Artificial Sequence
  MKO10015307_A_E2f7
  gRNA
ugccugucgaccggcuuuac

SEQ ID NO: 15308 - RNA, 20 nt, Artificial Sequence
  MKO10015308_A_E2f7
  gRNA
uccguugacaagggguagcu

SEQ ID NO: 15309 - RNA, 20 nt, Artificial Sequence
  MKO10015309_A_E2f7
  gRNA
ucgaucggcucguucuucau

SEQ ID NO: 15310 - RNA, 20 nt, Artificial Sequence
  MKO10015310_A_E2f8
  gRNA
cgacacucuucagcgucccg

SEQ ID NO: 15311 - RNA, 20 nt, Artificial Sequence
  MKO10015311_A_E2f8
  gRNA
gguacuugggguaccgcgcu

SEQ ID NO: 15312 - RNA, 20 nt, Artificial Sequence
  MKO10015312_A_E2f8
  gRNA
ugagccgccuugccaaaaac

SEQ ID NO: 15313 - RNA, 20 nt, Artificial Sequence
  MKO10015313_A_E330009J07Rik
  gRNA
cagaaugcgcuuucgaagua

SEQ ID NO: 15314 - RNA, 20 nt, Artificial Sequence
  MKO10015314_A_E330009J07Rik
  gRNA
gcgagcuggagcgaggcgcu

SEQ ID NO: 15315 - RNA, 20 nt, Artificial Sequence
  MKO10015315_A_E330009J07Rik
  gRNA
ccucaagauauugaccuuga

SEQ ID NO: 15316 - RNA, 20 nt, Artificial Sequence
  MKO10015316_A_E330014E10Rik
  gRNA
uccaucuagcagagcuugca

SEQ ID NO: 15317 - RNA, 20 nt, Artificial Sequence
  MKO10015317_A_E330014E10Rik
  gRNA
ccacacuccagaagcuagca

SEQ ID NO: 15318 - RNA, 20 nt, Artificial Sequence
  MKO10015318_A_E330014E10Rik
  gRNA
cuuacccuaguaucugaugc

SEQ ID NO: 15319 - RNA, 20 nt, Artificial Sequence
  MKO10015319_A_E330017A01Rik
  gRNA
auugucguuaccucauacgu

SEQ ID NO: 15320 - RNA, 20 nt, Artificial Sequence
  MKO10015320_A_E330017A01Rik
  gRNA
cugcccuccuccaacguaug

SEQ ID NO: 15321 - RNA, 20 nt, Artificial Sequence
  MKO10015321_A_E330017A01Rik
  gRNA
gcaggugguaagccacaacu

SEQ ID NO: 15322 - RNA, 20 nt, Artificial Sequence
  MKO10015322_A_E330021D16Rik
  gRNA
cugcaagaugaccgauucua

SEQ ID NO: 15323 - RNA, 20 nt, Artificial Sequence
  MKO10015323_A_E330021D16Rik
  gRNA
gaguccacgaaccacaucgc

SEQ ID NO: 15324 - RNA, 20 nt, Artificial Sequence
  MKO10015324_A_E330021D16Rik
  gRNA
cagcgccuacuccauagaau

SEQ ID NO: 15325 - RNA, 20 nt, Artificial Sequence
  MKO10015325_A_E330034G19Rik
  gRNA
ugcccuacuacagcaucacg

SEQ ID NO: 15326 - RNA, 20 nt, Artificial Sequence
  MKO10015326_A_E330034G19Rik
  gRNA
ugggggccagcuccuaccac

SEQ ID NO: 15327 - RNA, 20 nt, Artificial Sequence
  MKO10015327_A_E330034G19Rik
  gRNA
ucaacugauucagcucuguc

SEQ ID NO: 15328 - RNA, 20 nt, Artificial Sequence
  MKO10015328_A_E430018J23Rik
  gRNA
gcccuuuccggggccauccg

SEQ ID NO: 15329 - RNA, 20 nt, Artificial Sequence
  MKO10015329_A_E430018J23Rik
  gRNA
aggguugugcaccgcaacag

SEQ ID NO: 15330 - RNA, 20 nt, Artificial Sequence
  MKO10015330_A_E430018J23Rik
  gRNA
ccccggaaagggccuccgcu

SEQ ID NO: 15331 - RNA, 20 nt, Artificial Sequence
  MKO10015331_A_E430025E21Rik
  gRNA
cugaugaacgucucguugau

SEQ ID NO: 15332 - RNA, 20 nt, Artificial Sequence
  MKO10015332_A_E430025E21Rik
  gRNA
uguaagcugcuacgaagcac

SEQ ID NO: 15333 - RNA, 20 nt, Artificial Sequence
  MKO10015333_A_E430025E21Rik
  gRNA
gucaucgaccagaagauuga

SEQ ID NO: 15334 - RNA, 20 nt, Artificial Sequence
  MKO10015334_A_E4f1
  gRNA
gacauagcaugcacacguag

SEQ ID NO: 15335 - RNA, 20 nt, Artificial Sequence
  MKO10015335_A_E4f1
  gRNA
gguaacgcacagcagccgca

SEQ ID NO: 15336 - RNA, 20 nt, Artificial Sequence
  MKO10015336_A_E4f1
  gRNA
uucacauaccagugugccgu

SEQ ID NO: 15337 - RNA, 20 nt, Artificial Sequence
  MKO10015337_A_EU599041
  gRNA
ccagcaguagcauacaaagc

SEQ ID NO: 15338 - RNA, 20 nt, Artificial Sequence
  MKO10015338_A_EU599041
  gRNA
ccugcuuuguaugcuacugc

SEQ ID NO: 15339 - RNA, 20 nt, Artificial Sequence
  MKO10015339_A_EU599041
  gRNA
cuacaugaaagaauauauuc

SEQ ID NO: 15340 - RNA, 20 nt, Artificial Sequence
  MKO10015340_A_Eaf1
  gRNA
auugucuucgccugcgcugc

SEQ ID NO: 15341 - RNA, 20 nt, Artificial Sequence
  MKO10015341_A_Eaf1
  gRNA
uucccuuugaacaccgucau

SEQ ID NO: 15342 - RNA, 20 nt, Artificial Sequence
  MKO10015342_A_Eaf1
  gRNA
gcugucgucgucacuucccg

SEQ ID NO: 15343 - RNA, 20 nt, Artificial Sequence
  MKO10015343_A_Eaf2
  gRNA
ugcuacuugucaccgacuuc

SEQ ID NO: 15344 - RNA, 20 nt, Artificial Sequence
  MKO10015344_A_Eaf2
  gRNA
auaucauccauuagagacgu

SEQ ID NO: 15345 - RNA, 20 nt, Artificial Sequence
  MKO10015345_A_Eaf2
  gRNA
uacguaaaguacucaucaga

SEQ ID NO: 15346 - RNA, 20 nt, Artificial Sequence
  MKO10015346_A_Eapp
  gRNA
cacaaugucgucauacaggc

SEQ ID NO: 15347 - RNA, 20 nt, Artificial Sequence
  MKO10015347_A_Eapp
  gRNA
uacagcagcucaucguuugu

SEQ ID NO: 15348 - RNA, 20 nt, Artificial Sequence
  MKO10015348_A_Eapp
  gRNA
accaaaagcgaaaacucauc

SEQ ID NO: 15349 - RNA, 20 nt, Artificial Sequence
  MKO10015349_A_Ear10
  gRNA
auaagguguucuccuccaac

SEQ ID NO: 15350 - RNA, 20 nt, Artificial Sequence
  MKO10015350_A_Ear10
  gRNA
acugucauaauaguucauau

SEQ ID NO: 15351 - RNA, 20 nt, Artificial Sequence
  MKO10015351_A_Ear10
  gRNA
acugggaagugguuuguccc

SEQ ID NO: 15352 - RNA, 20 nt, Artificial Sequence
  MKO10015352_A_Ear11
  gRNA
ccacguaagaucugcaaaaa

SEQ ID NO: 15353 - RNA, 20 nt, Artificial Sequence
  MKO10015353_A_Ear11
  gRNA
aaccaccgggagggggucaa

SEQ ID NO: 15354 - RNA, 20 nt, Artificial Sequence
  MKO10015354_A_Ear11
  gRNA
ucugcaguuggaauaaugac

SEQ ID NO: 15355 - RNA, 20 nt, Artificial Sequence
  MKO10015355_A_Ear12
  gRNA
uaguacuccaaugaucuucu

SEQ ID NO: 15356 - RNA, 20 nt, Artificial Sequence
  MKO10015356_A_Ear12
  gRNA
agucgagacucaagcagcuu

SEQ ID NO: 15357 - RNA, 20 nt, Artificial Sequence
  MKO10015357_A_Ear12
  gRNA
auaccaaccaagaagaucau

SEQ ID NO: 15358 - RNA, 20 nt, Artificial Sequence
  MKO10015358_A_Ear14
  gRNA
cccgaugugaugcuguaaug

SEQ ID NO: 15359 - RNA, 20 nt, Artificial Sequence
  MKO10015359_A_Ear14
  gRNA
caaugcagauaccaaacgac

SEQ ID NO: 15360 - RNA, 20 nt, Artificial Sequence
  MKO10015360_A_Ear14
  gRNA
acuucacugaaccugucguu

SEQ ID NO: 15361 - RNA, 20 nt, Artificial Sequence
  MKO10015361_A_Ear1
  gRNA
uugaaaugaugcguauuaac

SEQ ID NO: 15362 - RNA, 20 nt, Artificial Sequence
  MKO10015362_A_Ear1
  gRNA
gcaucauuucaacauuacau

SEQ ID NO: 15363 - RNA, 20 nt, Artificial Sequence
  MKO10015363_A_Ear1
  gRNA
ugguauuauuauugauaugc

SEQ ID NO: 15364 - RNA, 20 nt, Artificial Sequence
  MKO10015364_A_Ear2
  gRNA
uaguacuccaaugaucuucu

SEQ ID NO: 15365 - RNA, 20 nt, Artificial Sequence
  MKO10015365_A_Ear2
  gRNA
agucgagacucaagcagcuu

SEQ ID NO: 15366 - RNA, 20 nt, Artificial Sequence
  MKO10015366_A_Ear2
  gRNA
auaccaaccaagaagaucau

SEQ ID NO: 15367 - RNA, 20 nt, Artificial Sequence
  MKO10015367_A_Ear3
  gRNA
uaguacuccaaugaucuucu

SEQ ID NO: 15368 - RNA, 20 nt, Artificial Sequence
  MKO10015368_A_Ear3
  gRNA
agucgagacucaagcagcuu

SEQ ID NO: 15369 - RNA, 20 nt, Artificial Sequence
  MKO10015369_A_Ear3
  gRNA
auaccaaccaagaagaucau

SEQ ID NO: 15370 - RNA, 20 nt, Artificial Sequence
  MKO10015370_A_Ear4
  gRNA
cccgaugugaugcuguaaug

SEQ ID NO: 15371 - RNA, 20 nt, Artificial Sequence
  MKO10015371_A_Ear4
  gRNA
caaugcagauaccaaacgac

SEQ ID NO: 15372 - RNA, 20 nt, Artificial Sequence
  MKO10015372_A_Ear4
  gRNA
acuucacugaaccugucguu

SEQ ID NO: 15373 - RNA, 20 nt, Artificial Sequence
  MKO10015373_A_Ear5
  gRNA
ggauaggugggacgguccuu

SEQ ID NO: 15374 - RNA, 20 nt, Artificial Sequence
  MKO10015374_A_Ear5
  gRNA
ugucccgucuuugcaagucu

SEQ ID NO: 15375 - RNA, 20 nt, Artificial Sequence
  MKO10015375_A_Ear5
  gRNA
gaugaacuaucaugacaauu

SEQ ID NO: 15376 - RNA, 20 nt, Artificial Sequence
  MKO10015376_A_Ear6
  gRNA
gcaaaccacugggaugcggu

SEQ ID NO: 15377 - RNA, 20 nt, Artificial Sequence
  MKO10015377_A_Ear6
  gRNA
acuccacugaucccuuuguu

SEQ ID NO: 15378 - RNA, 20 nt, Artificial Sequence
  MKO10015378_A_Ear6
  gRNA
agaaaccaaccgcaucccag

SEQ ID NO: 15379 - RNA, 20 nt, Artificial Sequence
  MKO10015379_A_Ear7
  gRNA
gcaaaccacugggaugcggu

SEQ ID NO: 15380 - RNA, 20 nt, Artificial Sequence
  MKO10015380_A_Ear7
  gRNA
acuccacugaucccuuuguu

SEQ ID NO: 15381 - RNA, 20 nt, Artificial Sequence
  MKO10015381_A_Ear7
  gRNA
agaaaccaaccgcaucccag

SEQ ID NO: 15382 - RNA, 20 nt, Artificial Sequence
  MKO10015382_A_Ears2
  gRNA
aguggcaggugauccgcguc

SEQ ID NO: 15383 - RNA, 20 nt, Artificial Sequence
  MKO10015383_A_Ears2
  gRNA
uuacacaguuugaccugacg

SEQ ID NO: 15384 - RNA, 20 nt, Artificial Sequence
  MKO10015384_A_Ears2
  gRNA
caccugaugagaguccccgc

SEQ ID NO: 15385 - RNA, 20 nt, Artificial Sequence
  MKO10015385_A_Ebag9
  gRNA
cccacaaguguaaagaucga

SEQ ID NO: 15386 - RNA, 20 nt, Artificial Sequence
  MKO10015386_A_Ebag9
  gRNA
uuauucgucugucccuaagc

SEQ ID NO: 15387 - RNA, 20 nt, Artificial Sequence
  MKO10015387_A_Ebag9
  gRNA
gucauguccuugaaguaguc

SEQ ID NO: 15388 - RNA, 20 nt, Artificial Sequence
  MKO10015388_A_Ebf1
  gRNA
ccgguaguggaucccauuau

SEQ ID NO: 15389 - RNA, 20 nt, Artificial Sequence
  MKO10015389_A_Ebf1
  gRNA
gagccucaccauugcuguag

SEQ ID NO: 15390 - RNA, 20 nt, Artificial Sequence
  MKO10015390_A_Ebf1
  gRNA
gauugagaggacggccuuug

SEQ ID NO: 15391 - RNA, 20 nt, Artificial Sequence
  MKO10015391_A_Ebf2
  gRNA
agucgaugagccugacauac

SEQ ID NO: 15392 - RNA, 20 nt, Artificial Sequence
  MKO10015392_A_Ebf2
  gRNA
cuuguagugaguaccauugu

SEQ ID NO: 15393 - RNA, 20 nt, Artificial Sequence
  MKO10015393_A_Ebf2
  gRNA
agcaaccuccuucaaacuug

SEQ ID NO: 15394 - RNA, 20 nt, Artificial Sequence
  MKO10015394_A_Ebf3
  gRNA
cgcucguggaugcacacggc

SEQ ID NO: 15395 - RNA, 20 nt, Artificial Sequence
  MKO10015395_A_Ebf3
  gRNA
gcgcggggggacgaccauga

SEQ ID NO: 15396 - RNA, 20 nt, Artificial Sequence
  MKO10015396_A_Ebf3
  gRNA
gaaauuggauuuccggaggu

SEQ ID NO: 15397 - RNA, 20 nt, Artificial Sequence
  MKO10015397_A_Ebf4
  gRNA
uauugacuccaugucgaagc

SEQ ID NO: 15398 - RNA, 20 nt, Artificial Sequence
  MKO10015398_A_Ebf4
  gRNA
acgggauccauuaccgccuu

SEQ ID NO: 15399 - RNA, 20 nt, Artificial Sequence
  MKO10015399_A_Ebf4
  gRNA
cacagccuucaucgacuucg

SEQ ID NO: 15400 - RNA, 20 nt, Artificial Sequence
  MKO10015400_A_Ebi3
  gRNA
ucaaguaccgacuccgcuac

SEQ ID NO: 15401 - RNA, 20 nt, Artificial Sequence
  MKO10015401_A_Ebi3
  gRNA
cucggcgccgguagcggagu

SEQ ID NO: 15402 - RNA, 20 nt, Artificial Sequence
  MKO10015402_A_Ebi3
  gRNA
cgacgugcaccuguucucca

SEQ ID NO: 15403 - RNA, 20 nt, Artificial Sequence
  MKO10015403_A_Ebna1bp2
  gRNA
ccaagcaacuucgagcgcuu

SEQ ID NO: 15404 - RNA, 20 nt, Artificial Sequence
  MKO10015404_A_Ebna1bp2
  gRNA
ccuaagcgcucgaaguugcu

SEQ ID NO: 15405 - RNA, 20 nt, Artificial Sequence
  MKO10015405_A_Ebna1bp2
  gRNA
auaccgcaagcacugcugcc

SEQ ID NO: 15406 - RNA, 20 nt, Artificial Sequence
  MKO10015406_A_Ebpl
  gRNA
cuggcucugcuacgacucac

SEQ ID NO: 15407 - RNA, 20 nt, Artificial Sequence
  MKO10015407_A_Ebpl
  gRNA
ggggcuuccgacgagccacu

SEQ ID NO: 15408 - RNA, 20 nt, Artificial Sequence
  MKO10015408_A_Ebpl
  gRNA
gcccaucuaggacaacaguc

SEQ ID NO: 15409 - RNA, 20 nt, Artificial Sequence
  MKO10015409_A_Ebp
  gRNA
cgggugcaaggggaccguau

SEQ ID NO: 15410 - RNA, 20 nt, Artificial Sequence
  MKO10015410_A_Ebp
  gRNA
ccucccgacuucgcauaucc

SEQ ID NO: 15411 - RNA, 20 nt, Artificial Sequence
  MKO10015411_A_Ebp
  gRNA
uaggccaccccguuuauuuc

SEQ ID NO: 15412 - RNA, 20 nt, Artificial Sequence
  MKO10015412_A_Ecd
  gRNA
uuaggucaauggggucccgu

SEQ ID NO: 15413 - RNA, 20 nt, Artificial Sequence
  MKO10015413_A_Ecd
  gRNA
gucaugccguacauaugagc

SEQ ID NO: 15414 - RNA, 20 nt, Artificial Sequence
  MKO10015414_A_Ecd
  gRNA
cuugagcaccgccacaaugc

SEQ ID NO: 15415 - RNA, 20 nt, Artificial Sequence
  MKO10015415_A_Ece1
  gRNA
aaggccaaccccgugcccga

SEQ ID NO: 15416 - RNA, 20 nt, Artificial Sequence
  MKO10015416_A_Ece1
  gRNA
uaguuucguucaugcacgca

SEQ ID NO: 15417 - RNA, 20 nt, Artificial Sequence
  MKO10015417_A_Ece1
  gRNA
ccccacaguagacccgugcc

SEQ ID NO: 15418 - RNA, 20 nt, Artificial Sequence
  MKO10015418_A_Ece2
  gRNA
gaacgucgcgcugcacgagu

SEQ ID NO: 15419 - RNA, 20 nt, Artificial Sequence
  MKO10015419_A_Ece2
  gRNA
cucgugcagcgcgacguuca

SEQ ID NO: 15420 - RNA, 20 nt, Artificial Sequence
  MKO10015420_A_Ece2
  gRNA
gaccauggauguucgagcac

SEQ ID NO: 15421 - RNA, 20 nt, Artificial Sequence
  MKO10015421_A_Ecel1
  gRNA
cgcguacaacaaagugacuc

SEQ ID NO: 15422 - RNA, 20 nt, Artificial Sequence
  MKO10015422_A_Ecel1
  gRNA
ucauccgcuccacaccucga

SEQ ID NO: 15423 - RNA, 20 nt, Artificial Sequence
  MKO10015423_A_Ecel1
  gRNA
gcagcgucuacucagacuac

SEQ ID NO: 15424 - RNA, 20 nt, Artificial Sequence
  MKO10015424_A_Ech1
  gRNA
agcccggcaguccgagucuu

SEQ ID NO: 15425 - RNA, 20 nt, Artificial Sequence
  MKO10015425_A_Ech1
  gRNA
augaugcggcccgcauagcc

SEQ ID NO: 15426 - RNA, 20 nt, Artificial Sequence
  MKO10015426_A_Ech1
  gRNA
cuggccgguuuagcugcacg

SEQ ID NO: 15427 - RNA, 20 nt, Artificial Sequence
  MKO10015427_A_Echdc1
  gRNA
ucgcuuuauaauacgaguca

SEQ ID NO: 15428 - RNA, 20 nt, Artificial Sequence
  MKO10015428_A_Echdc1
  gRNA
accguuaauaaguguugcuc

SEQ ID NO: 15429 - RNA, 20 nt, Artificial Sequence
  MKO10015429_A_Echdc1
  gRNA
caaugccguucugcuucuuu

SEQ ID NO: 15430 - RNA, 20 nt, Artificial Sequence
  MKO10015430_A_Echdc2
  gRNA
cccaaguaccugcuauucgg

SEQ ID NO: 15431 - RNA, 20 nt, Artificial Sequence
  MKO10015431_A_Echdc2
  gRNA
aaguuccaagcccccgccua

SEQ ID NO: 15432 - RNA, 20 nt, Artificial Sequence
  MKO10015432_A_Echdc2
  gRNA
accuaaugcccgcaaugccu

SEQ ID NO: 15433 - RNA, 20 nt, Artificial Sequence
  MKO10015433_A_Echdc3
  gRNA
cgaggaaguaggcgguucua

SEQ ID NO: 15434 - RNA, 20 nt, Artificial Sequence
  MKO10015434_A_Echdc3
  gRNA
gguagacaaccuggccuugc

SEQ ID NO: 15435 - RNA, 20 nt, Artificial Sequence
  MKO10015435_A_Echdc3
  gRNA
auaccucagcgugauaauca

SEQ ID NO: 15436 - RNA, 20 nt, Artificial Sequence
  MKO10015436_A_Echs1
  gRNA
cagagacucacccgagcagu

SEQ ID NO: 15437 - RNA, 20 nt, Artificial Sequence
  MKO10015437_A_Echs1
  gRNA
ggauuucuggcuguccgaac

SEQ ID NO: 15438 - RNA, 20 nt, Artificial Sequence
  MKO10015438_A_Echs1
  gRNA
aaugcagaaccgaacauuuc

SEQ ID NO: 15439 - RNA, 20 nt, Artificial Sequence
  MKO10015439_A_Eci1
  gRNA
ccgacgugaggaugacaccu

SEQ ID NO: 15440 - RNA, 20 nt, Artificial Sequence
  MKO10015440_A_Eci1
  gRNA
cuucgcuaacaagcgggugc

SEQ ID NO: 15441 - RNA, 20 nt, Artificial Sequence
  MKO10015441_A_Eci1
  gRNA
agggggcaacaaugcccagc

SEQ ID NO: 15442 - RNA, 20 nt, Artificial Sequence
  MKO10015442_A_Eci2
  gRNA
acucuaugcacuguacaagc

SEQ ID NO: 15443 - RNA, 20 nt, Artificial Sequence
  MKO10015443_A_Eci2
  gRNA
uugacaaagucaagcauacc

SEQ ID NO: 15444 - RNA, 20 nt, Artificial Sequence
  MKO10015444_A_Eci2
  gRNA
caugacaguguuaucagugc

SEQ ID NO: 15445 - RNA, 20 nt, Artificial Sequence
  MKO10015445_A_Eci3
  gRNA
ccucaguaucuuaguagacg

SEQ ID NO: 15446 - RNA, 20 nt, Artificial Sequence
  MKO10015446_A_Eci3
  gRNA
ccacgucuacuaagauacug

SEQ ID NO: 15447 - RNA, 20 nt, Artificial Sequence
  MKO10015447_A_Eci3
  gRNA
uaugacugaguuauccgugc

SEQ ID NO: 15448 - RNA, 20 nt, Artificial Sequence
  MKO10015448_A_Ecm1
  gRNA
ggccagucuuccucguacac

SEQ ID NO: 15449 - RNA, 20 nt, Artificial Sequence
  MKO10015449_A_Ecm1
  gRNA
acucggagucuccggguuug

SEQ ID NO: 15450 - RNA, 20 nt, Artificial Sequence
  MKO10015450_A_Ecm1
  gRNA
gcucuggcgucaucucucgc

SEQ ID NO: 15451 - RNA, 20 nt, Artificial Sequence
  MKO10015451_A_Ecm2
  gRNA
uauaggggcacgccuugggg

SEQ ID NO: 15452 - RNA, 20 nt, Artificial Sequence
  MKO10015452_A_Ecm2
  gRNA
aacgcagcugauaguccugu

SEQ ID NO: 15453 - RNA, 20 nt, Artificial Sequence
  MKO10015453_A_Ecm2
  gRNA
gcacucuccuuccgguuuaa

SEQ ID NO: 15454 - RNA, 20 nt, Artificial Sequence
  MKO10015454_A_Ecscr
  gRNA
uacgacaacucagaccucgc

SEQ ID NO: 15455 - RNA, 20 nt, Artificial Sequence
  MKO10015455_A_Ecscr
  gRNA
ugcgaggucugaguugucgu

SEQ ID NO: 15456 - RNA, 20 nt, Artificial Sequence
  MKO10015456_A_Ecscr
  gRNA
aguuagcacugacucugaug

SEQ ID NO: 15457 - RNA, 20 nt, Artificial Sequence
  MKO10015457_A_Ecsit
  gRNA
gcgcacaaugugcgcaagcg

SEQ ID NO: 15458 - RNA, 20 nt, Artificial Sequence
  MKO10015458_A_Ecsit
  gRNA
agaugcgcuggauaacguug

SEQ ID NO: 15459 - RNA, 20 nt, Artificial Sequence
  MKO10015459_A_Ecsit
  gRNA
agugccccgagaucuucccc

SEQ ID NO: 15460 - RNA, 20 nt, Artificial Sequence
  MKO10015460_A_Ecu2l
  gRNA
uauucaaagcucgacccccu

SEQ ID NO: 15461 - RNA, 20 nt, Artificial Sequence
  MKO10015461_A_Ecu2l
  gRNA
gaauucccgccguugcuugu

SEQ ID NO: 15462 - RNA, 20 nt, Artificial Sequence
  MKO10015462_A_Ecu2l
  gRNA
cuggaaguuucuaacggaac

SEQ ID NO: 15463 - RNA, 20 nt, Artificial Sequence
  MKO10015463_A_Ecu2
  gRNA
uuguacgaguaugcugaacc

SEQ ID NO: 15464 - RNA, 20 nt, Artificial Sequence
  MKO10015464_A_Ecu2
  gRNA
agcauacucguacaauacag

SEQ ID NO: 15465 - RNA, 20 nt, Artificial Sequence
  MKO10015465_A_Ecu2
  gRNA
cauugaguccaucuuuacac

SEQ ID NO: 15466 - RNA, 20 nt, Artificial Sequence
  MKO10015466_A_Eda2r
  gRNA
uucuaccgaaagacacgcau

SEQ ID NO: 15467 - RNA, 20 nt, Artificial Sequence
  MKO10015467_A_Eda2r
  gRNA
ggcccccaaugcgugucuuu

SEQ ID NO: 15468 - RNA, 20 nt, Artificial Sequence
  MKO10015468_A_Eda2r
  gRNA
uggagcugcagucaucaucc

SEQ ID NO: 15469 - RNA, 20 nt, Artificial Sequence
  MKO10015469_A_Edaradd
  gRNA
uuuaccugaaaggggaucuu

SEQ ID NO: 15470 - RNA, 20 nt, Artificial Sequence
  MKO10015470_A_Edaradd
  gRNA
agcaccaaagauccccuuuc

SEQ ID NO: 15471 - RNA, 20 nt, Artificial Sequence
  MKO10015471_A_Edaradd
  gRNA
aaguaucccauucaagacac

SEQ ID NO: 15472 - RNA, 20 nt, Artificial Sequence
  MKO10015472_A_Edar
  gRNA
auggaaaacgacgcugagug

SEQ ID NO: 15473 - RNA, 20 nt, Artificial Sequence
  MKO10015473_A_Edar
  gRNA
gucuuuagugccguauccac

SEQ ID NO: 15474 - RNA, 20 nt, Artificial Sequence
  MKO10015474_A_Edar
  gRNA
gcacacucauccagcacuuc

SEQ ID NO: 15475 - RNA, 20 nt, Artificial Sequence
  MKO10015475_A_Eda
  gRNA
uucccuucgcccgcccgagc

SEQ ID NO: 15476 - RNA, 20 nt, Artificial Sequence
  MKO10015476_A_Eda
  gRNA
uccgaauugcggcgggaacg

SEQ ID NO: 15477 - RNA, 20 nt, Artificial Sequence
  MKO10015477_A_Eda
  gRNA
ccuggggggccguugggccc

SEQ ID NO: 15478 - RNA, 20 nt, Artificial Sequence
  MKO10015478_A_Edc3
  gRNA
cggagccgauuguguaccgu

SEQ ID NO: 15479 - RNA, 20 nt, Artificial Sequence
  MKO10015479_A_Edc3
  gRNA
uacaggaguugugccgacga

SEQ ID NO: 15480 - RNA, 20 nt, Artificial Sequence
  MKO10015480_A_Edc3
  gRNA
aguccaaaagcuuccgucgu

SEQ ID NO: 15481 - RNA, 20 nt, Artificial Sequence
  MKO10015481_A_Edc4
  gRNA
gguggcaugguccguauacc

SEQ ID NO: 15482 - RNA, 20 nt, Artificial Sequence
  MKO10015482_A_Edc4
  gRNA
gguaacucaacgaacaaacc

SEQ ID NO: 15483 - RNA, 20 nt, Artificial Sequence
  MKO10015483_A_Edc4
  gRNA
guugcucccccgagccuugc

SEQ ID NO: 15484 - RNA, 20 nt, Artificial Sequence
  MKO10015484_A_Eddm3b
  gRNA
gaugagacuuucuacaggau

SEQ ID NO: 15485 - RNA, 20 nt, Artificial Sequence
  MKO10015485_A_Eddm3b
  gRNA
ugaggaccuuaaugggaguc

SEQ ID NO: 15486 - RNA, 20 nt, Artificial Sequence
  MKO10015486_A_Eddm3b
  gRNA
ucacggcuuuaucugucaug

SEQ ID NO: 15487 - RNA, 20 nt, Artificial Sequence
  MKO10015487_A_Edem1
  gRNA
aacuugcggagcaacgauac

SEQ ID NO: 15488 - RNA, 20 nt, Artificial Sequence
  MKO10015488_A_Edem1
  gRNA
uuaucguagcuucgaagacc

SEQ ID NO: 15489 - RNA, 20 nt, Artificial Sequence
  MKO10015489_A_Edem1
  gRNA
cugucacuuacccgaggaua

SEQ ID NO: 15490 - RNA, 20 nt, Artificial Sequence
  MKO10015490_A_Edem2
  gRNA
ucgaaccagggagcgaguca

SEQ ID NO: 15491 - RNA, 20 nt, Artificial Sequence
  MKO10015491_A_Edem2
  gRNA
gcaacccuuaccucggaugu

SEQ ID NO: 15492 - RNA, 20 nt, Artificial Sequence
  MKO10015492_A_Edem2
  gRNA
ccacgccuacgacaguuacc

SEQ ID NO: 15493 - RNA, 20 nt, Artificial Sequence
  MKO10015493_A_Edem3
  gRNA
aggcgucauccacaucgccc

SEQ ID NO: 15494 - RNA, 20 nt, Artificial Sequence
  MKO10015494_A_Edem3
  gRNA
ggcgauguggaugacgccuu

SEQ ID NO: 15495 - RNA, 20 nt, Artificial Sequence
  MKO10015495_A_Edem3
  gRNA
ccuaacacugauugauucuu

SEQ ID NO: 15496 - RNA, 20 nt, Artificial Sequence
  MKO10015496_A_Edf1
  gRNA
ucguuucaggccucaagcuc

SEQ ID NO: 15497 - RNA, 20 nt, Artificial Sequence
  MKO10015497_A_Edf1
  gRNA
cuuuguguucauuucgccuu

SEQ ID NO: 15498 - RNA, 20 nt, Artificial Sequence
  MKO10015498_A_Edf1
  gRNA
ucagcgacgaggagaagaug

SEQ ID NO: 15499 - RNA, 20 nt, Artificial Sequence
  MKO10015499_A_Edil3
  gRNA
gagauaagcgaagccuaucg

SEQ ID NO: 15500 - RNA, 20 nt, Artificial Sequence
  MKO10015500_A_Edil3
  gRNA
ugaaucccauuaaauccccg

SEQ ID NO: 15501 - RNA, 20 nt, Artificial Sequence
  MKO10015501_A_Edil3
  gRNA
uccacaacacuagagcaguu

SEQ ID NO: 15502 - RNA, 20 nt, Artificial Sequence
  MKO10015502_A_Edn1
  gRNA
aauaggcgcgucguaccgua

SEQ ID NO: 15503 - RNA, 20 nt, Artificial Sequence
  MKO10015503_A_Edn1
  gRNA
cgcacugacaucuaacugcc

SEQ ID NO: 15504 - RNA, 20 nt, Artificial Sequence
  MKO10015504_A_Edn1
  gRNA
uugggagccgaacucagcac

SEQ ID NO: 15505 - RNA, 20 nt, Artificial Sequence
  MKO10015505_A_Edn2
  gRNA
aggagcaucgacgaaaacgc

SEQ ID NO: 15506 - RNA, 20 nt, Artificial Sequence
  MKO10015506_A_Edn2
  gRNA
ccaccuaccagugucuucga

SEQ ID NO: 15507 - RNA, 20 nt, Artificial Sequence
  MKO10015507_A_Edn2
  gRNA
ccaccaagcuccgcuuugcc

SEQ ID NO: 15508 - RNA, 20 nt, Artificial Sequence
  MKO10015508_A_Edn3
  gRNA
guacaacgcaagcgugucca

SEQ ID NO: 15509 - RNA, 20 nt, Artificial Sequence
  MKO10015509_A_Edn3
  gRNA
uuagauccagcuaaggccgg

SEQ ID NO: 15510 - RNA, 20 nt, Artificial Sequence
  MKO10015510_A_Edn3
  gRNA
acgcuugcguuguacuugua

SEQ ID NO: 15511 - RNA, 20 nt, Artificial Sequence
  MKO10015511_A_Ednra
  gRNA
caagacggugaugcccacgg

SEQ ID NO: 15512 - RNA, 20 nt, Artificial Sequence
  MKO10015512_A_Ednra
  gRNA
caugguacccuucgaauaca

SEQ ID NO: 15513 - RNA, 20 nt, Artificial Sequence
  MKO10015513_A_Ednra
  gRNA
cagcucgcccuuguauucga

SEQ ID NO: 15514 - RNA, 20 nt, Artificial Sequence
  MKO10015514_A_Ednrb
  gRNA
augauuacgucggacuacaa

SEQ ID NO: 15515 - RNA, 20 nt, Artificial Sequence
  MKO10015515_A_Ednrb
  gRNA
gauaucgagcuguugcuucu

SEQ ID NO: 15516 - RNA, 20 nt, Artificial Sequence
  MKO10015516_A_Ednrb
  gRNA
ugaugaccugcgaaaugcuc

SEQ ID NO: 15517 - RNA, 20 nt, Artificial Sequence
  MKO10015517_A_Eea1
  gRNA
uuaccuuaagugaggccugu

SEQ ID NO: 15518 - RNA, 20 nt, Artificial Sequence
  MKO10015518_A_Eea1
  gRNA
uuucagacuccugggcgagu

SEQ ID NO: 15519 - RNA, 20 nt, Artificial Sequence
  MKO10015519_A_Eea1
  gRNA
ccuugagagccaacucgccc

SEQ ID NO: 15520 - RNA, 20 nt, Artificial Sequence
  MKO10015520_A_Eed
  gRNA
cuuauacgaaugccauucac

SEQ ID NO: 15521 - RNA, 20 nt, Artificial Sequence
  MKO10015521_A_Eed
  gRNA
ggcguauuugugggcguguc

SEQ ID NO: 15522 - RNA, 20 nt, Artificial Sequence
  MKO10015522_A_Eed
  gRNA
accguaucucccccugugaa

SEQ ID NO: 15523 - RNA, 20 nt, Artificial Sequence
  MKO10015523_A_Eef1a1
  gRNA
aagucacuuacauuagcacu

SEQ ID NO: 15524 - RNA, 20 nt, Artificial Sequence
  MKO10015524_A_Eef1a1
  gRNA
gagacugguguucucaagcc

SEQ ID NO: 15525 - RNA, 20 nt, Artificial Sequence
  MKO10015525_A_Eef1a1
  gRNA
agucgcaggggcuugucagu

SEQ ID NO: 15526 - RNA, 20 nt, Artificial Sequence
  MKO10015526_A_Eef1a2
  gRNA
aucauagcgcuucucgcugu

SEQ ID NO: 15527 - RNA, 20 nt, Artificial Sequence
  MKO10015527_A_Eef1a2
  gRNA
ggacugcgcagugcugaucg

SEQ ID NO: 15528 - RNA, 20 nt, Artificial Sequence
  MKO10015528_A_Eef1a2
  gRNA
ggaggauaccggucuccacu

SEQ ID NO: 15529 - RNA, 20 nt, Artificial Sequence
  MKO10015529_A_Eef1b2
  gRNA
ugaugugauuauaccaacgu

SEQ ID NO: 15530 - RNA, 20 nt, Artificial Sequence
  MKO10015530_A_Eef1b2
  gRNA
accugugucaugcccuacgu

SEQ ID NO: 15531 - RNA, 20 nt, Artificial Sequence
  MKO10015531_A_Eef1b2
  gRNA
acuuacaggagccccacacc

SEQ ID NO: 15532 - RNA, 20 nt, Artificial Sequence
  MKO10015532_A_Eef1d
  gRNA
aguccuuaccuggcgggagc

SEQ ID NO: 15533 - RNA, 20 nt, Artificial Sequence
  MKO10015533_A_Eef1d
  gRNA
uucaccuacuccccgagcca

SEQ ID NO: 15534 - RNA, 20 nt, Artificial Sequence
  MKO10015534_A_Eef1d
  gRNA
ugugaccuccggcucccgcc

SEQ ID NO: 15535 - RNA, 20 nt, Artificial Sequence
  MKO10015535_A_Eef1e1
  gRNA
cgccacccaucuagucaagc

SEQ ID NO: 15536 - RNA, 20 nt, Artificial Sequence
  MKO10015536_A_Eef1e1
  gRNA
aguacagcaggauguccgcc

SEQ ID NO: 15537 - RNA, 20 nt, Artificial Sequence
  MKO10015537_A_Eef1e1
  gRNA
aaauacucacuauaaagcgg

SEQ ID NO: 15538 - RNA, 20 nt, Artificial Sequence
  MKO10015538_A_Eef1g
  gRNA
caaauuaccauaauaggcaa

SEQ ID NO: 15539 - RNA, 20 nt, Artificial Sequence
  MKO10015539_A_Eef1g
  gRNA
caaagcguaccuguuuguug

SEQ ID NO: 15540 - RNA, 20 nt, Artificial Sequence
  MKO10015540_A_Eef1g
  gRNA
uccacagguuccagcauuug

SEQ ID NO: 15541 - RNA, 20 nt, Artificial Sequence
  MKO10015541_A_Eef2k
  gRNA
guagcgcuuggccacguagu

SEQ ID NO: 15542 - RNA, 20 nt, Artificial Sequence
  MKO10015542_A_Eef2k
  gRNA
ggccaagcgcuacaucgagc

SEQ ID NO: 15543 - RNA, 20 nt, Artificial Sequence
  MKO10015543_A_Eef2k
  gRNA
uuucucgaucgcaugcuucc

SEQ ID NO: 15544 - RNA, 20 nt, Artificial Sequence
  MKO10015544_A_Eef2
  gRNA
cccucagauugaccccgucc

SEQ ID NO: 15545 - RNA, 20 nt, Artificial Sequence
  MKO10015545_A_Eef2
  gRNA
ugaagcgcgucuccccagcu

SEQ ID NO: 15546 - RNA, 20 nt, Artificial Sequence
  MKO10015546_A_Eef2
  gRNA
gcgcuucacugacacucgca

SEQ ID NO: 15547 - RNA, 20 nt, Artificial Sequence
  MKO10015547_A_Eefsec
  gRNA
gggugcaccgauuauucccg

SEQ ID NO: 15548 - RNA, 20 nt, Artificial Sequence
  MKO10015548_A_Eefsec
  gRNA
gguccagaggggucucucgu

SEQ ID NO: 15549 - RNA, 20 nt, Artificial Sequence
  MKO10015549_A_Eefsec
  gRNA
cccuggggcguggccggcuu

SEQ ID NO: 15550 - RNA, 20 nt, Artificial Sequence
  MKO10015550_A_Eepd1
  gRNA
uccugcccaacauccgcaag

SEQ ID NO: 15551 - RNA, 20 nt, Artificial Sequence
  MKO10015551_A_Eepd1
  gRNA
ccccuuccacuugcggaugu

SEQ ID NO: 15552 - RNA, 20 nt, Artificial Sequence
  MKO10015552_A_Eepd1
  gRNA
acccagcaacggucaugcua

SEQ ID NO: 15553 - RNA, 20 nt, Artificial Sequence
  MKO10015553_A_Efcab10
  gRNA
ccuuacuuggucgggcaaag

SEQ ID NO: 15554 - RNA, 20 nt, Artificial Sequence
  MKO10015554_A_Efcab10
  gRNA
uaaucacucuggauacauuc

SEQ ID NO: 15555 - RNA, 20 nt, Artificial Sequence
  MKO10015555_A_Efcab10
  gRNA
guuagaguuguccauaaagu

SEQ ID NO: 15556 - RNA, 20 nt, Artificial Sequence
  MKO10015556_A_Efcab11
  gRNA
uggcucccaagcuaccagcg

SEQ ID NO: 15557 - RNA, 20 nt, Artificial Sequence
  MKO10015557_A_Efcab11
  gRNA
ccuaagccgagaggacuuua

SEQ ID NO: 15558 - RNA, 20 nt, Artificial Sequence
  MKO10015558_A_Efcab11
  gRNA
gacucuaucggaaugagaua

SEQ ID NO: 15559 - RNA, 20 nt, Artificial Sequence
  MKO10015559_A_Efcab12
  gRNA
ucuugaucuuucgacuacga

SEQ ID NO: 15560 - RNA, 20 nt, Artificial Sequence
  MKO10015560_A_Efcab12
  gRNA
gcgagaaccagcgcaucucc

SEQ ID NO: 15561 - RNA, 20 nt, Artificial Sequence
  MKO10015561_A_Efcab12
  gRNA
uucagcagguccaucuugcg

SEQ ID NO: 15562 - RNA, 20 nt, Artificial Sequence
  MKO10015562_A_Efcab14
  gRNA
gucugcggcugacuugacgc

SEQ ID NO: 15563 - RNA, 20 nt, Artificial Sequence
  MKO10015563_A_Efcab14
  gRNA
cauccucgcagccugcguug

SEQ ID NO: 15564 - RNA, 20 nt, Artificial Sequence
  MKO10015564_A_Efcab14
  gRNA
caacuugagaagauugaguc

SEQ ID NO: 15565 - RNA, 20 nt, Artificial Sequence
  MKO10015565_A_Efcab1
  gRNA
agcguaucagaguggauuca

SEQ ID NO: 15566 - RNA, 20 nt, Artificial Sequence
  MKO10015566_A_Efcab1
  gRNA
gccuugccugccugauccaa

SEQ ID NO: 15567 - RNA, 20 nt, Artificial Sequence
  MKO10015567_A_Efcab1
  gRNA
aauauuguuaccuuuggauc

SEQ ID NO: 15568 - RNA, 20 nt, Artificial Sequence
  MKO10015568_A_Efcab2
  gRNA
ccaccucgaaagcucgcaaa

SEQ ID NO: 15569 - RNA, 20 nt, Artificial Sequence
  MKO10015569_A_Efcab2
  gRNA
uuaggaugcugcccgacuga

SEQ ID NO: 15570 - RNA, 20 nt, Artificial Sequence
  MKO10015570_A_Efcab2
  gRNA
cuacuguauuauucgauuca

SEQ ID NO: 15571 - RNA, 20 nt, Artificial Sequence
  MKO10015571_A_Efcab3
  gRNA
cuuagagauaaagauuugcg

SEQ ID NO: 15572 - RNA, 20 nt, Artificial Sequence
  MKO10015572_A_Efcab3
  gRNA
gauaagcaccauagcaaaac

SEQ ID NO: 15573 - RNA, 20 nt, Artificial Sequence
  MKO10015573_A_Efcab3
  gRNA
aaccucgucccugcacagaa

SEQ ID NO: 15574 - RNA, 20 nt, Artificial Sequence
  MKO10015574_A_Efcab4a
  gRNA
ggaaguucugaugcgcgcau

SEQ ID NO: 15575 - RNA, 20 nt, Artificial Sequence
  MKO10015575_A_Efcab4a
  gRNA
gucuugagcaagcgcugcga

SEQ ID NO: 15576 - RNA, 20 nt, Artificial Sequence
  MKO10015576_A_Efcab4a
  gRNA
ucggggagcagcgacaccgc

SEQ ID NO: 15577 - RNA, 20 nt, Artificial Sequence
  MKO10015577_A_Efcab4b
  gRNA
cucacagugaaagugacguc

SEQ ID NO: 15578 - RNA, 20 nt, Artificial Sequence
  MKO10015578_A_Efcab4b
  gRNA
ggucuucgaaguuggacagc

SEQ ID NO: 15579 - RNA, 20 nt, Artificial Sequence
  MKO10015579_A_Efcab4b
  gRNA
ccagaacuuacuaaauccag

SEQ ID NO: 15580 - RNA, 20 nt, Artificial Sequence
  MKO10015580_A_Efcab5
  gRNA
ucugcgugacccugcacuac

SEQ ID NO: 15581 - RNA, 20 nt, Artificial Sequence
  MKO10015581_A_Efcab5
  gRNA
cucccucuuaccacgacuau

SEQ ID NO: 15582 - RNA, 20 nt, Artificial Sequence
  MKO10015582_A_Efcab5
  gRNA
gaucauagaacgcuuccagc

SEQ ID NO: 15583 - RNA, 20 nt, Artificial Sequence
  MKO10015583_A_Efcab6
  gRNA
ugugguuccggucgaguauc

SEQ ID NO: 15584 - RNA, 20 nt, Artificial Sequence
  MKO10015584_A_Efcab6
  gRNA
aagucuuccagauacucgac

SEQ ID NO: 15585 - RNA, 20 nt, Artificial Sequence
  MKO10015585_A_Efcab6
  gRNA
guagaucccgaucagcagcu

SEQ ID NO: 15586 - RNA, 20 nt, Artificial Sequence
  MKO10015586_A_Efcab7
  gRNA
gccguuauaucugagucaag

SEQ ID NO: 15587 - RNA, 20 nt, Artificial Sequence
  MKO10015587_A_Efcab7
  gRNA
uugguuacuguuagcgcuca

SEQ ID NO: 15588 - RNA, 20 nt, Artificial Sequence
  MKO10015588_A_Efcab7
  gRNA
cagcaccaaaaccgucaccu

SEQ ID NO: 15589 - RNA, 20 nt, Artificial Sequence
  MKO10015589_A_Efcab9
  gRNA
ugccgccaugaaacugacuc

SEQ ID NO: 15590 - RNA, 20 nt, Artificial Sequence
  MKO10015590_A_Efcab9
  gRNA
gggaauggcgguacauaaag

SEQ ID NO: 15591 - RNA, 20 nt, Artificial Sequence
  MKO10015591_A_Efcab9
  gRNA
cggggagaugaauauaggug

SEQ ID NO: 15592 - RNA, 20 nt, Artificial Sequence
  MKO10015592_A_Efcc1
  gRNA
ugagcagcuguuccgcuccg

SEQ ID NO: 15593 - RNA, 20 nt, Artificial Sequence
  MKO10015593_A_Efcc1
  gRNA
gacgcagcuugcaccgagug

SEQ ID NO: 15594 - RNA, 20 nt, Artificial Sequence
  MKO10015594_A_Efcc1
  gRNA
agcucgugcgccgccgcuuc

SEQ ID NO: 15595 - RNA, 20 nt, Artificial Sequence
  MKO10015595_A_Efemp1
  gRNA
cucguaaauugaugcauacu

SEQ ID NO: 15596 - RNA, 20 nt, Artificial Sequence
  MKO10015596_A_Efemp1
  gRNA
caaguaugcaucaauuuacg

SEQ ID NO: 15597 - RNA, 20 nt, Artificial Sequence
  MKO10015597_A_Efemp1
  gRNA
uuucggccaguuugaacuuc

SEQ ID NO: 15598 - RNA, 20 nt, Artificial Sequence
  MKO10015598_A_Efemp2
  gRNA
gacacaaauaacccccguag

SEQ ID NO: 15599 - RNA, 20 nt, Artificial Sequence
  MKO10015599_A_Efemp2
  gRNA
guccccaccguguagcuguc

SEQ ID NO: 15600 - RNA, 20 nt, Artificial Sequence
  MKO10015600_A_Efemp2
  gRNA
agcguccccacaggaucccg

SEQ ID NO: 15601 - RNA, 20 nt, Artificial Sequence
  MKO10015601_A_Efhb
  gRNA
ccagcuaaugacucccccag

SEQ ID NO: 15602 - RNA, 20 nt, Artificial Sequence
  MKO10015602_A_Efhb
  gRNA
uagccaucaacgagcaccau

SEQ ID NO: 15603 - RNA, 20 nt, Artificial Sequence
  MKO10015603_A_Efhb
  gRNA
uucuuuaagcacaucuucga

SEQ ID NO: 15604 - RNA, 20 nt, Artificial Sequence
  MKO10015604_A_Efhc1
  gRNA
gcauacgcugucgguucaug

SEQ ID NO: 15605 - RNA, 20 nt, Artificial Sequence
  MKO10015605_A_Efhc1
  gRNA
cucucccguuguuccguucg

SEQ ID NO: 15606 - RNA, 20 nt, Artificial Sequence
  MKO10015606_A_Efhc1
  gRNA
aguuguccgacgucccacca

SEQ ID NO: 15607 - RNA, 20 nt, Artificial Sequence
  MKO10015607_A_Efhc2
  gRNA
ugggaagcuuaccccgccga

SEQ ID NO: 15608 - RNA, 20 nt, Artificial Sequence
  MKO10015608_A_Efhc2
  gRNA
agcagaucuccaccuacucc

SEQ ID NO: 15609 - RNA, 20 nt, Artificial Sequence
  MKO10015609_A_Efhc2
  gRNA
aaacgauucauccaguauga

SEQ ID NO: 15610 - RNA, 20 nt, Artificial Sequence
  MKO10015610_A_Efhd1
  gRNA
uucggaguccgcgcuggcug

SEQ ID NO: 15611 - RNA, 20 nt, Artificial Sequence
  MKO10015611_A_Efhd1
  gRNA
uaacucagcuucgaacuuac

SEQ ID NO: 15612 - RNA, 20 nt, Artificial Sequence
  MKO10015612_A_Efhd1
  gRNA
uuccgagauugaugucgccc

SEQ ID NO: 15613 - RNA, 20 nt, Artificial Sequence
  MKO10015613_A_Efhd2
  gRNA
cuugcuggccaacucguccg

SEQ ID NO: 15614 - RNA, 20 nt, Artificial Sequence
  MKO10015614_A_Efhd2
  gRNA
gcagccggggcucaacgggg

SEQ ID NO: 15615 - RNA, 20 nt, Artificial Sequence
  MKO10015615_A_Efhd2
  gRNA
caacguguccagccgcuuug

SEQ ID NO: 15616 - RNA, 20 nt, Artificial Sequence
  MKO10015616_A_Efna1
  gRNA
guacaguguguaucgcucca

SEQ ID NO: 15617 - RNA, 20 nt, Artificial Sequence
  MKO10015617_A_Efna1
  gRNA
ugggccgguugcaauuccaa

SEQ ID NO: 15618 - RNA, 20 nt, Artificial Sequence
  MKO10015618_A_Efna1
  gRNA
ugcagaugacccggaaguac

SEQ ID NO: 15619 - RNA, 20 nt, Artificial Sequence
  MKO10015619_A_Efna2
  gRNA
uccucguugcgcgcacgcag

SEQ ID NO: 15620 - RNA, 20 nt, Artificial Sequence
  MKO10015620_A_Efna2
  gRNA
gacugcguaucggucagcgu

SEQ ID NO: 15621 - RNA, 20 nt, Artificial Sequence
  MKO10015621_A_Efna2
  gRNA
ggcagcggcgccccguagug

SEQ ID NO: 15622 - RNA, 20 nt, Artificial Sequence
  MKO10015622_A_Efna3
  gRNA
ggugaacgugaacgacuauc

SEQ ID NO: 15623 - RNA, 20 nt, Artificial Sequence
  MKO10015623_A_Efna3
  gRNA
uguccacagccugcggcgag

SEQ ID NO: 15624 - RNA, 20 nt, Artificial Sequence
  MKO10015624_A_Efna3
  gRNA
caccccgcagcaucgcacuc

SEQ ID NO: 15625 - RNA, 20 nt, Artificial Sequence
  MKO10015625_A_Efna4
  gRNA
uccuacagcggugccgacuc

SEQ ID NO: 15626 - RNA, 20 nt, Artificial Sequence
  MKO10015626_A_Efna4
  gRNA
ccuggagaaagcgguacguc

SEQ ID NO: 15627 - RNA, 20 nt, Artificial Sequence
  MKO10015627_A_Efna4
  gRNA
gcaucgagcaauuccagcgc

SEQ ID NO: 15628 - RNA, 20 nt, Artificial Sequence
  MKO10015628_A_Efna5
  gRNA
guagcggucggcgacgacuu

SEQ ID NO: 15629 - RNA, 20 nt, Artificial Sequence
  MKO10015629_A_Efna5
  gRNA
ccgaccgcuacgccgucuac

SEQ ID NO: 15630 - RNA, 20 nt, Artificial Sequence
  MKO10015630_A_Efna5
  gRNA
ucugcgccgcguucucaccg

SEQ ID NO: 15631 - RNA, 20 nt, Artificial Sequence
  MKO10015631_A_Efnb1
  gRNA
uuguucgcagccgucggcgc

SEQ ID NO: 15632 - RNA, 20 nt, Artificial Sequence
  MKO10015632_A_Efnb1
  gRNA
guacagcuuguaguacucgu

SEQ ID NO: 15633 - RNA, 20 nt, Artificial Sequence
  MKO10015633_A_Efnb1
  gRNA
cccggcgaacaucuacuaca

SEQ ID NO: 15634 - RNA, 20 nt, Artificial Sequence
  MKO10015634_A_Efnb2
  gRNA
ucuuguuggaccgugauucc

SEQ ID NO: 15635 - RNA, 20 nt, Artificial Sequence
  MKO10015635_A_Efnb2
  gRNA
uccgaaguggccuuauucgc

SEQ ID NO: 15636 - RNA, 20 nt, Artificial Sequence
  MKO10015636_A_Efnb2
  gRNA
ugaugcgaucccugcgaaua

SEQ ID NO: 15637 - RNA, 20 nt, Artificial Sequence
  MKO10015637_A_Efnb3
  gRNA
ucuagccgguccccgaucug

SEQ ID NO: 15638 - RNA, 20 nt, Artificial Sequence
  MKO10015638_A_Efnb3
  gRNA
ccgccgucuccgccaacaca

SEQ ID NO: 15639 - RNA, 20 nt, Artificial Sequence
  MKO10015639_A_Efnb3
  gRNA
uaccaauuauguaguaaucg

SEQ ID NO: 15640 - RNA, 20 nt, Artificial Sequence
  MKO10015640_A_Efr3a
  gRNA
uagguacguucuaaucgcua

SEQ ID NO: 15641 - RNA, 20 nt, Artificial Sequence
  MKO10015641_A_Efr3a
  gRNA
uccaccagacguuuguagcg

SEQ ID NO: 15642 - RNA, 20 nt, Artificial Sequence
  MKO10015642_A_Efr3a
  gRNA
gcguccucgcuacaaacguc

SEQ ID NO: 15643 - RNA, 20 nt, Artificial Sequence
  MKO10015643_A_Efr3b
  gRNA
gaugugggucgccaucgaua

SEQ ID NO: 15644 - RNA, 20 nt, Artificial Sequence
  MKO10015644_A_Efr3b
  gRNA
gaaguucgccaacauugaag

SEQ ID NO: 15645 - RNA, 20 nt, Artificial Sequence
  MKO10015645_A_Efr3b
  gRNA
augugacucacccauaucga

SEQ ID NO: 15646 - RNA, 20 nt, Artificial Sequence
  MKO10015646_A_Efs
  gRNA
uccgccgaggggauguucua

SEQ ID NO: 15647 - RNA, 20 nt, Artificial Sequence
  MKO10015647_A_Efs
  gRNA
guuccucgggugcuucguac

SEQ ID NO: 15648 - RNA, 20 nt, Artificial Sequence
  MKO10015648_A_Efs
  gRNA
caaccuguacgaagcacccg

SEQ ID NO: 15649 - RNA, 20 nt, Artificial Sequence
  MKO10015649_A_Eftud1
  gRNA
aggcaguucuucgacaagcc

SEQ ID NO: 15650 - RNA, 20 nt, Artificial Sequence
  MKO10015650_A_Eftud1
  gRNA
aaccgcuguugauacuucug

SEQ ID NO: 15651 - RNA, 20 nt, Artificial Sequence
  MKO10015651_A_Eftud1
  gRNA
uaagauagaccgccugauag

SEQ ID NO: 15652 - RNA, 20 nt, Artificial Sequence
  MKO10015652_A_Eftud2
  gRNA
accguacaccuccucggccg

SEQ ID NO: 15653 - RNA, 20 nt, Artificial Sequence
  MKO10015653_A_Eftud2
  gRNA
acccgucacgguguaugaga

SEQ ID NO: 15654 - RNA, 20 nt, Artificial Sequence
  MKO10015654_A_Eftud2
  gRNA
cgaggagguguacggucccg

SEQ ID NO: 15655 - RNA, 20 nt, Artificial Sequence
  MKO10015655_A_Egfbp2
  gRNA
augcuucaaacaacaccucc

SEQ ID NO: 15656 - RNA, 20 nt, Artificial Sequence
  MKO10015656_A_Egfbp2
  gRNA
ucaaauggcccugaaccaug

SEQ ID NO: 15657 - RNA, 20 nt, Artificial Sequence
  MKO10015657_A_Egfbp2
  gRNA
guguuguuugaagcaucagg

SEQ ID NO: 15658 - RNA, 20 nt, Artificial Sequence
  MKO10015658_A_Egfem1
  gRNA
gcgccacuuacaugccgggc

SEQ ID NO: 15659 - RNA, 20 nt, Artificial Sequence
  MKO10015659_A_Egfem1
  gRNA
uggaagggagugcucguauc

SEQ ID NO: 15660 - RNA, 20 nt, Artificial Sequence
  MKO10015660_A_Egfem1
  gRNA
ucguaucccacacaccaccg

SEQ ID NO: 15661 - RNA, 20 nt, Artificial Sequence
  MKO10015661_A_Egfl6
  gRNA
guuuagucuggcacacgucc

SEQ ID NO: 15662 - RNA, 20 nt, Artificial Sequence
  MKO10015662_A_Egfl6
  gRNA
acacucaccgaacuugcacc

SEQ ID NO: 15663 - RNA, 20 nt, Artificial Sequence
  MKO10015663_A_Egfl6
  gRNA
cugugucuucacagccguac

SEQ ID NO: 15664 - RNA, 20 nt, Artificial Sequence
  MKO10015664_A_Egfl7
  gRNA
uguguccgucgcaaguggug

SEQ ID NO: 15665 - RNA, 20 nt, Artificial Sequence
  MKO10015665_A_Egfl7
  gRNA
ggagggaguugcauccgccc

SEQ ID NO: 15666 - RNA, 20 nt, Artificial Sequence
  MKO10015666_A_Egfl7
  gRNA
caccccagggcuacggcgau

SEQ ID NO: 15667 - RNA, 20 nt, Artificial Sequence
  MKO10015667_A_Egfl8
  gRNA
caacgaguccuauagucaac

SEQ ID NO: 15668 - RNA, 20 nt, Artificial Sequence
  MKO10015668_A_Egfl8
  gRNA
uaugcgccuccccgcacaca

SEQ ID NO: 15669 - RNA, 20 nt, Artificial Sequence
  MKO10015669_A_Egfl8
  gRNA
gacacacguggugugcuguc

SEQ ID NO: 15670 - RNA, 20 nt, Artificial Sequence
  MKO10015670_A_Egflam
  gRNA
cggucacacaacgucccggu

SEQ ID NO: 15671 - RNA, 20 nt, Artificial Sequence
  MKO10015671_A_Egflam
  gRNA
cguugugugaccgcucccgc

SEQ ID NO: 15672 - RNA, 20 nt, Artificial Sequence
  MKO10015672_A_Egflam
  gRNA
accuccucuugacaucaagc

SEQ ID NO: 15673 - RNA, 20 nt, Artificial Sequence
  MKO10015673_A_Egfr
  gRNA
cggucagagaugcgacccuc

SEQ ID NO: 15674 - RNA, 20 nt, Artificial Sequence
  MKO10015674_A_Egfr
  gRNA
acugcccaugcggaacuuac

SEQ ID NO: 15675 - RNA, 20 nt, Artificial Sequence
  MKO10015675_A_Egfr
  gRNA
cgcgcuuacaacugcucgga

SEQ ID NO: 15676 - RNA, 20 nt, Artificial Sequence
  MKO10015676_A_Egf
  gRNA
guggcuccguccgucuuauc

SEQ ID NO: 15677 - RNA, 20 nt, Artificial Sequence
  MKO10015677_A_Egf
  gRNA
aucucucggauugacccaga

SEQ ID NO: 15678 - RNA, 20 nt, Artificial Sequence
  MKO10015678_A_Egf
  gRNA
ccucuaguccugucccguua

SEQ ID NO: 15679 - RNA, 20 nt, Artificial Sequence
  MKO10015679_A_Egln1
  gRNA
guacuucaugaggguuacgc

SEQ ID NO: 15680 - RNA, 20 nt, Artificial Sequence
  MKO10015680_A_Egln1
  gRNA
cacuaccuuguggcguaugc

SEQ ID NO: 15681 - RNA, 20 nt, Artificial Sequence
  MKO10015681_A_Egln1
  gRNA
acauagccuguuccguugcc

SEQ ID NO: 15682 - RNA, 20 nt, Artificial Sequence
  MKO10015682_A_Egln2
  gRNA
ugaugcagcgcccaucgccg

SEQ ID NO: 15683 - RNA, 20 nt, Artificial Sequence
  MKO10015683_A_Egln2
  gRNA
acguacccgagcccauugcc

SEQ ID NO: 15684 - RNA, 20 nt, Artificial Sequence
  MKO10015684_A_Egln2
  gRNA
ucagguacgccaucacuguc

SEQ ID NO: 15685 - RNA, 20 nt, Artificial Sequence
  MKO10015685_A_Egln3
  gRNA
guccugcggauauuuccgga

SEQ ID NO: 15686 - RNA, 20 nt, Artificial Sequence
  MKO10015686_A_Egln3
  gRNA
gaaaucguuuguagcagacg

SEQ ID NO: 15687 - RNA, 20 nt, Artificial Sequence
  MKO10015687_A_Egln3
  gRNA
gacagguuauguucgccaug

SEQ ID NO: 15688 - RNA, 20 nt, Artificial Sequence
  MKO10015688_A_Egr1
  gRNA
gguugggguacuugcgcaug

SEQ ID NO: 15689 - RNA, 20 nt, Artificial Sequence
  MKO10015689_A_Egr1
  gRNA
caucaauugcaucucggccu

SEQ ID NO: 15690 - RNA, 20 nt, Artificial Sequence
  MKO10015690_A_Egr1
  gRNA
ugggaggcaaccgagucguu

SEQ ID NO: 15691 - RNA, 20 nt, Artificial Sequence
  MKO10015691_A_Egr2
  gRNA
gagcgaagcuacucggauac

SEQ ID NO: 15692 - RNA, 20 nt, Artificial Sequence
  MKO10015692_A_Egr2
  gRNA
ggaagaccucgccgccucgu

SEQ ID NO: 15693 - RNA, 20 nt, Artificial Sequence
  MKO10015693_A_Egr2
  gRNA
cucccgccacuccguucauc

SEQ ID NO: 15694 - RNA, 20 nt, Artificial Sequence
  MKO10015694_A_Egr3
  gRNA
ccccacgcgugucccgcgga

SEQ ID NO: 15695 - RNA, 20 nt, Artificial Sequence
  MKO10015695_A_Egr3
  gRNA
cggggucuugcuaggccgau

SEQ ID NO: 15696 - RNA, 20 nt, Artificial Sequence
  MKO10015696_A_Egr3
  gRNA
gagcgcgcuggggaucuccu

SEQ ID NO: 15697 - RNA, 20 nt, Artificial Sequence
  MKO10015697_A_Egr4
  gRNA
ucucgucacugcgcgcgaag

SEQ ID NO: 15698 - RNA, 20 nt, Artificial Sequence
  MKO10015698_A_Egr4
  gRNA
cuccgguuacagcgcggcga

SEQ ID NO: 15699 - RNA, 20 nt, Artificial Sequence
  MKO10015699_A_Egr4
  gRNA
gccgagggagcgucccuagc

SEQ ID NO: 15700 - RNA, 20 nt, Artificial Sequence
  MKO10015700_A_Ehbp1l1
  gRNA
uauggacucggcggaaccga

SEQ ID NO: 15701 - RNA, 20 nt, Artificial Sequence
  MKO10015701_A_Ehbp1l1
  gRNA
cccgcuugccaacccgcugc

SEQ ID NO: 15702 - RNA, 20 nt, Artificial Sequence
  MKO10015702_A_Ehbp1l1
  gRNA
accgagauguccacguucuc

SEQ ID NO: 15703 - RNA, 20 nt, Artificial Sequence
  MKO10015703_A_Ehbp1
  gRNA
ggaauaaaaaauccauaucg

SEQ ID NO: 15704 - RNA, 20 nt, Artificial Sequence
  MKO10015704_A_Ehbp1
  gRNA
uuuggacaagaagaagccga

SEQ ID NO: 15705 - RNA, 20 nt, Artificial Sequence
  MKO10015705_A_Ehbp1
  gRNA
uacauucaaccaucagcucc

SEQ ID NO: 15706 - RNA, 20 nt, Artificial Sequence
  MKO10015706_A_Ehd1
  gRNA
cuuugggcauggcuacggcg

SEQ ID NO: 15707 - RNA, 20 nt, Artificial Sequence
  MKO10015707_A_Ehd1
  gRNA
cucgccguagccaugcccaa

SEQ ID NO: 15708 - RNA, 20 nt, Artificial Sequence
  MKO10015708_A_Ehd1
  gRNA
cggcguuucucggcagagac

SEQ ID NO: 15709 - RNA, 20 nt, Artificial Sequence
  MKO10015709_A_Ehd2
  gRNA
cacccgcaugggccccuucg

SEQ ID NO: 15710 - RNA, 20 nt, Artificial Sequence
  MKO10015710_A_Ehd2
  gRNA
ccuccagcucgaaaagacgc

SEQ ID NO: 15711 - RNA, 20 nt, Artificial Sequence
  MKO10015711_A_Ehd2
  gRNA
ugagcuugcgcagcgccgca

SEQ ID NO: 15712 - RNA, 20 nt, Artificial Sequence
  MKO10015712_A_Ehd3
  gRNA
gcuugugggcgucgaagagu

SEQ ID NO: 15713 - RNA, 20 nt, Artificial Sequence
  MKO10015713_A_Ehd3
  gRNA
cccgcucagcaaaccauucg

SEQ ID NO: 15714 - RNA, 20 nt, Artificial Sequence
  MKO10015714_A_Ehd3
  gRNA
uaucagugugaucgacacac

SEQ ID NO: 15715 - RNA, 20 nt, Artificial Sequence
  MKO10015715_A_Ehd4
  gRNA
ugcaaaacaccgacaaccgc

SEQ ID NO: 15716 - RNA, 20 nt, Artificial Sequence
  MKO10015716_A_Ehd4
  gRNA
agaagcgagaacuuaucuac

SEQ ID NO: 15717 - RNA, 20 nt, Artificial Sequence
  MKO10015717_A_Ehd4
  gRNA
ccaaccuugcacgcuugaug

SEQ ID NO: 15718 - RNA, 20 nt, Artificial Sequence
  MKO10015718_A_Ehf
  gRNA
cuccgcuaaugucgaacucc

SEQ ID NO: 15719 - RNA, 20 nt, Artificial Sequence
  MKO10015719_A_Ehf
  gRNA
cuggcuuccaaaaaaaccgc

SEQ ID NO: 15720 - RNA, 20 nt, Artificial Sequence
  MKO10015720_A_Ehf
  gRNA
ggaaaaggucacugcugcau

SEQ ID NO: 15721 - RNA, 20 nt, Artificial Sequence
  MKO10015721_A_Ehhadh
  gRNA
agcugcguuccucuugcacc

SEQ ID NO: 15722 - RNA, 20 nt, Artificial Sequence
  MKO10015722_A_Ehhadh
  gRNA
cuaucggauugccaaugcaa

SEQ ID NO: 15723 - RNA, 20 nt, Artificial Sequence
  MKO10015723_A_Ehhadh
  gRNA
gccauccaaggcguggcucu

SEQ ID NO: 15724 - RNA, 20 nt, Artificial Sequence
  MKO10015724_A_Ehmt1
  gRNA
aacccugacaucagugcccg

SEQ ID NO: 15725 - RNA, 20 nt, Artificial Sequence
  MKO10015725_A_Ehmt1
  gRNA
auucuaaccuccucgcuucc

SEQ ID NO: 15726 - RNA, 20 nt, Artificial Sequence
  MKO10015726_A_Ehmt1
  gRNA
gccauguagcacugauucug

SEQ ID NO: 15727 - RNA, 20 nt, Artificial Sequence
  MKO10015727_A_Ehmt2
  gRNA
agaugggggucgcaucgugc

SEQ ID NO: 15728 - RNA, 20 nt, Artificial Sequence
  MKO10015728_A_Ehmt2
  gRNA
cgggccaaaaugucaaugac

SEQ ID NO: 15729 - RNA, 20 nt, Artificial Sequence
  MKO10015729_A_Ehmt2
  gRNA
gcggcaguuguugccggaga

SEQ ID NO: 15730 - RNA, 20 nt, Artificial Sequence
  MKO10015730_A_Ei24
  gRNA
ccgagcaucuagcuuugaga

SEQ ID NO: 15731 - RNA, 20 nt, Artificial Sequence
  MKO10015731_A_Ei24
  gRNA
ugcaccuacuuggaaccaaa

SEQ ID NO: 15732 - RNA, 20 nt, Artificial Sequence
  MKO10015732_A_Ei24
  gRNA
gagaggaacagcgucgaaga

SEQ ID NO: 15733 - RNA, 20 nt, Artificial Sequence
  MKO10015733_A_Eid1
  gRNA
uuccugcgaaccgcgcgagc

SEQ ID NO: 15734 - RNA, 20 nt, Artificial Sequence
  MKO10015734_A_Eid1
  gRNA
cuccggcucgcgcgguucgc

SEQ ID NO: 15735 - RNA, 20 nt, Artificial Sequence
  MKO10015735_A_Eid1
  gRNA
ccucggggaacagaccgcgc

SEQ ID NO: 15736 - RNA, 20 nt, Artificial Sequence
  MKO10015736_A_Eid2b
  gRNA
gcacgcccgcgccuucaugc

SEQ ID NO: 15737 - RNA, 20 nt, Artificial Sequence
  MKO10015737_A_Eid2b
  gRNA
ggccaccccucagucggcgu

SEQ ID NO: 15738 - RNA, 20 nt, Artificial Sequence
  MKO10015738_A_Eid2b
  gRNA
acgaaaucgaggagcgccgc

SEQ ID NO: 15739 - RNA, 20 nt, Artificial Sequence
  MKO10015739_A_Eid2
  gRNA
acgcagguacucuaugucga

SEQ ID NO: 15740 - RNA, 20 nt, Artificial Sequence
  MKO10015740_A_Eid2
  gRNA
ggguggcggaagcgcaugua

SEQ ID NO: 15741 - RNA, 20 nt, Artificial Sequence
  MKO10015741_A_Eid2
  gRNA
acuacccgaucgcccccggc

SEQ ID NO: 15742 - RNA, 20 nt, Artificial Sequence
  MKO10015742_A_Eid3
  gRNA
uuugccaucucgcgucgcua

SEQ ID NO: 15743 - RNA, 20 nt, Artificial Sequence
  MKO10015743_A_Eid3
  gRNA
ccaaccguagcgacgcgaga

SEQ ID NO: 15744 - RNA, 20 nt, Artificial Sequence
  MKO10015744_A_Eid3
  gRNA
aacguucugcacgaaagccc

SEQ ID NO: 15745 - RNA, 20 nt, Artificial Sequence
  MKO10015745_A_Eif1ad
  gRNA
auuguugacccuauugaaga

SEQ ID NO: 15746 - RNA, 20 nt, Artificial Sequence
  MKO10015746_A_Eif1ad
  gRNA
ccaaauaccgcaagaacauc

SEQ ID NO: 15747 - RNA, 20 nt, Artificial Sequence
  MKO10015747_A_Eif1ad
  gRNA
cagacaguaucaugagagug

SEQ ID NO: 15748 - RNA, 20 nt, Artificial Sequence
  MKO10015748_A_Eif1ax
  gRNA
ccccaccaauaugauaucug

SEQ ID NO: 15749 - RNA, 20 nt, Artificial Sequence
  MKO10015749_A_Eif1ax
  gRNA
uauggcgagcuuccagagca

SEQ ID NO: 15750 - RNA, 20 nt, Artificial Sequence
  MKO10015750_A_Eif1ax
  gRNA
aaauaccucagauaucauau

SEQ ID NO: 15751 - RNA, 20 nt, Artificial Sequence
  MKO10015751_A_Eif1a
  gRNA
caucuccaauaucaucaaau

SEQ ID NO: 15752 - RNA, 20 nt, Artificial Sequence
  MKO10015752_A_Eif1a
  gRNA
gaaauccaauuugaugauau

SEQ ID NO: 15753 - RNA, 20 nt, Artificial Sequence
  MKO10015753_A_Eif1a
  gRNA
uucucagcuucccucuuaua

SEQ ID NO: 15754 - RNA, 20 nt, Artificial Sequence
  MKO10015754_A_Eif1b
  gRNA
gcgacgacuuacucccggca

SEQ ID NO: 15755 - RNA, 20 nt, Artificial Sequence
  MKO10015755_A_Eif1b
  gRNA
ucuuccugccguugcgcugc

SEQ ID NO: 15756 - RNA, 20 nt, Artificial Sequence
  MKO10015756_A_Eif1b
  gRNA
ggcccuuaccgaaagauugg

SEQ ID NO: 15757 - RNA, 20 nt, Artificial Sequence
  MKO10015757_A_Eif1
  gRNA
aacucaccucuaucaggaac

SEQ ID NO: 15758 - RNA, 20 nt, Artificial Sequence
  MKO10015758_A_Eif1
  gRNA
caggcucaccgaaagagugg

SEQ ID NO: 15759 - RNA, 20 nt, Artificial Sequence
  MKO10015759_A_Eif1
  gRNA
uuugcagauugggcuggcua

SEQ ID NO: 15760 - RNA, 20 nt, Artificial Sequence
  MKO10015760_A_Eif2ak1
  gRNA
gcgugacguuugugcuucga

SEQ ID NO: 15761 - RNA, 20 nt, Artificial Sequence
  MKO10015761_A_Eif2ak1
  gRNA
uagguccggaacaaauuaga

SEQ ID NO: 15762 - RNA, 20 nt, Artificial Sequence
  MKO10015762_A_Eif2ak1
  gRNA
ugccaaagagagaguccguc

SEQ ID NO: 15763 - RNA, 20 nt, Artificial Sequence
  MKO10015763_A_Eif2ak2
  gRNA
acuugucauagacgagcugc

SEQ ID NO: 15764 - RNA, 20 nt, Artificial Sequence
  MKO10015764_A_Eif2ak2
  gRNA
uuguucguugguaacuacau

SEQ ID NO: 15765 - RNA, 20 nt, Artificial Sequence
  MKO10015765_A_Eif2ak2
  gRNA
gaagcuguuaaagagcccgc

SEQ ID NO: 15766 - RNA, 20 nt, Artificial Sequence
  MKO10015766_A_Eif2ak3
  gRNA
cacuucucacugccgcuucg

SEQ ID NO: 15767 - RNA, 20 nt, Artificial Sequence
  MKO10015767_A_Eif2ak3
  gRNA
cucgaaucuuccuacaaguu

SEQ ID NO: 15768 - RNA, 20 nt, Artificial Sequence
  MKO10015768_A_Eif2ak3
  gRNA
cauggaggccguccccuuca

SEQ ID NO: 15769 - RNA, 20 nt, Artificial Sequence
  MKO10015769_A_Eif2ak4
  gRNA
aaagcccggacauacuccuc

SEQ ID NO: 15770 - RNA, 20 nt, Artificial Sequence
  MKO10015770_A_Eif2ak4
  gRNA
cgcugagaaacgacugcaca

SEQ ID NO: 15771 - RNA, 20 nt, Artificial Sequence
  MKO10015771_A_Eif2ak4
  gRNA
cucucuuagaggcauagucc

SEQ ID NO: 15772 - RNA, 20 nt, Artificial Sequence
  MKO10015772_A_Eif2a
  gRNA
uauaaucaaugucgcuaaca

SEQ ID NO: 15773 - RNA, 20 nt, Artificial Sequence
  MKO10015773_A_Eif2a
  gRNA
uguaaggcugccacguugcc

SEQ ID NO: 15774 - RNA, 20 nt, Artificial Sequence
  MKO10015774_A_Eif2a
  gRNA
accgugcuuucugugaagug

SEQ ID NO: 15775 - RNA, 20 nt, Artificial Sequence
  MKO10015775_A_Eif2b1
  gRNA
gagcuccccgccagaugaca

SEQ ID NO: 15776 - RNA, 20 nt, Artificial Sequence
  MKO10015776_A_Eif2b1
  gRNA
auacacacugaaccguuucu

SEQ ID NO: 15777 - RNA, 20 nt, Artificial Sequence
  MKO10015777_A_Eif2b1
  gRNA
gauacuugcccagauaaauc

SEQ ID NO: 15778 - RNA, 20 nt, Artificial Sequence
  MKO10015778_A_Eif2b2
  gRNA
cgcacucugcaacaauaacg

SEQ ID NO: 15779 - RNA, 20 nt, Artificial Sequence
  MKO10015779_A_Eif2b2
  gRNA
ucuuccgggccgccucuuua

SEQ ID NO: 15780 - RNA, 20 nt, Artificial Sequence
  MKO10015780_A_Eif2b2
  gRNA
auuaaucgccucaaugaugu

SEQ ID NO: 15781 - RNA, 20 nt, Artificial Sequence
  MKO10015781_A_Eif2b3
  gRNA
cagagcuuaugaugcgucac

SEQ ID NO: 15782 - RNA, 20 nt, Artificial Sequence
  MKO10015782_A_Eif2b3
  gRNA
cauuugacagaccgaugugc

SEQ ID NO: 15783 - RNA, 20 nt, Artificial Sequence
  MKO10015783_A_Eif2b3
  gRNA
uucagcggguaccaaauuaa

SEQ ID NO: 15784 - RNA, 20 nt, Artificial Sequence
  MKO10015784_A_Eif2b4
  gRNA
uagaaagccagaucgacaac

SEQ ID NO: 15785 - RNA, 20 nt, Artificial Sequence
  MKO10015785_A_Eif2b4
  gRNA
cuuccuaccuguugucgauc

SEQ ID NO: 15786 - RNA, 20 nt, Artificial Sequence
  MKO10015786_A_Eif2b4
  gRNA
cgcgaaguucugccuuacuc

SEQ ID NO: 15787 - RNA, 20 nt, Artificial Sequence
  MKO10015787_A_Eif2b5
  gRNA
auagucaauuagcgcaacgu

SEQ ID NO: 15788 - RNA, 20 nt, Artificial Sequence
  MKO10015788_A_Eif2b5
  gRNA
ccuuggcaucgacgucacgg

SEQ ID NO: 15789 - RNA, 20 nt, Artificial Sequence
  MKO10015789_A_Eif2b5
  gRNA
ugugauuauccgaacaacgu

SEQ ID NO: 15790 - RNA, 20 nt, Artificial Sequence
  MKO10015790_A_Eif2d
  gRNA
ucggugacuguguacacgag

SEQ ID NO: 15791 - RNA, 20 nt, Artificial Sequence
  MKO10015791_A_Eif2d
  gRNA
aggucgccuugcuguacuug

SEQ ID NO: 15792 - RNA, 20 nt, Artificial Sequence
  MKO10015792_A_Eif2d
  gRNA
guagggggcaccacuacccc

SEQ ID NO: 15793 - RNA, 20 nt, Artificial Sequence
  MKO10015793_A_Eif2s1
  gRNA
gcaacuuaccuugaugggca

SEQ ID NO: 15794 - RNA, 20 nt, Artificial Sequence
  MKO10015794_A_Eif2s1
  gRNA
caagcggucaaaauucgagc

SEQ ID NO: 15795 - RNA, 20 nt, Artificial Sequence
  MKO10015795_A_Eif2s1
  gRNA
uacagaaaccaugcccauca

SEQ ID NO: 15796 - RNA, 20 nt, Artificial Sequence
  MKO10015796_A_Eif2s2
  gRNA
gaaauacuagaaaaagacga

SEQ ID NO: 15797 - RNA, 20 nt, Artificial Sequence
  MKO10015797_A_Eif2s2
  gRNA
gcccucagagacaaaagaag

SEQ ID NO: 15798 - RNA, 20 nt, Artificial Sequence
  MKO10015798_A_Eif2s2
  gRNA
accaacugaagaaaaagacg

SEQ ID NO: 15799 - RNA, 20 nt, Artificial Sequence
  MKO10015799_A_Eif2s3x
  gRNA
gcuuggauaugcuaaugcua

SEQ ID NO: 15800 - RNA, 20 nt, Artificial Sequence
  MKO10015800_A_Eif2s3x
  gRNA
gaugcggcccuucuguugau

SEQ ID NO: 15801 - RNA, 20 nt, Artificial Sequence
  MKO10015801_A_Eif2s3x
  gRNA
augacuuaccuaucaacaga

SEQ ID NO: 15802 - RNA, 20 nt, Artificial Sequence
  MKO10015802_A_Eif2s3y
  gRNA
acaauuggucauguugcuca

SEQ ID NO: 15803 - RNA, 20 nt, Artificial Sequence
  MKO10015803_A_Eif2s3y
  gRNA
gacuagucugaaguuuccuu

SEQ ID NO: 15804 - RNA, 20 nt, Artificial Sequence
  MKO10015804_A_Eif2s3y
  gRNA
gaugcagcucuucuguugau

SEQ ID NO: 15805 - RNA, 20 nt, Artificial Sequence
  MKO10015805_A_Eif3a
  gRNA
uaccuuguugggcgauauca

SEQ ID NO: 15806 - RNA, 20 nt, Artificial Sequence
  MKO10015806_A_Eif3a
  gRNA
uaccaugauaucgcccaaca

SEQ ID NO: 15807 - RNA, 20 nt, Artificial Sequence
  MKO10015807_A_Eif3a
  gRNA
guuggacagugcuaucagca

SEQ ID NO: 15808 - RNA, 20 nt, Artificial Sequence
  MKO10015808_A_Eif3b
  gRNA
ggaagcggacgggauugacu

SEQ ID NO: 15809 - RNA, 20 nt, Artificial Sequence
  MKO10015809_A_Eif3b
  gRNA
ucaaucccguccgcuuccug

SEQ ID NO: 15810 - RNA, 20 nt, Artificial Sequence
  MKO10015810_A_Eif3b
  gRNA
uuuagggcaauuugcguuac

SEQ ID NO: 15811 - RNA, 20 nt, Artificial Sequence
  MKO10015811_A_Eif3c
  gRNA
ccgauucuacauccgaauac

SEQ ID NO: 15812 - RNA, 20 nt, Artificial Sequence
  MKO10015812_A_Eif3c
  gRNA
gagaguuguccgaagcgcca

SEQ ID NO: 15813 - RNA, 20 nt, Artificial Sequence
  MKO10015813_A_Eif3c
  gRNA
uuuccggaucuucuggcgca

SEQ ID NO: 15814 - RNA, 20 nt, Artificial Sequence
  MKO10015814_A_Eif3d
  gRNA
cuaccugugcgaaucucauc

SEQ ID NO: 15815 - RNA, 20 nt, Artificial Sequence
  MKO10015815_A_Eif3d
  gRNA
acuucccccaccgaacugag

SEQ ID NO: 15816 - RNA, 20 nt, Artificial Sequence
  MKO10015816_A_Eif3d
  gRNA
gucccucacagguugcagac

SEQ ID NO: 15817 - RNA, 20 nt, Artificial Sequence
  MKO10015817_A_Eif3e
  gRNA
ucuucaaacaucuucacgau

SEQ ID NO: 15818 - RNA, 20 nt, Artificial Sequence
  MKO10015818_A_Eif3e
  gRNA
uauucugaugauaucccuca

SEQ ID NO: 15819 - RNA, 20 nt, Artificial Sequence
  MKO10015819_A_Eif3e
  gRNA
uuaccccauguuugucugcc

SEQ ID NO: 15820 - RNA, 20 nt, Artificial Sequence
  MKO10015820_A_Eif3f
  gRNA
uauuaugacacugaacgcau

SEQ ID NO: 15821 - RNA, 20 nt, Artificial Sequence
  MKO10015821_A_Eif3f
  gRNA
uacgcguacuucacugugag

SEQ ID NO: 15822 - RNA, 20 nt, Artificial Sequence
  MKO10015822_A_Eif3f
  gRNA
ugauccaugaguacuacagc

SEQ ID NO: 15823 - RNA, 20 nt, Artificial Sequence
  MKO10015823_A_Eif3g
  gRNA
cucuggacugguguccccgg

SEQ ID NO: 15824 - RNA, 20 nt, Artificial Sequence
  MKO10015824_A_Eif3g
  gRNA
cucaccuccgggcaguaacu

SEQ ID NO: 15825 - RNA, 20 nt, Artificial Sequence
  MKO10015825_A_Eif3g
  gRNA
ugagacccggaaggcaucaa

SEQ ID NO: 15826 - RNA, 20 nt, Artificial Sequence
  MKO10015826_A_Eif3h
  gRNA
gagucugucguccucauuua

SEQ ID NO: 15827 - RNA, 20 nt, Artificial Sequence
  MKO10015827_A_Eif3h
  gRNA
agcaguugguaaucucuagc

SEQ ID NO: 15828 - RNA, 20 nt, Artificial Sequence
  MKO10015828_A_Eif3h
  gRNA
aauugcucagucuugcuagc

SEQ ID NO: 15829 - RNA, 20 nt, Artificial Sequence
  MKO10015829_A_Eif3i
  gRNA
ucugcgugauggaccgcuca

SEQ ID NO: 15830 - RNA, 20 nt, Artificial Sequence
  MKO10015830_A_Eif3i
  gRNA
cagaucaaguauaaccgcga

SEQ ID NO: 15831 - RNA, 20 nt, Artificial Sequence
  MKO10015831_A_Eif3i
  gRNA
cuuuccagaucgucaacgug

SEQ ID NO: 15832 - RNA, 20 nt, Artificial Sequence
  MKO10015832_A_Eif3j1
  gRNA
agacgcggacacguucucua

SEQ ID NO: 15833 - RNA, 20 nt, Artificial Sequence
  MKO10015833_A_Eif3j1
  gRNA
ccucguccucgccuucccag

SEQ ID NO: 15834 - RNA, 20 nt, Artificial Sequence
  MKO10015834_A_Eif3j1
  gRNA
ugaugaugaugaaaauaaag

SEQ ID NO: 15835 - RNA, 20 nt, Artificial Sequence
  MKO10015835_A_Eif3j2
  gRNA
acgaggacgugaaggauaac

SEQ ID NO: 15836 - RNA, 20 nt, Artificial Sequence
  MKO10015836_A_Eif3j2
  gRNA
ggacucagacucuugggacg

SEQ ID NO: 15837 - RNA, 20 nt, Artificial Sequence
  MKO10015837_A_Eif3j2
  gRNA
ucgggaugucuguauuucau

SEQ ID NO: 15838 - RNA, 20 nt, Artificial Sequence
  MKO10015838_A_Eif3k
  gRNA
guguaaauguaugaucgacc

SEQ ID NO: 15839 - RNA, 20 nt, Artificial Sequence
  MKO10015839_A_Eif3k
  gRNA
auccggcagaucuuguaccu

SEQ ID NO: 15840 - RNA, 20 nt, Artificial Sequence
  MKO10015840_A_Eif3k
  gRNA
gugucuccacauaucgcucc

SEQ ID NO: 15841 - RNA, 20 nt, Artificial Sequence
  MKO10015841_A_Eif3l
  gRNA
uuaugaucccuacgccuacc

SEQ ID NO: 15842 - RNA, 20 nt, Artificial Sequence
  MKO10015842_A_Eif3l
  gRNA
gugugcauaucauagucgcc

SEQ ID NO: 15843 - RNA, 20 nt, Artificial Sequence
  MKO10015843_A_Eif3l
  gRNA
ucuccuaggagauccgaagc

SEQ ID NO: 15844 - RNA, 20 nt, Artificial Sequence
  MKO10015844_A_Eif3m
  gRNA
cgcucguggauuguaagaaa

SEQ ID NO: 15845 - RNA, 20 nt, Artificial Sequence
  MKO10015845_A_Eif3m
  gRNA
gcgccucguagagcagucug

SEQ ID NO: 15846 - RNA, 20 nt, Artificial Sequence
  MKO10015846_A_Eif3m
  gRNA
uacaacuguagucucagaga

SEQ ID NO: 15847 - RNA, 20 nt, Artificial Sequence
  MKO10015847_A_Eif4a1
  gRNA
cuuaccucgaugacgccuuc

SEQ ID NO: 15848 - RNA, 20 nt, Artificial Sequence
  MKO10015848_A_Eif4a1
  gRNA
gguacucacacagguaucuc

SEQ ID NO: 15849 - RNA, 20 nt, Artificial Sequence
  MKO10015849_A_Eif4a1
  gRNA
caagucuuacccuugauaca

SEQ ID NO: 15850 - RNA, 20 nt, Artificial Sequence
  MKO10015850_A_Eif4a2
  gRNA
gagagauccaauucgaauuc

SEQ ID NO: 15851 - RNA, 20 nt, Artificial Sequence
  MKO10015851_A_Eif4a2
  gRNA
gaagccccucacauuguugu

SEQ ID NO: 15852 - RNA, 20 nt, Artificial Sequence
  MKO10015852_A_Eif4a2
  gRNA
uucuucaccagaauucgaau

SEQ ID NO: 15853 - RNA, 20 nt, Artificial Sequence
  MKO10015853_A_Eif4a3
  gRNA
ggcacgccgggacgcgucuu

SEQ ID NO: 15854 - RNA, 20 nt, Artificial Sequence
  MKO10015854_A_Eif4a3
  gRNA
cacucaccaaagacgcgucc

SEQ ID NO: 15855 - RNA, 20 nt, Artificial Sequence
  MKO10015855_A_Eif4a3
  gRNA
aaucugcaccgcuaacuccc

SEQ ID NO: 15856 - RNA, 20 nt, Artificial Sequence
  MKO10015856_A_Eif4b
  gRNA
guaacgaugaugacguguac

SEQ ID NO: 15857 - RNA, 20 nt, Artificial Sequence
  MKO10015857_A_Eif4b
  gRNA
ccuaacggacuuucuagcug

SEQ ID NO: 15858 - RNA, 20 nt, Artificial Sequence
  MKO10015858_A_Eif4b
  gRNA
cuguccuagugucaacaacu

SEQ ID NO: 15859 - RNA, 20 nt, Artificial Sequence
  MKO10015859_A_Eif4e1b
  gRNA
cugugacuaugcccuguuca

SEQ ID NO: 15860 - RNA, 20 nt, Artificial Sequence
  MKO10015860_A_Eif4e1b
  gRNA
gccuccucaccuguacugca

SEQ ID NO: 15861 - RNA, 20 nt, Artificial Sequence
  MKO10015861_A_Eif4e1b
  gRNA
uguagcuugcucaggaccuc

SEQ ID NO: 15862 - RNA, 20 nt, Artificial Sequence
  MKO10015862_A_Eif4e2
  gRNA
gguucuccucgaguaccaaa

SEQ ID NO: 15863 - RNA, 20 nt, Artificial Sequence
  MKO10015863_A_Eif4e2
  gRNA
gcaaguggaucauucgacuc

SEQ ID NO: 15864 - RNA, 20 nt, Artificial Sequence
  MKO10015864_A_Eif4e2
  gRNA
ugcaguacaacuacaccuuu

SEQ ID NO: 15865 - RNA, 20 nt, Artificial Sequence
  MKO10015865_A_Eif4e3
  gRNA
gaauuguuguuagcgaccau

SEQ ID NO: 15866 - RNA, 20 nt, Artificial Sequence
  MKO10015866_A_Eif4e3
  gRNA
ccuacguuuaguccacaguu

SEQ ID NO: 15867 - RNA, 20 nt, Artificial Sequence
  MKO10015867_A_Eif4e3
  gRNA
gagaccuaccgugcuguccu

SEQ ID NO: 15868 - RNA, 20 nt, Artificial Sequence
  MKO10015868_A_Eif4ebp1
  gRNA
cccacucgccgcguagcccu

SEQ ID NO: 15869 - RNA, 20 nt, Artificial Sequence
  MKO10015869_A_Eif4ebp1
  gRNA
gacuacagcaccacuccggg

SEQ ID NO: 15870 - RNA, 20 nt, Artificial Sequence
  MKO10015870_A_Eif4ebp1
  gRNA
gacacuccaucagaaauuuc

SEQ ID NO: 15871 - RNA, 20 nt, Artificial Sequence
  MKO10015871_A_Eif4ebp2
  gRNA
cgucggagccauguccgcgu

SEQ ID NO: 15872 - RNA, 20 nt, Artificial Sequence
  MKO10015872_A_Eif4ebp2
  gRNA
acuacugcaccacgcccggg

SEQ ID NO: 15873 - RNA, 20 nt, Artificial Sequence
  MKO10015873_A_Eif4ebp2
  gRNA
caagguggggucugcgccau

SEQ ID NO: 15874 - RNA, 20 nt, Artificial Sequence
  MKO10015874_A_Eif4ebp3
  gRNA
cacacuauacgccacuaccc

SEQ ID NO: 15875 - RNA, 20 nt, Artificial Sequence
  MKO10015875_A_Eif4ebp3
  gRNA
uccacgaguugcccaauucc

SEQ ID NO: 15876 - RNA, 20 nt, Artificial Sequence
  MKO10015876_A_Eif4ebp3
  gRNA
cuacgacagaaaguuccugc

SEQ ID NO: 15877 - RNA, 20 nt, Artificial Sequence
  MKO10015877_A_Eif4enif1
  gRNA
aacuuacuuucguauagcga

SEQ ID NO: 15878 - RNA, 20 nt, Artificial Sequence
  MKO10015878_A_Eif4enif1
  gRNA
agaauccgaucgaccuucuc

SEQ ID NO: 15879 - RNA, 20 nt, Artificial Sequence
  MKO10015879_A_Eif4enif1
  gRNA
acuacaaggacaaacguuuc

SEQ ID NO: 15880 - RNA, 20 nt, Artificial Sequence
  MKO10015880_A_Eif4e
  gRNA
aaagcuuaccuguucuguag

SEQ ID NO: 15881 - RNA, 20 nt, Artificial Sequence
  MKO10015881_A_Eif4e
  gRNA
aggacgggauugagccuaug

SEQ ID NO: 15882 - RNA, 20 nt, Artificial Sequence
  MKO10015882_A_Eif4e
  gRNA
ucucuagccagaagcgaucg

SEQ ID NO: 15883 - RNA, 20 nt, Artificial Sequence
  MKO10015883_A_Eif4g1
  gRNA
ggugcaagcccuaccgaguu

SEQ ID NO: 15884 - RNA, 20 nt, Artificial Sequence
  MKO10015884_A_Eif4g1
  gRNA
aauagcacuucuacccuagc

SEQ ID NO: 15885 - RNA, 20 nt, Artificial Sequence
  MKO10015885_A_Eif4g1
  gRNA
agccuacuauaucccuggac

SEQ ID NO: 15886 - RNA, 20 nt, Artificial Sequence
  MKO10015886_A_Eif4g2
  gRNA
ucucgucuagugcuucgugc

SEQ ID NO: 15887 - RNA, 20 nt, Artificial Sequence
  MKO10015887_A_Eif4g2
  gRNA
uauuaaacuagcgaguuccu

SEQ ID NO: 15888 - RNA, 20 nt, Artificial Sequence
  MKO10015888_A_Eif4g2
  gRNA
guggagagugcgauugcaga

SEQ ID NO: 15889 - RNA, 20 nt, Artificial Sequence
  MKO10015889_A_Eif4g3
  gRNA
gacccccaccgccguguauc

SEQ ID NO: 15890 - RNA, 20 nt, Artificial Sequence
  MKO10015890_A_Eif4g3
  gRNA
uaagcauuagcgaagucccc

SEQ ID NO: 15891 - RNA, 20 nt, Artificial Sequence
  MKO10015891_A_Eif4g3
  gRNA
caguauccaguucagccgcc

SEQ ID NO: 15892 - RNA, 20 nt, Artificial Sequence
  MKO10015892_A_Eif4h
  gRNA
auuuccuacguaagcugugu

SEQ ID NO: 15893 - RNA, 20 nt, Artificial Sequence
  MKO10015893_A_Eif4h
  gRNA
aucucagcauacggagugug

SEQ ID NO: 15894 - RNA, 20 nt, Artificial Sequence
  MKO10015894_A_Eif4h
  gRNA
caauguccacacgaagugac

SEQ ID NO: 15895 - RNA, 20 nt, Artificial Sequence
  MKO10015895_A_Eif5a2
  gRNA
agggcgaccaugcaaaaucg

SEQ ID NO: 15896 - RNA, 20 nt, Artificial Sequence
  MKO10015896_A_Eif5a2
  gRNA
gacgaaauugauuucacuac

SEQ ID NO: 15897 - RNA, 20 nt, Artificial Sequence
  MKO10015897_A_Eif5a2
  gRNA
cucugucagguacaccuugu

SEQ ID NO: 15898 - RNA, 20 nt, Artificial Sequence
  MKO10015898_A_Eif5a
  gRNA
gaagucauuccguuugaugu

SEQ ID NO: 15899 - RNA, 20 nt, Artificial Sequence
  MKO10015899_A_Eif5a
  gRNA
caucaaacggaaugacuucc

SEQ ID NO: 15900 - RNA, 20 nt, Artificial Sequence
  MKO10015900_A_Eif5a
  gRNA
ugcucagcauuacguaagaa

SEQ ID NO: 15901 - RNA, 20 nt, Artificial Sequence
  MKO10015901_A_Eif5b
  gRNA
uccguuccuaccguagacag

SEQ ID NO: 15902 - RNA, 20 nt, Artificial Sequence
  MKO10015902_A_Eif5b
  gRNA
agaaaggauuaagcggcuug

SEQ ID NO: 15903 - RNA, 20 nt, Artificial Sequence
  MKO10015903_A_Eif5b
  gRNA
cguucgagaguaaacuccuc

SEQ ID NO: 15904 - RNA, 20 nt, Artificial Sequence
  MKO10015904_A_Eif5
  gRNA
gcacucaccagaucuguuuc

SEQ ID NO: 15905 - RNA, 20 nt, Artificial Sequence
  MKO10015905_A_Eif5
  gRNA
acguugcaaaggcgcuuaau

SEQ ID NO: 15906 - RNA, 20 nt, Artificial Sequence
  MKO10015906_A_Eif5
  gRNA
aaugaccguuacauugucaa

SEQ ID NO: 15907 - RNA, 20 nt, Artificial Sequence
  MKO10015907_A_Eif6
  gRNA
gcucuccgaugccauucccg

SEQ ID NO: 15908 - RNA, 20 nt, Artificial Sequence
  MKO10015908_A_Eif6
  gRNA
ggcgauggaugcgugcacca

SEQ ID NO: 15909 - RNA, 20 nt, Artificial Sequence
  MKO10015909_A_Eif6
  gRNA
ggccaaguuaccugucaaug

SEQ ID NO: 15910 - RNA, 20 nt, Artificial Sequence
  MKO10015910_A_Elac1
  gRNA
gcauauccaucaccgacccg

SEQ ID NO: 15911 - RNA, 20 nt, Artificial Sequence
  MKO10015911_A_Elac1
  gRNA
ugcggugguucuucggugcg

SEQ ID NO: 15912 - RNA, 20 nt, Artificial Sequence
  MKO10015912_A_Elac1
  gRNA
ccaaccgccuuggcgagaga

SEQ ID NO: 15913 - RNA, 20 nt, Artificial Sequence
  MKO10015913_A_Elac2
  gRNA
aggcguccaacgacuuaugc

SEQ ID NO: 15914 - RNA, 20 nt, Artificial Sequence
  MKO10015914_A_Elac2
  gRNA
uagacugaaagucgcucgcu

SEQ ID NO: 15915 - RNA, 20 nt, Artificial Sequence
  MKO10015915_A_Elac2
  gRNA
ucuuucugacucggaugcau

SEQ ID NO: 15916 - RNA, 20 nt, Artificial Sequence
  MKO10015916_A_Elane
  gRNA
ucgugugaacguaugcacuc

SEQ ID NO: 15917 - RNA, 20 nt, Artificial Sequence
  MKO10015917_A_Elane
  gRNA
gagugcgcuccugucgccgc

SEQ ID NO: 15918 - RNA, 20 nt, Artificial Sequence
  MKO10015918_A_Elane
  gRNA
uaccauuaacgccaacgugc

SEQ ID NO: 15919 - RNA, 20 nt, Artificial Sequence
  MKO10015919_A_Elavl1
  gRNA
gggccuccaaaccgccuagc

SEQ ID NO: 15920 - RNA, 20 nt, Artificial Sequence
  MKO10015920_A_Elavl1
  gRNA
ccucaucggcgucuugccca

SEQ ID NO: 15921 - RNA, 20 nt, Artificial Sequence
  MKO10015921_A_Elavl1
  gRNA
uugggcgaaucaucaacucc

SEQ ID NO: 15922 - RNA, 20 nt, Artificial Sequence
  MKO10015922_A_Elavl2
  gRNA
gguuuauucgauuugacaag

SEQ ID NO: 15923 - RNA, 20 nt, Artificial Sequence
  MKO10015923_A_Elavl2
  gRNA
gaugcaaacuuauacgucag

SEQ ID NO: 15924 - RNA, 20 nt, Artificial Sequence
  MKO10015924_A_Elavl2
  gRNA
uucucggauucuugucgacc

SEQ ID NO: 15925 - RNA, 20 nt, Artificial Sequence
  MKO10015925_A_Elavl3
  gRNA
aagugaugauucggccguac

SEQ ID NO: 15926 - RNA, 20 nt, Artificial Sequence
  MKO10015926_A_Elavl3
  gRNA
guuugcgaacuugaccguga

SEQ ID NO: 15927 - RNA, 20 nt, Artificial Sequence
  MKO10015927_A_Elavl3
  gRNA
aagagucucuucggcagcau

SEQ ID NO: 15928 - RNA, 20 nt, Artificial Sequence
  MKO10015928_A_Elavl4
  gRNA
guccuacgcccgcccaagcu

SEQ ID NO: 15929 - RNA, 20 nt, Artificial Sequence
  MKO10015929_A_Elavl4
  gRNA
agcuguaccagucccccaac

SEQ ID NO: 15930 - RNA, 20 nt, Artificial Sequence
  MKO10015930_A_Elavl4
  gRNA
ucccugaucgaggccgagcu

SEQ ID NO: 15931 - RNA, 20 nt, Artificial Sequence
  MKO10015931_A_Elf1
  gRNA
gaugacgacaucacccuuac

SEQ ID NO: 15932 - RNA, 20 nt, Artificial Sequence
  MKO10015932_A_Elf1
  gRNA
gucgucggggaaucuggccg

SEQ ID NO: 15933 - RNA, 20 nt, Artificial Sequence
  MKO10015933_A_Elf1
  gRNA
uucuuucucuugcgcugcuc

SEQ ID NO: 15934 - RNA, 20 nt, Artificial Sequence
  MKO10015934_A_Elf2
  gRNA
cgacgagacuuauaugaugc

SEQ ID NO: 15935 - RNA, 20 nt, Artificial Sequence
  MKO10015935_A_Elf2
  gRNA
cgucgucauagaccagcacc

SEQ ID NO: 15936 - RNA, 20 nt, Artificial Sequence
  MKO10015936_A_Elf2
  gRNA
uugagggauucaagaagucc

SEQ ID NO: 15937 - RNA, 20 nt, Artificial Sequence
  MKO10015937_A_Elf3
  gRNA
cgacuucucccgcugcgaca

SEQ ID NO: 15938 - RNA, 20 nt, Artificial Sequence
  MKO10015938_A_Elf3
  gRNA
cuagcgagcggccccaguuc

SEQ ID NO: 15939 - RNA, 20 nt, Artificial Sequence
  MKO10015939_A_Elf3
  gRNA
caaaggggcccgagucgccu

SEQ ID NO: 15940 - RNA, 20 nt, Artificial Sequence
  MKO10015940_A_Elf4
  gRNA
gaucuggaugagguccacaa

SEQ ID NO: 15941 - RNA, 20 nt, Artificial Sequence
  MKO10015941_A_Elf4
  gRNA
ggggaccuguuccacgauca

SEQ ID NO: 15942 - RNA, 20 nt, Artificial Sequence
  MKO10015942_A_Elf4
  gRNA
aguggaugacacguuauuug

SEQ ID NO: 15943 - RNA, 20 nt, Artificial Sequence
  MKO10015943_A_Elf5
  gRNA
cuccagaacauucgcucgca

SEQ ID NO: 15944 - RNA, 20 nt, Artificial Sequence
  MKO10015944_A_Elf5
  gRNA
gaccuugcgagcgaauguuc

SEQ ID NO: 15945 - RNA, 20 nt, Artificial Sequence
  MKO10015945_A_Elf5
  gRNA
uccaguugcuugaaaacaag

SEQ ID NO: 15946 - RNA, 20 nt, Artificial Sequence
  MKO10015946_A_Elfn1
  gRNA
accauacuuaagcucgauga

SEQ ID NO: 15947 - RNA, 20 nt, Artificial Sequence
  MKO10015947_A_Elfn1
  gRNA
agugccgaugcucgccguac

SEQ ID NO: 15948 - RNA, 20 nt, Artificial Sequence
  MKO10015948_A_Elfn1
  gRNA
gagaucuauguugacgaugu

SEQ ID NO: 15949 - RNA, 20 nt, Artificial Sequence
  MKO10015949_A_Elfn2
  gRNA
cauugagccguugcggcacu

SEQ ID NO: 15950 - RNA, 20 nt, Artificial Sequence
  MKO10015950_A_Elfn2
  gRNA
cuuacggcucacugcggcgu

SEQ ID NO: 15951 - RNA, 20 nt, Artificial Sequence
  MKO10015951_A_Elfn2
  gRNA
cuugcaugcgccgcuuccgc

SEQ ID NO: 15952 - RNA, 20 nt, Artificial Sequence
  MKO10015952_A_Elk1
  gRNA
ccgagcgcauguauucauuc

SEQ ID NO: 15953 - RNA, 20 nt, Artificial Sequence
  MKO10015953_A_Elk1
  gRNA
uguaaccucggccauagcca

SEQ ID NO: 15954 - RNA, 20 nt, Artificial Sequence
  MKO10015954_A_Elk1
  gRNA
agcagggauggcguuagcgc

SEQ ID NO: 15955 - RNA, 20 nt, Artificial Sequence
  MKO10015955_A_Elk3
  gRNA
ccgaguggagguacucguug

SEQ ID NO: 15956 - RNA, 20 nt, Artificial Sequence
  MKO10015956_A_Elk3
  gRNA
cggcugaucucuaccgcgug

SEQ ID NO: 15957 - RNA, 20 nt, Artificial Sequence
  MKO10015957_A_Elk3
  gRNA
gccggugccgcuccccaguc

SEQ ID NO: 15958 - RNA, 20 nt, Artificial Sequence
  MKO10015958_A_Elk4
  gRNA
ccuuuacguaguaguaucgc

SEQ ID NO: 15959 - RNA, 20 nt, Artificial Sequence
  MKO10015959_A_Elk4
  gRNA
ccugcgauacuacuacguaa

SEQ ID NO: 15960 - RNA, 20 nt, Artificial Sequence
  MKO10015960_A_Elk4
  gRNA
uauguagucauugcgacuag

SEQ ID NO: 15961 - RNA, 20 nt, Artificial Sequence
  MKO10015961_A_Ell2
  gRNA
ugcagucgagcaagcagcuc

SEQ ID NO: 15962 - RNA, 20 nt, Artificial Sequence
  MKO10015962_A_Ell2
  gRNA
ucuuucucgcgucaucugau

SEQ ID NO: 15963 - RNA, 20 nt, Artificial Sequence
  MKO10015963_A_Ell2
  gRNA
cuugcucgacugcagaaaga

SEQ ID NO: 15964 - RNA, 20 nt, Artificial Sequence
  MKO10015964_A_Ell3
  gRNA
uuguguaccaacgcuuaggc

SEQ ID NO: 15965 - RNA, 20 nt, Artificial Sequence
  MKO10015965_A_Ell3
  gRNA
agccaccauuagugcccucu

SEQ ID NO: 15966 - RNA, 20 nt, Artificial Sequence
  MKO10015966_A_Ell3
  gRNA
cacuuaccccucgguggccu

SEQ ID NO: 15967 - RNA, 20 nt, Artificial Sequence
  MKO10015967_A_Ell
  gRNA
ugucgcggccaauauuggag

SEQ ID NO: 15968 - RNA, 20 nt, Artificial Sequence
  MKO10015968_A_Ell
  gRNA
ggagguguagcacccgaucu

SEQ ID NO: 15969 - RNA, 20 nt, Artificial Sequence
  MKO10015969_A_Ell
  gRNA
ccgaagugccaucgucauua

SEQ ID NO: 15970 - RNA, 20 nt, Artificial Sequence
  MKO10015970_A_Elmo1
  gRNA
cuggagaugugguuaaucga

SEQ ID NO: 15971 - RNA, 20 nt, Artificial Sequence
  MKO10015971_A_Elmo1
  gRNA
ccgggauguuaccuuugcuc

SEQ ID NO: 15972 - RNA, 20 nt, Artificial Sequence
  MKO10015972_A_Elmo1
  gRNA
ccugagcaaagguaacaucc

SEQ ID NO: 15973 - RNA, 20 nt, Artificial Sequence
  MKO10015973_A_Elmo2
  gRNA
uagcggaggguguaguacuc

SEQ ID NO: 15974 - RNA, 20 nt, Artificial Sequence
  MKO10015974_A_Elmo2
  gRNA
aucaucaaggaggugugcga

SEQ ID NO: 15975 - RNA, 20 nt, Artificial Sequence
  MKO10015975_A_Elmo2
  gRNA
ucucuuucagaaacggccgc

SEQ ID NO: 15976 - RNA, 20 nt, Artificial Sequence
  MKO10015976_A_Elmo3
  gRNA
cauagugcuccggaugaguc

SEQ ID NO: 15977 - RNA, 20 nt, Artificial Sequence
  MKO10015977_A_Elmo3
  gRNA
cugcagaauacaagucguga

SEQ ID NO: 15978 - RNA, 20 nt, Artificial Sequence
  MKO10015978_A_Elmo3
  gRNA
aaccgcuuggagaucaagaa

SEQ ID NO: 15979 - RNA, 20 nt, Artificial Sequence
  MKO10015979_A_Elmod1
  gRNA
auuugcuacggcaccaaacc

SEQ ID NO: 15980 - RNA, 20 nt, Artificial Sequence
  MKO10015980_A_Elmod1
  gRNA
ccggaaggugugaacugcaa

SEQ ID NO: 15981 - RNA, 20 nt, Artificial Sequence
  MKO10015981_A_Elmod1
  gRNA
uucuguaacccacgauuugc

SEQ ID NO: 15982 - RNA, 20 nt, Artificial Sequence
  MKO10015982_A_Elmod2
  gRNA
guguauagcgaacaucauga

SEQ ID NO: 15983 - RNA, 20 nt, Artificial Sequence
  MKO10015983_A_Elmod2
  gRNA
gaugccaacgaaaaaguuga

SEQ ID NO: 15984 - RNA, 20 nt, Artificial Sequence
  MKO10015984_A_Elmod2
  gRNA
acgugcuuacugcagauaac

SEQ ID NO: 15985 - RNA, 20 nt, Artificial Sequence
  MKO10015985_A_Elmod3
  gRNA
aucuccgagcugacgaacca

SEQ ID NO: 15986 - RNA, 20 nt, Artificial Sequence
  MKO10015986_A_Elmod3
  gRNA
accaccuggcugccacccau

SEQ ID NO: 15987 - RNA, 20 nt, Artificial Sequence
  MKO10015987_A_Elmod3
  gRNA
ccagcucaucuccuucaacg

SEQ ID NO: 15988 - RNA, 20 nt, Artificial Sequence
  MKO10015988_A_Elmsan1
  gRNA
cgucagucaucgugacccgc

SEQ ID NO: 15989 - RNA, 20 nt, Artificial Sequence
  MKO10015989_A_Elmsan1
  gRNA
cccugcagacgaaucaacgu

SEQ ID NO: 15990 - RNA, 20 nt, Artificial Sequence
  MKO10015990_A_Elmsan1
  gRNA
gaacucggguggaccgccug

SEQ ID NO: 15991 - RNA, 20 nt, Artificial Sequence
  MKO10015991_A_Eln
  gRNA
acuccaccaggaaguccgcc

SEQ ID NO: 15992 - RNA, 20 nt, Artificial Sequence
  MKO10015992_A_Eln
  gRNA
accuggauaauagacuccac

SEQ ID NO: 15993 - RNA, 20 nt, Artificial Sequence
  MKO10015993_A_Eln
  gRNA
uccuccaggugccggacuuc

SEQ ID NO: 15994 - RNA, 20 nt, Artificial Sequence
  MKO10015994_A_Elof1
  gRNA
agggaccgugcucgaaacac

SEQ ID NO: 15995 - RNA, 20 nt, Artificial Sequence
  MKO10015995_A_Elof1
  gRNA
ugggacgaagaaaguccaaa

SEQ ID NO: 15996 - RNA, 20 nt, Artificial Sequence
  MKO10015996_A_Elof1
  gRNA
ugacuccaguguuucgagca

SEQ ID NO: 15997 - RNA, 20 nt, Artificial Sequence
  MKO10015997_A_Elovl1
  gRNA
gucuauggggucacagcgcc

SEQ ID NO: 15998 - RNA, 20 nt, Artificial Sequence
  MKO10015998_A_Elovl1
  gRNA
cuucucacagaugguucgag

SEQ ID NO: 15999 - RNA, 20 nt, Artificial Sequence
  MKO10015999_A_Elovl1
  gRNA
cuacuuacccgaagugcuuc

SEQ ID NO: 16000 - RNA, 20 nt, Artificial Sequence
  MKO10016000_A_Elovl2
  gRNA
uuuacagauucucgaguucg

SEQ ID NO: 16001 - RNA, 20 nt, Artificial Sequence
  MKO10016001_A_Elovl2
  gRNA
ucacguaccugcucucgaua

SEQ ID NO: 16002 - RNA, 20 nt, Artificial Sequence
  MKO10016002_A_Elovl2
  gRNA
acgcguccauguucaacauc

SEQ ID NO: 16003 - RNA, 20 nt, Artificial Sequence
  MKO10016003_A_Elovl3
  gRNA
uacggcgucauccguguaga

SEQ ID NO: 16004 - RNA, 20 nt, Artificial Sequence
  MKO10016004_A_Elovl3
  gRNA
cuaugacuucgagacguuuc

SEQ ID NO: 16005 - RNA, 20 nt, Artificial Sequence
  MKO10016005_A_Elovl3
  gRNA
agaaguguuccguuguugug

SEQ ID NO: 16006 - RNA, 20 nt, Artificial Sequence
  MKO10016006_A_Elovl4
  gRNA
agcgugcuuaugcuuaucgu

SEQ ID NO: 16007 - RNA, 20 nt, Artificial Sequence
  MKO10016007_A_Elovl4
  gRNA
uucaugggaucauacaacgc

SEQ ID NO: 16008 - RNA, 20 nt, Artificial Sequence
  MKO10016008_A_Elovl4
  gRNA
aucgaaaggcguugaguauu

SEQ ID NO: 16009 - RNA, 20 nt, Artificial Sequence
  MKO10016009_A_Elovl5
  gRNA
cgcgggagaauccgauauga

SEQ ID NO: 16010 - RNA, 20 nt, Artificial Sequence
  MKO10016010_A_Elovl5
  gRNA
cguccaugcgucccuaccuc

SEQ ID NO: 16011 - RNA, 20 nt, Artificial Sequence
  MKO10016011_A_Elovl5
  gRNA
gaccauaguacgaguacaug

SEQ ID NO: 16012 - RNA, 20 nt, Artificial Sequence
  MKO10016012_A_Elovl6
  gRNA
uguacucuuacuacgccuug

SEQ ID NO: 16013 - RNA, 20 nt, Artificial Sequence
  MKO10016013_A_Elovl6
  gRNA
cgcugacucuugccgucuuc

SEQ ID NO: 16014 - RNA, 20 nt, Artificial Sequence
  MKO10016014_A_Elovl6
  gRNA
cugacacuacucagccuucg

SEQ ID NO: 16015 - RNA, 20 nt, Artificial Sequence
  MKO10016015_A_Elovl7
  gRNA
uccacggcaugaucguauga

SEQ ID NO: 16016 - RNA, 20 nt, Artificial Sequence
  MKO10016016_A_Elovl7
  gRNA
uccaucauacgaucaugccg

SEQ ID NO: 16017 - RNA, 20 nt, Artificial Sequence
  MKO10016017_A_Elovl7
  gRNA
gucuaacagcucgaugaauu

SEQ ID NO: 16018 - RNA, 20 nt, Artificial Sequence
  MKO10016018_A_Elp2
  gRNA
ggacacuuaccauuaguacc

SEQ ID NO: 16019 - RNA, 20 nt, Artificial Sequence
  MKO10016019_A_Elp2
  gRNA
agcgguguggccauucagau

SEQ ID NO: 16020 - RNA, 20 nt, Artificial Sequence
  MKO10016020_A_Elp2
  gRNA
cagauucuacugugcgaauc

SEQ ID NO: 16021 - RNA, 20 nt, Artificial Sequence
  MKO10016021_A_Elp3
  gRNA
cugcagcgaugauauccacc

SEQ ID NO: 16022 - RNA, 20 nt, Artificial Sequence
  MKO10016022_A_Elp3
  gRNA
aucaagaucuuucgauagug

SEQ ID NO: 16023 - RNA, 20 nt, Artificial Sequence
  MKO10016023_A_Elp3
  gRNA
gaauacucaaaaucggaguc

SEQ ID NO: 16024 - RNA, 20 nt, Artificial Sequence
  MKO10016024_A_Elp4
  gRNA
ccggucucgucgucacgauu

SEQ ID NO: 16025 - RNA, 20 nt, Artificial Sequence
  MKO10016025_A_Elp4
  gRNA
ccaaaucgugacgacgagac

SEQ ID NO: 16026 - RNA, 20 nt, Artificial Sequence
  MKO10016026_A_Elp4
  gRNA
guaccaguuacaacccaaga

SEQ ID NO: 16027 - RNA, 20 nt, Artificial Sequence
  MKO10016027_A_Elp5
  gRNA
agcgaagaagaguuucgcga

SEQ ID NO: 16028 - RNA, 20 nt, Artificial Sequence
  MKO10016028_A_Elp5
  gRNA
ccaacaacgugcaacuuacc

SEQ ID NO: 16029 - RNA, 20 nt, Artificial Sequence
  MKO10016029_A_Elp5
  gRNA
ccugguaaguugcacguugu

SEQ ID NO: 16030 - RNA, 20 nt, Artificial Sequence
  MKO10016030_A_Elp6
  gRNA
gucacuguauacguuuauuc

SEQ ID NO: 16031 - RNA, 20 nt, Artificial Sequence
  MKO10016031_A_Elp6
  gRNA
uaaacguauacagugacugc

SEQ ID NO: 16032 - RNA, 20 nt, Artificial Sequence
  MKO10016032_A_Elp6
  gRNA
caucugucuuagcgucacag

SEQ ID NO: 16033 - RNA, 20 nt, Artificial Sequence
  MKO10016033_A_Eltd1
  gRNA
aauggcgucacgauuuguga

SEQ ID NO: 16034 - RNA, 20 nt, Artificial Sequence
  MKO10016034_A_Eltd1
  gRNA
accauugugcacuucgcacu

SEQ ID NO: 16035 - RNA, 20 nt, Artificial Sequence
  MKO10016035_A_Eltd1
  gRNA
auuaauguuugcagcgaugc

SEQ ID NO: 16036 - RNA, 20 nt, Artificial Sequence
  MKO10016036_A_Emb
  gRNA
aaagucguugaucgcuuacg

SEQ ID NO: 16037 - RNA, 20 nt, Artificial Sequence
  MKO10016037_A_Emb
  gRNA
auacugaccguggauguuaa

SEQ ID NO: 16038 - RNA, 20 nt, Artificial Sequence
  MKO10016038_A_Emb
  gRNA
cauggguaaugaaaccgcac

SEQ ID NO: 16039 - RNA, 20 nt, Artificial Sequence
  MKO10016039_A_Emc10
  gRNA
gugacuuaccgcugggacga

SEQ ID NO: 16040 - RNA, 20 nt, Artificial Sequence
  MKO10016040_A_Emc10
  gRNA
ccgaaaggugcgacuccacc

SEQ ID NO: 16041 - RNA, 20 nt, Artificial Sequence
  MKO10016041_A_Emc10
  gRNA
ucgggacccggacccuguag

SEQ ID NO: 16042 - RNA, 20 nt, Artificial Sequence
  MKO10016042_A_Emc1
  gRNA
ucuucguagaccgcggccgc

SEQ ID NO: 16043 - RNA, 20 nt, Artificial Sequence
  MKO10016043_A_Emc1
  gRNA
ggcuucaaucauggcggucg

SEQ ID NO: 16044 - RNA, 20 nt, Artificial Sequence
  MKO10016044_A_Emc1
  gRNA
agggcgccucaugcguuccu

SEQ ID NO: 16045 - RNA, 20 nt, Artificial Sequence
  MKO10016045_A_Emc2
  gRNA
agucaucccgaccauagucu

SEQ ID NO: 16046 - RNA, 20 nt, Artificial Sequence
  MKO10016046_A_Emc2
  gRNA
gacaaacuuacaguguuagu

SEQ ID NO: 16047 - RNA, 20 nt, Artificial Sequence
  MKO10016047_A_Emc2
  gRNA
augauugcagcccuagacua

SEQ ID NO: 16048 - RNA, 20 nt, Artificial Sequence
  MKO10016048_A_Emc3
  gRNA
cauccgccgauaagaaucau

SEQ ID NO: 16049 - RNA, 20 nt, Artificial Sequence
  MKO10016049_A_Emc3
  gRNA
ugcucacacuagacgcaucc

SEQ ID NO: 16050 - RNA, 20 nt, Artificial Sequence
  MKO10016050_A_Emc3
  gRNA
guccucccaaugauucuuau

SEQ ID NO: 16051 - RNA, 20 nt, Artificial Sequence
  MKO10016051_A_Emc4
  gRNA
ccggucggucucuugcacgc

SEQ ID NO: 16052 - RNA, 20 nt, Artificial Sequence
  MKO10016052_A_Emc4
  gRNA
ccagcgugcaagagaccgac

SEQ ID NO: 16053 - RNA, 20 nt, Artificial Sequence
  MKO10016053_A_Emc4
  gRNA
gcgacccauucaagcacuua

SEQ ID NO: 16054 - RNA, 20 nt, Artificial Sequence
  MKO10016054_A_Emc6
  gRNA
agccgugcgaggcaacgccg

SEQ ID NO: 16055 - RNA, 20 nt, Artificial Sequence
  MKO10016055_A_Emc6
  gRNA
ccggcaguaauccaggaccg

SEQ ID NO: 16056 - RNA, 20 nt, Artificial Sequence
  MKO10016056_A_Emc6
  gRNA
agggccgccguucaucagcg

SEQ ID NO: 16057 - RNA, 20 nt, Artificial Sequence
  MKO10016057_A_Emc7
  gRNA
cgagucgauaucacuucaaa

SEQ ID NO: 16058 - RNA, 20 nt, Artificial Sequence
  MKO10016058_A_Emc7
  gRNA
cagcuuacccgucucauguc

SEQ ID NO: 16059 - RNA, 20 nt, Artificial Sequence
  MKO10016059_A_Emc7
  gRNA
gccacuacuagauuugccag

SEQ ID NO: 16060 - RNA, 20 nt, Artificial Sequence
  MKO10016060_A_Emc8
  gRNA
cggugaugccgcacucauca

SEQ ID NO: 16061 - RNA, 20 nt, Artificial Sequence
  MKO10016061_A_Emc8
  gRNA
ucucgugcugcucguacacg

SEQ ID NO: 16062 - RNA, 20 nt, Artificial Sequence
  MKO10016062_A_Emc8
  gRNA
ccgcuccuacgaaacacucg

SEQ ID NO: 16063 - RNA, 20 nt, Artificial Sequence
  MKO10016063_A_Emc9
  gRNA
ugauuugaguguuaagccgc

SEQ ID NO: 16064 - RNA, 20 nt, Artificial Sequence
  MKO10016064_A_Emc9
  gRNA
cuaccaugccaaugcgguuu

SEQ ID NO: 16065 - RNA, 20 nt, Artificial Sequence
  MKO10016065_A_Emc9
  gRNA
acaaugacuggagguacacg

SEQ ID NO: 16066 - RNA, 20 nt, Artificial Sequence
  MKO10016066_A_Emcn
  gRNA
aaugcuaauucaacgcuacc

SEQ ID NO: 16067 - RNA, 20 nt, Artificial Sequence
  MKO10016067_A_Emcn
  gRNA
ucgggagguguuccaucugc

SEQ ID NO: 16068 - RNA, 20 nt, Artificial Sequence
  MKO10016068_A_Emcn
  gRNA
agucgcuugaagcagccgca

SEQ ID NO: 16069 - RNA, 20 nt, Artificial Sequence
  MKO10016069_A_Emd
  gRNA
agacuuggauucagccgccg

SEQ ID NO: 16070 - RNA, 20 nt, Artificial Sequence
  MKO10016070_A_Emd
  gRNA
ucgaguacgagacccagaga

SEQ ID NO: 16071 - RNA, 20 nt, Artificial Sequence
  MKO10016071_A_Emd
  gRNA
acccuugcucugguaaagua

SEQ ID NO: 16072 - RNA, 20 nt, Artificial Sequence
  MKO10016072_A_Eme1
  gRNA
cuccuccaagugaugcuucg

SEQ ID NO: 16073 - RNA, 20 nt, Artificial Sequence
  MKO10016073_A_Eme1
  gRNA
ccauaccucgaagcaucacu

SEQ ID NO: 16074 - RNA, 20 nt, Artificial Sequence
  MKO10016074_A_Eme1
  gRNA
caucaguuacaaagcuccga

SEQ ID NO: 16075 - RNA, 20 nt, Artificial Sequence
  MKO10016075_A_Eme2
  gRNA
ccgcaucgaaccgcagcacc

SEQ ID NO: 16076 - RNA, 20 nt, Artificial Sequence
  MKO10016076_A_Eme2
  gRNA
gccugacaacguuccacugc

SEQ ID NO: 16077 - RNA, 20 nt, Artificial Sequence
  MKO10016077_A_Eme2
  gRNA
uuggacuggacgcauaccug

SEQ ID NO: 16078 - RNA, 20 nt, Artificial Sequence
  MKO10016078_A_Emg1
  gRNA
gaaccgagcuggcuugcuac

SEQ ID NO: 16079 - RNA, 20 nt, Artificial Sequence
  MKO10016079_A_Emg1
  gRNA
cugagcguccgagcagccga

SEQ ID NO: 16080 - RNA, 20 nt, Artificial Sequence
  MKO10016080_A_Emg1
  gRNA
caucagugacauucgagagu

SEQ ID NO: 16081 - RNA, 20 nt, Artificial Sequence
  MKO10016081_A_Emid1
  gRNA
cguggacggacagcggcaug

SEQ ID NO: 16082 - RNA, 20 nt, Artificial Sequence
  MKO10016082_A_Emid1
  gRNA
caugccgcuguccguccacg

SEQ ID NO: 16083 - RNA, 20 nt, Artificial Sequence
  MKO10016083_A_Emid1
  gRNA
gagugcuacagaacugcccg

SEQ ID NO: 16084 - RNA, 20 nt, Artificial Sequence
  MKO10016084_A_Emilin1
  gRNA
gcucguggagugagucguuc

SEQ ID NO: 16085 - RNA, 20 nt, Artificial Sequence
  MKO10016085_A_Emilin1
  gRNA
uagggagcggcugcgaaccc

SEQ ID NO: 16086 - RNA, 20 nt, Artificial Sequence
  MKO10016086_A_Emilin1
  gRNA
uuguaagccacccgauagcg

SEQ ID NO: 16087 - RNA, 20 nt, Artificial Sequence
  MKO10016087_A_Emilin2
  gRNA
acgcagacuuugaugcgaga

SEQ ID NO: 16088 - RNA, 20 nt, Artificial Sequence
  MKO10016088_A_Emilin2
  gRNA
gaauacgugcgaguacaagc

SEQ ID NO: 16089 - RNA, 20 nt, Artificial Sequence
  MKO10016089_A_Emilin2
  gRNA
ccgacuuacaccagggcgga

SEQ ID NO: 16090 - RNA, 20 nt, Artificial Sequence
  MKO10016090_A_Emilin3
  gRNA
agggccccugucguaccuau

SEQ ID NO: 16091 - RNA, 20 nt, Artificial Sequence
  MKO10016091_A_Emilin3
  gRNA
ugggccgccgucuguccgug

SEQ ID NO: 16092 - RNA, 20 nt, Artificial Sequence
  MKO10016092_A_Emilin3
  gRNA
gcgcaagcucauccgcggcc

SEQ ID NO: 16093 - RNA, 20 nt, Artificial Sequence
  MKO10016093_A_Eml1
  gRNA
gucagaccgcaucgccucuc

SEQ ID NO: 16094 - RNA, 20 nt, Artificial Sequence
  MKO10016094_A_Eml1
  gRNA
guucagccuccgaaccacgu

SEQ ID NO: 16095 - RNA, 20 nt, Artificial Sequence
  MKO10016095_A_Eml1
  gRNA
ucuuccgaaagagugucucc

SEQ ID NO: 16096 - RNA, 20 nt, Artificial Sequence
  MKO10016096_A_Eml2
  gRNA
uaggugggcgccaguucguc

SEQ ID NO: 16097 - RNA, 20 nt, Artificial Sequence
  MKO10016097_A_Eml2
  gRNA
cuaucgaggccgggacugca

SEQ ID NO: 16098 - RNA, 20 nt, Artificial Sequence
  MKO10016098_A_Eml2
  gRNA
cuccuccacgcuguacagua

SEQ ID NO: 16099 - RNA, 20 nt, Artificial Sequence
  MKO10016099_A_Eml3
  gRNA
auaauugcuccuccgagauc

SEQ ID NO: 16100 - RNA, 20 nt, Artificial Sequence
  MKO10016100_A_Eml3
  gRNA
cuuccugcacccgaagucgc

SEQ ID NO: 16101 - RNA, 20 nt, Artificial Sequence
  MKO10016101_A_Eml3
  gRNA
cuggcauaucagccccgaca

SEQ ID NO: 16102 - RNA, 20 nt, Artificial Sequence
  MKO10016102_A_Eml4
  gRNA
cgcaagauggacgguuucgc

SEQ ID NO: 16103 - RNA, 20 nt, Artificial Sequence
  MKO10016103_A_Eml4
  gRNA
aaagaugucaucgucaauca

SEQ ID NO: 16104 - RNA, 20 nt, Artificial Sequence
  MKO10016104_A_Eml4
  gRNA
ucuauguccuguauaaccaa

SEQ ID NO: 16105 - RNA, 20 nt, Artificial Sequence
  MKO10016105_A_Eml5
  gRNA
uuaccaaaaacuccgcguuu

SEQ ID NO: 16106 - RNA, 20 nt, Artificial Sequence
  MKO10016106_A_Eml5
  gRNA
guugcuaccaacacucgcuc

SEQ ID NO: 16107 - RNA, 20 nt, Artificial Sequence
  MKO10016107_A_Eml5
  gRNA
ccacagcugacgaguuuauu

SEQ ID NO: 16108 - RNA, 20 nt, Artificial Sequence
  MKO10016108_A_Eml6
  gRNA
gcaccgggcgccaauuuccg

SEQ ID NO: 16109 - RNA, 20 nt, Artificial Sequence
  MKO10016109_A_Eml6
  gRNA
cgcgcggugucggcuuauca

SEQ ID NO: 16110 - RNA, 20 nt, Artificial Sequence
  MKO10016110_A_Eml6
  gRNA
guccauccgagucaaaagcc

SEQ ID NO: 16111 - RNA, 20 nt, Artificial Sequence
  MKO10016111_A_Emp1
  gRNA
caucauuacgcccacagcga

SEQ ID NO: 16112 - RNA, 20 nt, Artificial Sequence
  MKO10016112_A_Emp1
  gRNA
gggacucacguuggcaaugg

SEQ ID NO: 16113 - RNA, 20 nt, Artificial Sequence
  MKO10016113_A_Emp1
  gRNA
ugcgacggcucccuguccua

SEQ ID NO: 16114 - RNA, 20 nt, Artificial Sequence
  MKO10016114_A_Emp2
  gRNA
uuggcgccggucuguauaga

SEQ ID NO: 16115 - RNA, 20 nt, Artificial Sequence
  MKO10016115_A_Emp2
  gRNA
gccggucagcucauugaucu

SEQ ID NO: 16116 - RNA, 20 nt, Artificial Sequence
  MKO10016116_A_Emp2
  gRNA
cuacggcuacucuuucaucc

SEQ ID NO: 16117 - RNA, 20 nt, Artificial Sequence
  MKO10016117_A_Emp3
  gRNA
gugcucauucacguuuccgc

SEQ ID NO: 16118 - RNA, 20 nt, Artificial Sequence
  MKO10016118_A_Emp3
  gRNA
uaaccgaagcugcccccacu

SEQ ID NO: 16119 - RNA, 20 nt, Artificial Sequence
  MKO10016119_A_Emp3
  gRNA
gaagagcccuccgcgccgca

SEQ ID NO: 16120 - RNA, 20 nt, Artificial Sequence
  MKO10016120_A_Emr1
  gRNA
aaaguugguuuguccauugc

SEQ ID NO: 16121 - RNA, 20 nt, Artificial Sequence
  MKO10016121_A_Emr1
  gRNA
ucagugcagguggcauaagc

SEQ ID NO: 16122 - RNA, 20 nt, Artificial Sequence
  MKO10016122_A_Emr1
  gRNA
uacagcuguaccugucaacc

SEQ ID NO: 16123 - RNA, 20 nt, Artificial Sequence
  MKO10016123_A_Emr4
  gRNA
auugaucacccugauuguua

SEQ ID NO: 16124 - RNA, 20 nt, Artificial Sequence
  MKO10016124_A_Emr4
  gRNA
auagacuuaccauaacaauc

SEQ ID NO: 16125 - RNA, 20 nt, Artificial Sequence
  MKO10016125_A_Emr4
  gRNA
uuccuggaaugcugcuuauc

SEQ ID NO: 16126 - RNA, 20 nt, Artificial Sequence
  MKO10016126_A_Emx1
  gRNA
cccuccauagagcgagcggc

SEQ ID NO: 16127 - RNA, 20 nt, Artificial Sequence
  MKO10016127_A_Emx1
  gRNA
ggugaaaccccgcuuagccg

SEQ ID NO: 16128 - RNA, 20 nt, Artificial Sequence
  MKO10016128_A_Emx1
  gRNA
gcuucguggcgaugcgccac

SEQ ID NO: 16129 - RNA, 20 nt, Artificial Sequence
  MKO10016129_A_Emx2
  gRNA
ucggcgcagcauguuucagc

SEQ ID NO: 16130 - RNA, 20 nt, Artificial Sequence
  MKO10016130_A_Emx2
  gRNA
cauccaccgcuaccgauauc

SEQ ID NO: 16131 - RNA, 20 nt, Artificial Sequence
  MKO10016131_A_Emx2
  gRNA
uuuccgcucccaccacguaa

SEQ ID NO: 16132 - RNA, 20 nt, Artificial Sequence
  MKO10016132_A_En1
  gRNA
cgcauccaaagccgggaacc

SEQ ID NO: 16133 - RNA, 20 nt, Artificial Sequence
  MKO10016133_A_En1
  gRNA
gccuaaaagucagcgcgacu

SEQ ID NO: 16134 - RNA, 20 nt, Artificial Sequence
  MKO10016134_A_En1
  gRNA
gcggccgcggacggcguuca

SEQ ID NO: 16135 - RNA, 20 nt, Artificial Sequence
  MKO10016135_A_En2
  gRNA
gugcgcacgcuggguucggu

SEQ ID NO: 16136 - RNA, 20 nt, Artificial Sequence
  MKO10016136_A_En2
  gRNA
gacccugcggucgacggaga

SEQ ID NO: 16137 - RNA, 20 nt, Artificial Sequence
  MKO10016137_A_En2
  gRNA
ccgugguggaaugguuguac

SEQ ID NO: 16138 - RNA, 20 nt, Artificial Sequence
  MKO10016138_A_Enah
  gRNA
cauggcacuugcgaagacau

SEQ ID NO: 16139 - RNA, 20 nt, Artificial Sequence
  MKO10016139_A_Enah
  gRNA
cuuagaaguguuaaauucac

SEQ ID NO: 16140 - RNA, 20 nt, Artificial Sequence
  MKO10016140_A_Enah
  gRNA
cagaaagauucaagaccauc

SEQ ID NO: 16141 - RNA, 20 nt, Artificial Sequence
  MKO10016141_A_Enam
  gRNA
augccaaugccccgaaugcc

SEQ ID NO: 16142 - RNA, 20 nt, Artificial Sequence
  MKO10016142_A_Enam
  gRNA
gcucuuucagaugaugccua

SEQ ID NO: 16143 - RNA, 20 nt, Artificial Sequence
  MKO10016143_A_Enam
  gRNA
cuagccucaccugagguggc

SEQ ID NO: 16144 - RNA, 20 nt, Artificial Sequence
  MKO10016144_A_Enc1
  gRNA
gcgcaugagcugccacgccg

SEQ ID NO: 16145 - RNA, 20 nt, Artificial Sequence
  MKO10016145_A_Enc1
  gRNA
augguagccccacuccgcga

SEQ ID NO: 16146 - RNA, 20 nt, Artificial Sequence
  MKO10016146_A_Enc1
  gRNA
uagacuacgcauacuccucc

SEQ ID NO: 16147 - RNA, 20 nt, Artificial Sequence
  MKO10016147_A_Endod1
  gRNA
cgggcgcgcagcgcgaaacg

SEQ ID NO: 16148 - RNA, 20 nt, Artificial Sequence
  MKO10016148_A_Endod1
  gRNA
uggcgaccgaagcgcacgug

SEQ ID NO: 16149 - RNA, 20 nt, Artificial Sequence
  MKO10016149_A_Endod1
  gRNA
agccacugucucauaccucg

SEQ ID NO: 16150 - RNA, 20 nt, Artificial Sequence
  MKO10016150_A_Endog
  gRNA
cgcuacgguccccgucgcca

SEQ ID NO: 16151 - RNA, 20 nt, Artificial Sequence
  MKO10016151_A_Endog
  gRNA
acguagcucgaucugcccac

SEQ ID NO: 16152 - RNA, 20 nt, Artificial Sequence
  MKO10016152_A_Endog
  gRNA
agcuacgacccgcgcacgcg

SEQ ID NO: 16153 - RNA, 20 nt, Artificial Sequence
  MKO10016153_A_Endou
  gRNA
ggugcuugucguaggcuucc

SEQ ID NO: 16154 - RNA, 20 nt, Artificial Sequence
  MKO10016154_A_Endou
  gRNA
cagcagcgaugccgucacua

SEQ ID NO: 16155 - RNA, 20 nt, Artificial Sequence
  MKO10016155_A_Endou
  gRNA
gcaucuccgagaccaucuac

SEQ ID NO: 16156 - RNA, 20 nt, Artificial Sequence
  MKO10016156_A_Endov
  gRNA
aacggggugcuucaccaacg

SEQ ID NO: 16157 - RNA, 20 nt, Artificial Sequence
  MKO10016157_A_Endov
  gRNA
cagccgcaugguuggccuga

SEQ ID NO: 16158 - RNA, 20 nt, Artificial Sequence
  MKO10016158_A_Endov
  gRNA
ggcuccguaggucguucuug

SEQ ID NO: 16159 - RNA, 20 nt, Artificial Sequence
  MKO10016159_A_Engase
  gRNA
ggagcuccuccagcgucgac

SEQ ID NO: 16160 - RNA, 20 nt, Artificial Sequence
  MKO10016160_A_Engase
  gRNA
uaggaucaacgaggaucaag

SEQ ID NO: 16161 - RNA, 20 nt, Artificial Sequence
  MKO10016161_A_Engase
  gRNA
agaugucgauauacugccag

SEQ ID NO: 16162 - RNA, 20 nt, Artificial Sequence
  MKO10016162_A_Eng
  gRNA
gucauccagugcugcuaucg

SEQ ID NO: 16163 - RNA, 20 nt, Artificial Sequence
  MKO10016163_A_Eng
  gRNA
aaacgucaccucaccccuug

SEQ ID NO: 16164 - RNA, 20 nt, Artificial Sequence
  MKO10016164_A_Eng
  gRNA
ggugacguuuaccaccagcc

SEQ ID NO: 16165 - RNA, 20 nt, Artificial Sequence
  MKO10016165_A_Enho
  gRNA
cgauggcgaugagagccccu

SEQ ID NO: 16166 - RNA, 20 nt, Artificial Sequence
  MKO10016166_A_Enho
  gRNA
cgacgucagcagaucgagaa

SEQ ID NO: 16167 - RNA, 20 nt, Artificial Sequence
  MKO10016167_A_Enho
  gRNA
cucaucgccaucgucugcaa

SEQ ID NO: 16168 - RNA, 20 nt, Artificial Sequence
  MKO10016168_A_Enkd1
  gRNA
gcguggcguuguagcgcucc

SEQ ID NO: 16169 - RNA, 20 nt, Artificial Sequence
  MKO10016169_A_Enkd1
  gRNA
gcccgagagauccuagagcg

SEQ ID NO: 16170 - RNA, 20 nt, Artificial Sequence
  MKO10016170_A_Enkd1
  gRNA
uaggagagacccccgaaccg

SEQ ID NO: 16171 - RNA, 20 nt, Artificial Sequence
  MKO10016171_A_Enkur
  gRNA
gagaaccgaucauccaguua

SEQ ID NO: 16172 - RNA, 20 nt, Artificial Sequence
  MKO10016172_A_Enkur
  gRNA
guacauaugcaagcgaaaug

SEQ ID NO: 16173 - RNA, 20 nt, Artificial Sequence
  MKO10016173_A_Enkur
  gRNA
ucgguucucaagggcacugc

SEQ ID NO: 16174 - RNA, 20 nt, Artificial Sequence
  MKO10016174_A_Eno1
  gRNA
ggccacucaccgggacaggc

SEQ ID NO: 16175 - RNA, 20 nt, Artificial Sequence
  MKO10016175_A_Eno1
  gRNA
uccaggucucuuccgagcug

SEQ ID NO: 16176 - RNA, 20 nt, Artificial Sequence
  MKO10016176_A_Eno1
  gRNA
ccugcagaaagugaauguug

SEQ ID NO: 16177 - RNA, 20 nt, Artificial Sequence
  MKO10016177_A_Eno2
  gRNA
ggggacaaacagcguuacuu

SEQ ID NO: 16178 - RNA, 20 nt, Artificial Sequence
  MKO10016178_A_Eno2
  gRNA
cugcccucaggguaucuccg

SEQ ID NO: 16179 - RNA, 20 nt, Artificial Sequence
  MKO10016179_A_Eno2
  gRNA
gaugccgguggaggcuccac

SEQ ID NO: 16180 - RNA, 20 nt, Artificial Sequence
  MKO10016180_A_Eno3
  gRNA
cgacacaucgcagaucuugc

SEQ ID NO: 16181 - RNA, 20 nt, Artificial Sequence
  MKO10016181_A_Eno3
  gRNA
cugcaagaucugcgaugugu

SEQ ID NO: 16182 - RNA, 20 nt, Artificial Sequence
  MKO10016182_A_Eno3
  gRNA
uggagacaaagcacgauacc

SEQ ID NO: 16183 - RNA, 20 nt, Artificial Sequence
  MKO10016183_A_Eno4
  gRNA
uccacgacuucaaagugcgu

SEQ ID NO: 16184 - RNA, 20 nt, Artificial Sequence
  MKO10016184_A_Eno4
  gRNA
cccuacgcacuuugaagucg

SEQ ID NO: 16185 - RNA, 20 nt, Artificial Sequence
  MKO10016185_A_Eno4
  gRNA
cgauccucucuacuuaaccc

SEQ ID NO: 16186 - RNA, 20 nt, Artificial Sequence
  MKO10016186_A_Enoph1
  gRNA
cggggcuguuccgauacccg

SEQ ID NO: 16187 - RNA, 20 nt, Artificial Sequence
  MKO10016187_A_Enoph1
  gRNA
cggugacauccgugagaaac

SEQ ID NO: 16188 - RNA, 20 nt, Artificial Sequence
  MKO10016188_A_Enoph1
  gRNA
cugugguggacaacguguac

SEQ ID NO: 16189 - RNA, 20 nt, Artificial Sequence
  MKO10016189_A_Enox1
  gRNA
cccauuaacccgaugauacc

SEQ ID NO: 16190 - RNA, 20 nt, Artificial Sequence
  MKO10016190_A_Enox1
  gRNA
ggagcggcaucgacgcaaac

SEQ ID NO: 16191 - RNA, 20 nt, Artificial Sequence
  MKO10016191_A_Enox1
  gRNA
uugacgacagccacuuccgu

SEQ ID NO: 16192 - RNA, 20 nt, Artificial Sequence
  MKO10016192_A_Enox2
  gRNA
uacuagagcccagacgaauu

SEQ ID NO: 16193 - RNA, 20 nt, Artificial Sequence
  MKO10016193_A_Enox2
  gRNA
caacagccauguccgccgcc

SEQ ID NO: 16194 - RNA, 20 nt, Artificial Sequence
  MKO10016194_A_Enox2
  gRNA
accgauuccuccagauaugc

SEQ ID NO: 16195 - RNA, 20 nt, Artificial Sequence
  MKO10016195_A_Enpep
  gRNA
uuagaugaggccgauaguag

SEQ ID NO: 16196 - RNA, 20 nt, Artificial Sequence
  MKO10016196_A_Enpep
  gRNA
cuucgaagacuacuucgcua

SEQ ID NO: 16197 - RNA, 20 nt, Artificial Sequence
  MKO10016197_A_Enpep
  gRNA
gcuuuacgacccccuacuau

SEQ ID NO: 16198 - RNA, 20 nt, Artificial Sequence
  MKO10016198_A_Enpp1
  gRNA
augugaaagcaucgauaccc

SEQ ID NO: 16199 - RNA, 20 nt, Artificial Sequence
  MKO10016199_A_Enpp1
  gRNA
uuaccuucuuuggcgcagcu

SEQ ID NO: 16200 - RNA, 20 nt, Artificial Sequence
  MKO10016200_A_Enpp1
  gRNA
aaaccaagcugcgccaaaga

SEQ ID NO: 16201 - RNA, 20 nt, Artificial Sequence
  MKO10016201_A_Enpp2
  gRNA
uaagcagagauugacgccga

SEQ ID NO: 16202 - RNA, 20 nt, Artificial Sequence
  MKO10016202_A_Enpp2
  gRNA
ucccucggcauggcaagaca

SEQ ID NO: 16203 - RNA, 20 nt, Artificial Sequence
  MKO10016203_A_Enpp2
  gRNA
ucacagcaagucgaauuaag

SEQ ID NO: 16204 - RNA, 20 nt, Artificial Sequence
  MKO10016204_A_Enpp3
  gRNA
acgugcaauuuauuccguug

SEQ ID NO: 16205 - RNA, 20 nt, Artificial Sequence
  MKO10016205_A_Enpp3
  gRNA
cuguagacagucauccgcac

SEQ ID NO: 16206 - RNA, 20 nt, Artificial Sequence
  MKO10016206_A_Enpp3
  gRNA
ugcuuugacucaucgcacag

SEQ ID NO: 16207 - RNA, 20 nt, Artificial Sequence
  MKO10016207_A_Enpp4
  gRNA
ggucaagcgcugccgcuaug

SEQ ID NO: 16208 - RNA, 20 nt, Artificial Sequence
  MKO10016208_A_Enpp4
  gRNA
gauguaagcggccacaagua

SEQ ID NO: 16209 - RNA, 20 nt, Artificial Sequence
  MKO10016209_A_Enpp4
  gRNA
ugcuccgcaugaauaucaug

SEQ ID NO: 16210 - RNA, 20 nt, Artificial Sequence
  MKO10016210_A_Enpp5
  gRNA
aauaggucgggaaacuaucg

SEQ ID NO: 16211 - RNA, 20 nt, Artificial Sequence
  MKO10016211_A_Enpp5
  gRNA
cucaucgucacgagcgacca

SEQ ID NO: 16212 - RNA, 20 nt, Artificial Sequence
  MKO10016212_A_Enpp5
  gRNA
aguucaaccaaucguagcug

SEQ ID NO: 16213 - RNA, 20 nt, Artificial Sequence
  MKO10016213_A_Enpp6
  gRNA
cuucuacaucgaugcgcuca

SEQ ID NO: 16214 - RNA, 20 nt, Artificial Sequence
  MKO10016214_A_Enpp6
  gRNA
acauguaguugccgaucauc

SEQ ID NO: 16215 - RNA, 20 nt, Artificial Sequence
  MKO10016215_A_Enpp6
  gRNA
caugagcgcaucgauguaga

SEQ ID NO: 16216 - RNA, 20 nt, Artificial Sequence
  MKO10016216_A_Enpp7
  gRNA
auaccgagcguggcguggua

SEQ ID NO: 16217 - RNA, 20 nt, Artificial Sequence
  MKO10016217_A_Enpp7
  gRNA
auugugcccgagcccaacga

SEQ ID NO: 16218 - RNA, 20 nt, Artificial Sequence
  MKO10016218_A_Enpp7
  gRNA
cgugguccgaugugauaauc

SEQ ID NO: 16219 - RNA, 20 nt, Artificial Sequence
  MKO10016219_A_Ensa
  gRNA
ugacgagcgaggacuuucuc

SEQ ID NO: 16220 - RNA, 20 nt, Artificial Sequence
  MKO10016220_A_Ensa
  gRNA
uagcaaaaguacuuugacuc

SEQ ID NO: 16221 - RNA, 20 nt, Artificial Sequence
  MKO10016221_A_Ensa
  gRNA
ccaggaagcaucacucaacu

SEQ ID NO: 16222 - RNA, 20 nt, Artificial Sequence
  MKO10016222_A_Enthd1
  gRNA
ccccguggcagauaaucugc

SEQ ID NO: 16223 - RNA, 20 nt, Artificial Sequence
  MKO10016223_A_Enthd1
  gRNA
gguccgcugccucguccacg

SEQ ID NO: 16224 - RNA, 20 nt, Artificial Sequence
  MKO10016224_A_Enthd1
  gRNA
uaaagaugaguucgucagcc

SEQ ID NO: 16225 - RNA, 20 nt, Artificial Sequence
  MKO10016225_A_Enthd2
  gRNA
ggaguaccuccugaaccguc

SEQ ID NO: 16226 - RNA, 20 nt, Artificial Sequence
  MKO10016226_A_Enthd2
  gRNA
uacuggcgaucucuucaaac

SEQ ID NO: 16227 - RNA, 20 nt, Artificial Sequence
  MKO10016227_A_Enthd2
  gRNA
agcugcuguccagacgguuc

SEQ ID NO: 16228 - RNA, 20 nt, Artificial Sequence
  MKO10016228_A_Entpd1
  gRNA
ugcguaccuggccgaaugca

SEQ ID NO: 16229 - RNA, 20 nt, Artificial Sequence
  MKO10016229_A_Entpd1
  gRNA
guuaauaguaauccacccau

SEQ ID NO: 16230 - RNA, 20 nt, Artificial Sequence
  MKO10016230_A_Entpd1
  gRNA
ccggccacuuguagauguac

SEQ ID NO: 16231 - RNA, 20 nt, Artificial Sequence
  MKO10016231_A_Entpd2
  gRNA
cccacaguauggcaucguuc

SEQ ID NO: 16232 - RNA, 20 nt, Artificial Sequence
  MKO10016232_A_Entpd2
  gRNA
agaagggucauuugcguagc

SEQ ID NO: 16233 - RNA, 20 nt, Artificial Sequence
  MKO10016233_A_Entpd2
  gRNA
gcuggccauagagccgcaaa

SEQ ID NO: 16234 - RNA, 20 nt, Artificial Sequence
  MKO10016234_A_Entpd3
  gRNA
uauggcgucgugcucgaugc

SEQ ID NO: 16235 - RNA, 20 nt, Artificial Sequence
  MKO10016235_A_Entpd3
  gRNA
gaccggcuuaccuucagccc

SEQ ID NO: 16236 - RNA, 20 nt, Artificial Sequence
  MKO10016236_A_Entpd3
  gRNA
accaccaaggugacgauggc

SEQ ID NO: 16237 - RNA, 20 nt, Artificial Sequence
  MKO10016237_A_Entpd4
  gRNA
acagccacccauacuugcug

SEQ ID NO: 16238 - RNA, 20 nt, Artificial Sequence
  MKO10016238_A_Entpd4
  gRNA
ccugucucuuuccugccucu

SEQ ID NO: 16239 - RNA, 20 nt, Artificial Sequence
  MKO10016239_A_Entpd4
  gRNA
ggcuuaaucuucaucaccac

SEQ ID NO: 16240 - RNA, 20 nt, Artificial Sequence
  MKO10016240_A_Entpd5
  gRNA
augcugaucauagccugcgu

SEQ ID NO: 16241 - RNA, 20 nt, Artificial Sequence
  MKO10016241_A_Entpd5
  gRNA
augaugcuaacgcugccauc

SEQ ID NO: 16242 - RNA, 20 nt, Artificial Sequence
  MKO10016242_A_Entpd5
  gRNA
ugccccauuaaugucagugc

SEQ ID NO: 16243 - RNA, 20 nt, Artificial Sequence
  MKO10016243_A_Entpd6
  gRNA
cucuuacagguguuucggcc

SEQ ID NO: 16244 - RNA, 20 nt, Artificial Sequence
  MKO10016244_A_Entpd6
  gRNA
uucgucugugccguucauga

SEQ ID NO: 16245 - RNA, 20 nt, Artificial Sequence
  MKO10016245_A_Entpd6
  gRNA
aaacacagucauccccgaca

SEQ ID NO: 16246 - RNA, 20 nt, Artificial Sequence
  MKO10016246_A_Entpd7
  gRNA
uacuuaagggaucuccgcaa

SEQ ID NO: 16247 - RNA, 20 nt, Artificial Sequence
  MKO10016247_A_Entpd7
  gRNA
gccacccgcugacggagaaa

SEQ ID NO: 16248 - RNA, 20 nt, Artificial Sequence
  MKO10016248_A_Entpd7
  gRNA
aaaucugaauuauggacucg

SEQ ID NO: 16249 - RNA, 20 nt, Artificial Sequence
  MKO10016249_A_Entpd8
  gRNA
ggcgcuggcguugaucccac

SEQ ID NO: 16250 - RNA, 20 nt, Artificial Sequence
  MKO10016250_A_Entpd8
  gRNA
cuauaccucugacccgacac

SEQ ID NO: 16251 - RNA, 20 nt, Artificial Sequence
  MKO10016251_A_Entpd8
  gRNA
caagucaccuuccgccugua

SEQ ID NO: 16252 - RNA, 20 nt, Artificial Sequence
  MKO10016252_A_Eny2
  gRNA
gaaaucacuccaaaaggcag

SEQ ID NO: 16253 - RNA, 20 nt, Artificial Sequence
  MKO10016253_A_Eny2
  gRNA
cagcuaaaggcacacuguaa

SEQ ID NO: 16254 - RNA, 20 nt, Artificial Sequence
  MKO10016254_A_Eny2
  gRNA
acacguuacuguugaugacu

SEQ ID NO: 16255 - RNA, 20 nt, Artificial Sequence
  MKO10016255_A_Eogu
  gRNA
uggauaugcgcgagagcgac

SEQ ID NO: 16256 - RNA, 20 nt, Artificial Sequence
  MKO10016256_A_Eogu
  gRNA
cguuugcagcuaugucgacu

SEQ ID NO: 16257 - RNA, 20 nt, Artificial Sequence
  MKO10016257_A_Eogu
  gRNA
ugcaaauaggaccgauacuc

SEQ ID NO: 16258 - RNA, 20 nt, Artificial Sequence
  MKO10016258_A_Eomes
  gRNA
cacggcggcggggaauccac

SEQ ID NO: 16259 - RNA, 20 nt, Artificial Sequence
  MKO10016259_A_Eomes
  gRNA
cccguguaccccgcguccaa

SEQ ID NO: 16260 - RNA, 20 nt, Artificial Sequence
  MKO10016260_A_Eomes
  gRNA
uucuggccgacccuaaccac

SEQ ID NO: 16261 - RNA, 20 nt, Artificial Sequence
  MKO10016261_A_Ep300
  gRNA
cuggugacuccaguugccgc

SEQ ID NO: 16262 - RNA, 20 nt, Artificial Sequence
  MKO10016262_A_Ep300
  gRNA
acugcauguuuggccguccc

SEQ ID NO: 16263 - RNA, 20 nt, Artificial Sequence
  MKO10016263_A_Ep300
  gRNA
cugacugauaucgccaccau

SEQ ID NO: 16264 - RNA, 20 nt, Artificial Sequence
  MKO10016264_A_Ep400
  gRNA
gucuggaccugcugcgacau

SEQ ID NO: 16265 - RNA, 20 nt, Artificial Sequence
  MKO10016265_A_Ep400
  gRNA
cccuacauguuccgaugccc

SEQ ID NO: 16266 - RNA, 20 nt, Artificial Sequence
  MKO10016266_A_Ep400
  gRNA
ccccuuuacaagcguaucuu

SEQ ID NO: 16267 - RNA, 20 nt, Artificial Sequence
  MKO10016267_A_Epas1
  gRNA
agaaaucccgugaugccgcg

SEQ ID NO: 16268 - RNA, 20 nt, Artificial Sequence
  MKO10016268_A_Epas1
  gRNA
ccuuccagguggccgacuug

SEQ ID NO: 16269 - RNA, 20 nt, Artificial Sequence
  MKO10016269_A_Epas1
  gRNA
ccgagcgugacuucuucaug

SEQ ID NO: 16270 - RNA, 20 nt, Artificial Sequence
  MKO10016270_A_Epb4.1l1
  gRNA
aauccuuaucguccauaucc

SEQ ID NO: 16271 - RNA, 20 nt, Artificial Sequence
  MKO10016271_A_Epb4.1l1
  gRNA
ugggcgugguccucuccgac

SEQ ID NO: 16272 - RNA, 20 nt, Artificial Sequence
  MKO10016272_A_Epb4.1l1
  gRNA
gaauuggcuggaccccucca

SEQ ID NO: 16273 - RNA, 20 nt, Artificial Sequence
  MKO10016273_A_Epb4.1l2
  gRNA
uguauuccgugccaucuaga

SEQ ID NO: 16274 - RNA, 20 nt, Artificial Sequence
  MKO10016274_A_Epb4.1l2
  gRNA
agcugacugaagauaucacc

SEQ ID NO: 16275 - RNA, 20 nt, Artificial Sequence
  MKO10016275_A_Epb4.1l2
  gRNA
uaaucgcuuacuuucugcuc

SEQ ID NO: 16276 - RNA, 20 nt, Artificial Sequence
  MKO10016276_A_Epb4.1l3
  gRNA
ucucugcgucucgauacgug

SEQ ID NO: 16277 - RNA, 20 nt, Artificial Sequence
  MKO10016277_A_Epb4.1l3
  gRNA
ccuguacagaagcgcucccg

SEQ ID NO: 16278 - RNA, 20 nt, Artificial Sequence
  MKO10016278_A_Epb4.1l3
  gRNA
gaacugguuggacccugcua

SEQ ID NO: 16279 - RNA, 20 nt, Artificial Sequence
  MKO10016279_A_Epb4.1l4a
  gRNA
uuuccgucacauaaaccucg

SEQ ID NO: 16280 - RNA, 20 nt, Artificial Sequence
  MKO10016280_A_Epb4.1l4a
  gRNA
aucugagcagcaauauugac

SEQ ID NO: 16281 - RNA, 20 nt, Artificial Sequence
  MKO10016281_A_Epb4.1l4a
  gRNA
ugugacggaaaacgugguca

SEQ ID NO: 16282 - RNA, 20 nt, Artificial Sequence
  MKO10016282_A_Epb4.1l4b
  gRNA
caaucuggucgaacaaaucc

SEQ ID NO: 16283 - RNA, 20 nt, Artificial Sequence
  MKO10016283_A_Epb4.1l4b
  gRNA
cgaccagauuguguaccacu

SEQ ID NO: 16284 - RNA, 20 nt, Artificial Sequence
  MKO10016284_A_Epb4.1l4b
  gRNA
accuuguaaauuccucucga

SEQ ID NO: 16285 - RNA, 20 nt, Artificial Sequence
  MKO10016285_A_Epb4.1l5
  gRNA
caugcuugcgcauagaccug

SEQ ID NO: 16286 - RNA, 20 nt, Artificial Sequence
  MKO10016286_A_Epb4.1l5
  gRNA
ugacaucuguaccguccaga

SEQ ID NO: 16287 - RNA, 20 nt, Artificial Sequence
  MKO10016287_A_Epb4.1l5
  gRNA
aucuucgugaggagcuaacc

SEQ ID NO: 16288 - RNA, 20 nt, Artificial Sequence
  MKO10016288_A_Epb4.1
  gRNA
ggucuacgaauguguuguag

SEQ ID NO: 16289 - RNA, 20 nt, Artificial Sequence
  MKO10016289_A_Epb4.1
  gRNA
guagaccgugucauccaaca

SEQ ID NO: 16290 - RNA, 20 nt, Artificial Sequence
  MKO10016290_A_Epb4.1
  gRNA
acuacuuugguuuagcccug

SEQ ID NO: 16291 - RNA, 20 nt, Artificial Sequence
  MKO10016291_A_Epb4.2
  gRNA
ucaccaaggcgcccacaacu

SEQ ID NO: 16292 - RNA, 20 nt, Artificial Sequence
  MKO10016292_A_Epb4.2
  gRNA
gcucccagcaccuuacuuug

SEQ ID NO: 16293 - RNA, 20 nt, Artificial Sequence
  MKO10016293_A_Epb4.2
  gRNA
uguccauacucaguaacuuc

SEQ ID NO: 16294 - RNA, 20 nt, Artificial Sequence
  MKO10016294_A_Epc1
  gRNA
ugaacagccugauuacgauc

SEQ ID NO: 16295 - RNA, 20 nt, Artificial Sequence
  MKO10016295_A_Epc1
  gRNA
gauaagugaugacccccggc

SEQ ID NO: 16296 - RNA, 20 nt, Artificial Sequence
  MKO10016296_A_Epc1
  gRNA
uagcacaaaugauccuuacg

SEQ ID NO: 16297 - RNA, 20 nt, Artificial Sequence
  MKO10016297_A_Epc2
  gRNA
augauccuuacguugccuuu

SEQ ID NO: 16298 - RNA, 20 nt, Artificial Sequence
  MKO10016298_A_Epc2
  gRNA
cgagcaaccagauuaugaua

SEQ ID NO: 16299 - RNA, 20 nt, Artificial Sequence
  MKO10016299_A_Epc2
  gRNA
uaagugcaauaauucccguu

SEQ ID NO: 16300 - RNA, 20 nt, Artificial Sequence
  MKO10016300_A_Epcam
  gRNA
cguacagcccaucguuguuc

SEQ ID NO: 16301 - RNA, 20 nt, Artificial Sequence
  MKO10016301_A_Epcam
  gRNA
gagccccugcucgucgcagu

SEQ ID NO: 16302 - RNA, 20 nt, Artificial Sequence
  MKO10016302_A_Epcam
  gRNA
uauuugcagugcgcuucaag

SEQ ID NO: 16303 - RNA, 20 nt, Artificial Sequence
  MKO10016303_A_Epdr1
  gRNA
cgcgcccugguguccuacga

SEQ ID NO: 16304 - RNA, 20 nt, Artificial Sequence
  MKO10016304_A_Epdr1
  gRNA
cugcacaucaaagaaccgcg

SEQ ID NO: 16305 - RNA, 20 nt, Artificial Sequence
  MKO10016305_A_Epdr1
  gRNA
cuggaccggauaacaauccu

SEQ ID NO: 16306 - RNA, 20 nt, Artificial Sequence
  MKO10016306_A_Epg5
  gRNA
guguccguguuacaacgagu

SEQ ID NO: 16307 - RNA, 20 nt, Artificial Sequence
  MKO10016307_A_Epg5
  gRNA
cgggcucuccugcucgcgac

SEQ ID NO: 16308 - RNA, 20 nt, Artificial Sequence
  MKO10016308_A_Epg5
  gRNA
acagccgacucguuguaaca

SEQ ID NO: 16309 - RNA, 20 nt, Artificial Sequence
  MKO10016309_A_Epgn
  gRNA
aauccacagcauacgaaguu

SEQ ID NO: 16310 - RNA, 20 nt, Artificial Sequence
  MKO10016310_A_Epgn
  gRNA
gacccuaacuucguaugcug

SEQ ID NO: 16311 - RNA, 20 nt, Artificial Sequence
  MKO10016311_A_Epgn
  gRNA
ugagagaacuucagagcuac

SEQ ID NO: 16312 - RNA, 20 nt, Artificial Sequence
  MKO10016312_A_Epha10
  gRNA
ccgcgggcagcgcaucuucg

SEQ ID NO: 16313 - RNA, 20 nt, Artificial Sequence
  MKO10016313_A_Epha10
  gRNA
cgagggcguccccgccuagg

SEQ ID NO: 16314 - RNA, 20 nt, Artificial Sequence
  MKO10016314_A_Epha10
  gRNA
cgccccgggaccgccgaaga

SEQ ID NO: 16315 - RNA, 20 nt, Artificial Sequence
  MKO10016315_A_Epha1
  gRNA
cgcuccaauuggaucuaccg

SEQ ID NO: 16316 - RNA, 20 nt, Artificial Sequence
  MKO10016316_A_Epha1
  gRNA
ggaagcuucacgcaucuacg

SEQ ID NO: 16317 - RNA, 20 nt, Artificial Sequence
  MKO10016317_A_Epha1
  gRNA
cgcugugccgagaccgugca

SEQ ID NO: 16318 - RNA, 20 nt, Artificial Sequence
  MKO10016318_A_Epha2
  gRNA
caacgugguauccggcgacc

SEQ ID NO: 16319 - RNA, 20 nt, Artificial Sequence
  MKO10016319_A_Epha2
  gRNA
uucgcugucgaagcacgcaa

SEQ ID NO: 16320 - RNA, 20 nt, Artificial Sequence
  MKO10016320_A_Epha2
  gRNA
cugcugaccgugaucucguc

SEQ ID NO: 16321 - RNA, 20 nt, Artificial Sequence
  MKO10016321_A_Epha3
  gRNA
gaacgagguuucauaugcca

SEQ ID NO: 16322 - RNA, 20 nt, Artificial Sequence
  MKO10016322_A_Epha3
  gRNA
cucaaacauaaacgagaccu

SEQ ID NO: 16323 - RNA, 20 nt, Artificial Sequence
  MKO10016323_A_Epha3
  gRNA
augaacauuacacaccaauc

SEQ ID NO: 16324 - RNA, 20 nt, Artificial Sequence
  MKO10016324_A_Epha4
  gRNA
uacaccgauccgaaccuacc

SEQ ID NO: 16325 - RNA, 20 nt, Artificial Sequence
  MKO10016325_A_Epha4
  gRNA
acugacuggaucacccgcga

SEQ ID NO: 16326 - RNA, 20 nt, Artificial Sequence
  MKO10016326_A_Epha4
  gRNA
acguccugcaccugugaccg

SEQ ID NO: 16327 - RNA, 20 nt, Artificial Sequence
  MKO10016327_A_Epha5
  gRNA
accuucguuagagauccaac

SEQ ID NO: 16328 - RNA, 20 nt, Artificial Sequence
  MKO10016328_A_Epha5
  gRNA
auaauuccauuggggcgauc

SEQ ID NO: 16329 - RNA, 20 nt, Artificial Sequence
  MKO10016329_A_Epha5
  gRNA
cugcuguacgugcucgaauu

SEQ ID NO: 16330 - RNA, 20 nt, Artificial Sequence
  MKO10016330_A_Epha6
  gRNA
gccccgcacuucaaccaaag

SEQ ID NO: 16331 - RNA, 20 nt, Artificial Sequence
  MKO10016331_A_Epha6
  gRNA
caucggauucuauauaauac

SEQ ID NO: 16332 - RNA, 20 nt, Artificial Sequence
  MKO10016332_A_Epha6
  gRNA
uccacacagcucaaccuacg

SEQ ID NO: 16333 - RNA, 20 nt, Artificial Sequence
  MKO10016333_A_Epha7
  gRNA
uuacucgugcaugcaacgua

SEQ ID NO: 16334 - RNA, 20 nt, Artificial Sequence
  MKO10016334_A_Epha7
  gRNA
gaaccgaguuugaacaacca

SEQ ID NO: 16335 - RNA, 20 nt, Artificial Sequence
  MKO10016335_A_Epha7
  gRNA
cggacuaacuggauuucuaa

SEQ ID NO: 16336 - RNA, 20 nt, Artificial Sequence
  MKO10016336_A_Epha8
  gRNA
acgaacugggugccccgcga

SEQ ID NO: 16337 - RNA, 20 nt, Artificial Sequence
  MKO10016337_A_Epha8
  gRNA
cccaguaaccgccuccgaga

SEQ ID NO: 16338 - RNA, 20 nt, Artificial Sequence
  MKO10016338_A_Epha8
  gRNA
gugaugucgcugcgaccacc

SEQ ID NO: 16339 - RNA, 20 nt, Artificial Sequence
  MKO10016339_A_Ephb1
  gRNA
uuacuaguacacgccaccuc

SEQ ID NO: 16340 - RNA, 20 nt, Artificial Sequence
  MKO10016340_A_Ephb1
  gRNA
ggguacguuaccuuccaucg

SEQ ID NO: 16341 - RNA, 20 nt, Artificial Sequence
  MKO10016341_A_Ephb1
  gRNA
cuuacagguacagcgcccaa

SEQ ID NO: 16342 - RNA, 20 nt, Artificial Sequence
  MKO10016342_A_Ephb2
  gRNA
accaaauucauccggcgccg

SEQ ID NO: 16343 - RNA, 20 nt, Artificial Sequence
  MKO10016343_A_Ephb2
  gRNA
ccucgcgaccccccgagucu

SEQ ID NO: 16344 - RNA, 20 nt, Artificial Sequence
  MKO10016344_A_Ephb2
  gRNA
uucggucccgugucccgcaa

SEQ ID NO: 16345 - RNA, 20 nt, Artificial Sequence
  MKO10016345_A_Ephb3
  gRNA
agaccucgcuaauccucgaa

SEQ ID NO: 16346 - RNA, 20 nt, Artificial Sequence
  MKO10016346_A_Ephb3
  gRNA
uguagcgugugugggccaac

SEQ ID NO: 16347 - RNA, 20 nt, Artificial Sequence
  MKO10016347_A_Ephb3
  gRNA
gccccacuuaccacggcacu

SEQ ID NO: 16348 - RNA, 20 nt, Artificial Sequence
  MKO10016348_A_Ephb4
  gRNA
cacgauacgcuucaccauga

SEQ ID NO: 16349 - RNA, 20 nt, Artificial Sequence
  MKO10016349_A_Ephb4
  gRNA
ucuccauccaggcgggcgua

SEQ ID NO: 16350 - RNA, 20 nt, Artificial Sequence
  MKO10016350_A_Ephb4
  gRNA
agguagcugcguggccaacg

SEQ ID NO: 16351 - RNA, 20 nt, Artificial Sequence
  MKO10016351_A_Ephb6
  gRNA
agacggccccgacaguauug

SEQ ID NO: 16352 - RNA, 20 nt, Artificial Sequence
  MKO10016352_A_Ephb6
  gRNA
ugccaggccgcaauacuguc

SEQ ID NO: 16353 - RNA, 20 nt, Artificial Sequence
  MKO10016353_A_Ephb6
  gRNA
ugcauuucgacccccgccag

SEQ ID NO: 16354 - RNA, 20 nt, Artificial Sequence
  MKO10016354_A_Ephx1
  gRNA
ggagcucuuguacccauuca

SEQ ID NO: 16355 - RNA, 20 nt, Artificial Sequence
  MKO10016355_A_Ephx1
  gRNA
cuuguagaagauccucgcag

SEQ ID NO: 16356 - RNA, 20 nt, Artificial Sequence
  MKO10016356_A_Ephx1
  gRNA
cgccuugaauguagaacuuc

SEQ ID NO: 16357 - RNA, 20 nt, Artificial Sequence
  MKO10016357_A_Ephx2
  gRNA
uccgucguccagccaguugu

SEQ ID NO: 16358 - RNA, 20 nt, Artificial Sequence
  MKO10016358_A_Ephx2
  gRNA
accauccccaugucacgggc

SEQ ID NO: 16359 - RNA, 20 nt, Artificial Sequence
  MKO10016359_A_Ephx2
  gRNA
cuugaucaucccaaccugac

SEQ ID NO: 16360 - RNA, 20 nt, Artificial Sequence
  MKO10016360_A_Ephx3
  gRNA
ggcucugaaacucucgcagc

SEQ ID NO: 16361 - RNA, 20 nt, Artificial Sequence
  MKO10016361_A_Ephx3
  gRNA
gcauccucgugagccacgac

SEQ ID NO: 16362 - RNA, 20 nt, Artificial Sequence
  MKO10016362_A_Ephx3
  gRNA
cacaccuuggaucacugaca

SEQ ID NO: 16363 - RNA, 20 nt, Artificial Sequence
  MKO10016363_A_Ephx4
  gRNA
gagaauuuaaaagcgaauac

SEQ ID NO: 16364 - RNA, 20 nt, Artificial Sequence
  MKO10016364_A_Ephx4
  gRNA
ccacauccaaguguauuuac

SEQ ID NO: 16365 - RNA, 20 nt, Artificial Sequence
  MKO10016365_A_Ephx4
  gRNA
acuggggaggcaugauugcc

SEQ ID NO: 16366 - RNA, 20 nt, Artificial Sequence
  MKO10016366_A_Epm2aip1
  gRNA
gaucggcgagaacuccggac

SEQ ID NO: 16367 - RNA, 20 nt, Artificial Sequence
  MKO10016367_A_Epm2aip1
  gRNA
cuacucgggaacgcgacgug

SEQ ID NO: 16368 - RNA, 20 nt, Artificial Sequence
  MKO10016368_A_Epm2aip1
  gRNA
ccgagcacgaauucuacgag

SEQ ID NO: 16369 - RNA, 20 nt, Artificial Sequence
  MKO10016369_A_Epm2a
  gRNA
cgggccgcguugacacguuc

SEQ ID NO: 16370 - RNA, 20 nt, Artificial Sequence
  MKO10016370_A_Epm2a
  gRNA
cauucuccagaagcgcgugc

SEQ ID NO: 16371 - RNA, 20 nt, Artificial Sequence
  MKO10016371_A_Epm2a
  gRNA
uguaccagaacgugucaacg

SEQ ID NO: 16372 - RNA, 20 nt, Artificial Sequence
  MKO10016372_A_Epn1
  gRNA
cgcccacgcgcucaagacca

SEQ ID NO: 16373 - RNA, 20 nt, Artificial Sequence
  MKO10016373_A_Epn1
  gRNA
uaggaagagcggauccgucg

SEQ ID NO: 16374 - RNA, 20 nt, Artificial Sequence
  MKO10016374_A_Epn1
  gRNA
uuccaguauguggaccguga

SEQ ID NO: 16375 - RNA, 20 nt, Artificial Sequence
  MKO10016375_A_Epn2
  gRNA
ucucucgaacguuaauaccc

SEQ ID NO: 16376 - RNA, 20 nt, Artificial Sequence
  MKO10016376_A_Epn2
  gRNA
cgagaacgcuaccacauugu

SEQ ID NO: 16377 - RNA, 20 nt, Artificial Sequence
  MKO10016377_A_Epn2
  gRNA
cacuccaggaagaacgccuc

SEQ ID NO: 16378 - RNA, 20 nt, Artificial Sequence
  MKO10016378_A_Epn3
  gRNA
cuuggccaugagucgcgaag

SEQ ID NO: 16379 - RNA, 20 nt, Artificial Sequence
  MKO10016379_A_Epn3
  gRNA
cccugucccguugacgacgu

SEQ ID NO: 16380 - RNA, 20 nt, Artificial Sequence
  MKO10016380_A_Epn3
  gRNA
auagcgcggggacgaagaug

SEQ ID NO: 16381 - RNA, 20 nt, Artificial Sequence
  MKO10016381_A_Epor
  gRNA
caugcgcgcucgaacagcga

SEQ ID NO: 16382 - RNA, 20 nt, Artificial Sequence
  MKO10016382_A_Epor
  gRNA
cuucgcuguucgagcgcgca

SEQ ID NO: 16383 - RNA, 20 nt, Artificial Sequence
  MKO10016383_A_Epor
  gRNA
agugcuccuggacgcccccg

SEQ ID NO: 16384 - RNA, 20 nt, Artificial Sequence
  MKO10016384_A_Epo
  gRNA
gucuacgccaacuuccuccg

SEQ ID NO: 16385 - RNA, 20 nt, Artificial Sequence
  MKO10016385_A_Epo
  gRNA
gaacucgacugucgcagaug

SEQ ID NO: 16386 - RNA, 20 nt, Artificial Sequence
  MKO10016386_A_Epo
  gRNA
caucugcgacagucgaguuc

SEQ ID NO: 16387 - RNA, 20 nt, Artificial Sequence
  MKO10016387_A_Eppin
  gRNA
guauggcuuacuuucgucgu

SEQ ID NO: 16388 - RNA, 20 nt, Artificial Sequence
  MKO10016388_A_Eppin
  gRNA
ugcagccugccgaaagacuc

SEQ ID NO: 16389 - RNA, 20 nt, Artificial Sequence
  MKO10016389_A_Eppin
  gRNA
uucacacuccucucugaauc

SEQ ID NO: 16390 - RNA, 20 nt, Artificial Sequence
  MKO10016390_A_Eppk1
  gRNA
gcaggcgacccgccuacuag

SEQ ID NO: 16391 - RNA, 20 nt, Artificial Sequence
  MKO10016391_A_Eppk1
  gRNA
cgcgccagccuugucacgac

SEQ ID NO: 16392 - RNA, 20 nt, Artificial Sequence
  MKO10016392_A_Eppk1
  gRNA
acagcgccgcggcuaccucg

SEQ ID NO: 16393 - RNA, 20 nt, Artificial Sequence
  MKO10016393_A_Eprs
  gRNA
cucuaguccacguuaaacgc

SEQ ID NO: 16394 - RNA, 20 nt, Artificial Sequence
  MKO10016394_A_Eprs
  gRNA
caaaguugucuucgugugau

SEQ ID NO: 16395 - RNA, 20 nt, Artificial Sequence
  MKO10016395_A_Eprs
  gRNA
agccaaaccagcguuuaacg

SEQ ID NO: 16396 - RNA, 20 nt, Artificial Sequence
  MKO10016396_A_Eps15l1
  gRNA
uuucuauguugcacugcgac

SEQ ID NO: 16397 - RNA, 20 nt, Artificial Sequence
  MKO10016397_A_Eps15l1
  gRNA
auacgagucuuauuacaagc

SEQ ID NO: 16398 - RNA, 20 nt, Artificial Sequence
  MKO10016398_A_Eps15l1
  gRNA
uuguaauaagacucguauaa

SEQ ID NO: 16399 - RNA, 20 nt, Artificial Sequence
  MKO10016399_A_Eps15
  gRNA
ccacaaagcguucuuguuaa

SEQ ID NO: 16400 - RNA, 20 nt, Artificial Sequence
  MKO10016400_A_Eps15
  gRNA
ccauuaacaagaacgcuuug

SEQ ID NO: 16401 - RNA, 20 nt, Artificial Sequence
  MKO10016401_A_Eps15
  gRNA
gcaccuacaagagucacaac

SEQ ID NO: 16402 - RNA, 20 nt, Artificial Sequence
  MKO10016402_A_Eps8l1
  gRNA
ugccaucguacgcugcgacg

SEQ ID NO: 16403 - RNA, 20 nt, Artificial Sequence
  MKO10016403_A_Eps8l1
  gRNA
caccgcgucgcagcguacga

SEQ ID NO: 16404 - RNA, 20 nt, Artificial Sequence
  MKO10016404_A_Eps8l1
  gRNA
cacgucagccauaaccacgg

SEQ ID NO: 16405 - RNA, 20 nt, Artificial Sequence
  MKO10016405_A_Eps8l2
  gRNA
cgacaagucacugcgacugc

SEQ ID NO: 16406 - RNA, 20 nt, Artificial Sequence
  MKO10016406_A_Eps8l2
  gRNA
gacuucacaguaucacgugc

SEQ ID NO: 16407 - RNA, 20 nt, Artificial Sequence
  MKO10016407_A_Eps8l2
  gRNA
cagguccuuugcgcucaucc

SEQ ID NO: 16408 - RNA, 20 nt, Artificial Sequence
  MKO10016408_A_Eps8l3
  gRNA
ggaacuggauucuuaccgcc

SEQ ID NO: 16409 - RNA, 20 nt, Artificial Sequence
  MKO10016409_A_Eps8l3
  gRNA
gcaucugaugacauguaagc

SEQ ID NO: 16410 - RNA, 20 nt, Artificial Sequence
  MKO10016410_A_Eps8l3
  gRNA
uguacccacagugcaccgga

SEQ ID NO: 16411 - RNA, 20 nt, Artificial Sequence
  MKO10016411_A_Eps8
  gRNA
aucuuuccgauccagcacga

SEQ ID NO: 16412 - RNA, 20 nt, Artificial Sequence
  MKO10016412_A_Eps8
  gRNA
uucuuacuuccacgcgguac

SEQ ID NO: 16413 - RNA, 20 nt, Artificial Sequence
  MKO10016413_A_Eps8
  gRNA
caaugcgagauuguguuuag

SEQ ID NO: 16414 - RNA, 20 nt, Artificial Sequence
  MKO10016414_A_Epsti1
  gRNA
gggaugaaucuauucgaauc

SEQ ID NO: 16415 - RNA, 20 nt, Artificial Sequence
  MKO10016415_A_Epsti1
  gRNA
ugccacucacccagccguug

SEQ ID NO: 16416 - RNA, 20 nt, Artificial Sequence
  MKO10016416_A_Epsti1
  gRNA
cagucuacuuggugccacaa

SEQ ID NO: 16417 - RNA, 20 nt, Artificial Sequence
  MKO10016417_A_Ept1
  gRNA
cggccucuuaccuagagugu

SEQ ID NO: 16418 - RNA, 20 nt, Artificial Sequence
  MKO10016418_A_Ept1
  gRNA
uccuuaacaguacagcgcuu

SEQ ID NO: 16419 - RNA, 20 nt, Artificial Sequence
  MKO10016419_A_Ept1
  gRNA
acaaaaacacugacgccagu

SEQ ID NO: 16420 - RNA, 20 nt, Artificial Sequence
  MKO10016420_A_Epx
  gRNA
aucaugcaacgucuucgcag

SEQ ID NO: 16421 - RNA, 20 nt, Artificial Sequence
  MKO10016421_A_Epx
  gRNA
agcggccugaaccacucuuc

SEQ ID NO: 16422 - RNA, 20 nt, Artificial Sequence
  MKO10016422_A_Epx
  gRNA
aacaaguaccgaaccauaac

SEQ ID NO: 16423 - RNA, 20 nt, Artificial Sequence
  MKO10016423_A_Epyc
  gRNA
gaucgauggcucuuccccac

SEQ ID NO: 16424 - RNA, 20 nt, Artificial Sequence
  MKO10016424_A_Epyc
  gRNA
cuauaucaccgauaacagcu

SEQ ID NO: 16425 - RNA, 20 nt, Artificial Sequence
  MKO10016425_A_Epyc
  gRNA
ugguacuuauacaaguacac

SEQ ID NO: 16426 - RNA, 20 nt, Artificial Sequence
  MKO10016426_A_Eqtn
  gRNA
gccagcaaaccaacugccag

SEQ ID NO: 16427 - RNA, 20 nt, Artificial Sequence
  MKO10016427_A_Eqtn
  gRNA
ugugacugccacaacuaacc

SEQ ID NO: 16428 - RNA, 20 nt, Artificial Sequence
  MKO10016428_A_Eqtn
  gRNA
gauaauauuguccaaaaugc

SEQ ID NO: 16429 - RNA, 20 nt, Artificial Sequence
  MKO10016429_A_Eral1
  gRNA
gcagauuccaugcucgucca

SEQ ID NO: 16430 - RNA, 20 nt, Artificial Sequence
  MKO10016430_A_Eral1
  gRNA
ccaucuggagcgcucuuugc

SEQ ID NO: 16431 - RNA, 20 nt, Artificial Sequence
  MKO10016431_A_Eral1
  gRNA
cucccaggaggaccacgcgg

SEQ ID NO: 16432 - RNA, 20 nt, Artificial Sequence
  MKO10016432_A_Erap1
  gRNA
ugcagcauccagagcauaau

SEQ ID NO: 16433 - RNA, 20 nt, Artificial Sequence
  MKO10016433_A_Erap1
  gRNA
aaaucaagccgauuaugcuc

SEQ ID NO: 16434 - RNA, 20 nt, Artificial Sequence
  MKO10016434_A_Erap1
  gRNA
uucuuuaucguauaacagag

SEQ ID NO: 16435 - RNA, 20 nt, Artificial Sequence
  MKO10016435_A_Eras
  gRNA
ucuugacgaccccucgucuc

SEQ ID NO: 16436 - RNA, 20 nt, Artificial Sequence
  MKO10016436_A_Eras
  gRNA
cuccacaccuugccgcgucu

SEQ ID NO: 16437 - RNA, 20 nt, Artificial Sequence
  MKO10016437_A_Eras
  gRNA
cauggucuuucacgaagcau

SEQ ID NO: 16438 - RNA, 20 nt, Artificial Sequence
  MKO10016438_A_Erbb2ip
  gRNA
gaauucuuaccagcuaauuu

SEQ ID NO: 16439 - RNA, 20 nt, Artificial Sequence
  MKO10016439_A_Erbb2ip
  gRNA
gaacuggaugucagcaaaaa

SEQ ID NO: 16440 - RNA, 20 nt, Artificial Sequence
  MKO10016440_A_Erbb2ip
  gRNA
uugcaaaucuuauuaaucuc

SEQ ID NO: 16441 - RNA, 20 nt, Artificial Sequence
  MKO10016441_A_Erbb2
  gRNA
cuuacaggcccgggaacgau

SEQ ID NO: 16442 - RNA, 20 nt, Artificial Sequence
  MKO10016442_A_Erbb2
  gRNA
gcuagacaaccgagacccuu

SEQ ID NO: 16443 - RNA, 20 nt, Artificial Sequence
  MKO10016443_A_Erbb2
  gRNA
acauggacaccaaucguucc

SEQ ID NO: 16444 - RNA, 20 nt, Artificial Sequence
  MKO10016444_A_Erbb3
  gRNA
ccccuugcagacuucgugac

SEQ ID NO: 16445 - RNA, 20 nt, Artificial Sequence
  MKO10016445_A_Erbb3
  gRNA
cggggaacccaggucuacga

SEQ ID NO: 16446 - RNA, 20 nt, Artificial Sequence
  MKO10016446_A_Erbb3
  gRNA
gcccuuaccuaaccuccgag

SEQ ID NO: 16447 - RNA, 20 nt, Artificial Sequence
  MKO10016447_A_Erbb4
  gRNA
agaauuuacgcauuauucgu

SEQ ID NO: 16448 - RNA, 20 nt, Artificial Sequence
  MKO10016448_A_Erbb4
  gRNA
caaguaacgaaacugguuga

SEQ ID NO: 16449 - RNA, 20 nt, Artificial Sequence
  MKO10016449_A_Erbb4
  gRNA
ucaccagcaucgagcacaac

SEQ ID NO: 16450 - RNA, 20 nt, Artificial Sequence
  MKO10016450_A_Erc1
  gRNA
cgagccgucgcguucucuca

SEQ ID NO: 16451 - RNA, 20 nt, Artificial Sequence
  MKO10016451_A_Erc1
  gRNA
ggagcaguaccgaguuguac

SEQ ID NO: 16452 - RNA, 20 nt, Artificial Sequence
  MKO10016452_A_Erc1
  gRNA
aagaccaugagagaacgcga

SEQ ID NO: 16453 - RNA, 20 nt, Artificial Sequence
  MKO10016453_A_Erc2
  gRNA
ccgaagaagccaacuucagc

SEQ ID NO: 16454 - RNA, 20 nt, Artificial Sequence
  MKO10016454_A_Erc2
  gRNA
ccuucauuucgaugacaguc

SEQ ID NO: 16455 - RNA, 20 nt, Artificial Sequence
  MKO10016455_A_Erc2
  gRNA
ggcuccaagcugagcacgac

SEQ ID NO: 16456 - RNA, 20 nt, Artificial Sequence
  MKO10016456_A_Ercc1
  gRNA
auagcaucaucgugagcccg

SEQ ID NO: 16457 - RNA, 20 nt, Artificial Sequence
  MKO10016457_A_Ercc1
  gRNA
gcguacucagcauacgucug

SEQ ID NO: 16458 - RNA, 20 nt, Artificial Sequence
  MKO10016458_A_Ercc1
  gRNA
cuucgcccuucgugugcugc

SEQ ID NO: 16459 - RNA, 20 nt, Artificial Sequence
  MKO10016459_A_Ercc2
  gRNA
cccguacgacuacaucuacc

SEQ ID NO: 16460 - RNA, 20 nt, Artificial Sequence
  MKO10016460_A_Ercc2
  gRNA
gccgccaggcucaacgugga

SEQ ID NO: 16461 - RNA, 20 nt, Artificial Sequence
  MKO10016461_A_Ercc2
  gRNA
ggcgagaagcugccguucuu

SEQ ID NO: 16462 - RNA, 20 nt, Artificial Sequence
  MKO10016462_A_Ercc3
  gRNA
augucgcuugaggaacgccg

SEQ ID NO: 16463 - RNA, 20 nt, Artificial Sequence
  MKO10016463_A_Ercc3
  gRNA
caacacugaccgcugcauag

SEQ ID NO: 16464 - RNA, 20 nt, Artificial Sequence
  MKO10016464_A_Ercc3
  gRNA
gaagacgaagacgacauucc

SEQ ID NO: 16465 - RNA, 20 nt, Artificial Sequence
  MKO10016465_A_Ercc4
  gRNA
ucgcuaugaagucuacacgc

SEQ ID NO: 16466 - RNA, 20 nt, Artificial Sequence
  MKO10016466_A_Ercc4
  gRNA
ucagacaauccgccauuacu

SEQ ID NO: 16467 - RNA, 20 nt, Artificial Sequence
  MKO10016467_A_Ercc4
  gRNA
caacaggcauccucguguac

SEQ ID NO: 16468 - RNA, 20 nt, Artificial Sequence
  MKO10016468_A_Ercc5
  gRNA
agcgccacccagucucacuc

SEQ ID NO: 16469 - RNA, 20 nt, Artificial Sequence
  MKO10016469_A_Ercc5
  gRNA
uucccccagauauuagcauu

SEQ ID NO: 16470 - RNA, 20 nt, Artificial Sequence
  MKO10016470_A_Ercc5
  gRNA
ggaucaaaaacaagcauugc

SEQ ID NO: 16471 - RNA, 20 nt, Artificial Sequence
  MKO10016471_A_Ercc6l2
  gRNA
gugaaguguaagguccgcau

SEQ ID NO: 16472 - RNA, 20 nt, Artificial Sequence
  MKO10016472_A_Ercc6l2
  gRNA
cuugcgagauuaccaaaggg

SEQ ID NO: 16473 - RNA, 20 nt, Artificial Sequence
  MKO10016473_A_Ercc6l2
  gRNA
ccucuacagacacuacauag

SEQ ID NO: 16474 - RNA, 20 nt, Artificial Sequence
  MKO10016474_A_Ercc6l
  gRNA
ugaaccuccuagcgcacugc

SEQ ID NO: 16475 - RNA, 20 nt, Artificial Sequence
  MKO10016475_A_Ercc6l
  gRNA
ugggccaaauuuagaucuac

SEQ ID NO: 16476 - RNA, 20 nt, Artificial Sequence
  MKO10016476_A_Ercc6l
  gRNA
ucuccacuuccgcuaagccu

SEQ ID NO: 16477 - RNA, 20 nt, Artificial Sequence
  MKO10016477_A_Ercc6
  gRNA
agcgaugccgaauuugacga

SEQ ID NO: 16478 - RNA, 20 nt, Artificial Sequence
  MKO10016478_A_Ercc6
  gRNA
guagccaggcgccaagacga

SEQ ID NO: 16479 - RNA, 20 nt, Artificial Sequence
  MKO10016479_A_Ercc6
  gRNA
guuauacuucugucgcuuca

SEQ ID NO: 16480 - RNA, 20 nt, Artificial Sequence
  MKO10016480_A_Ercc8
  gRNA
cgauguucacaaauacagcg

SEQ ID NO: 16481 - RNA, 20 nt, Artificial Sequence
  MKO10016481_A_Ercc8
  gRNA
cucgacauugagcccguuga

SEQ ID NO: 16482 - RNA, 20 nt, Artificial Sequence
  MKO10016482_A_Ercc8
  gRNA
auagaguacaaccacgccau

SEQ ID NO: 16483 - RNA, 20 nt, Artificial Sequence
  MKO10016483_A_Erdr1
  gRNA
gcguccguccguccguccag

SEQ ID NO: 16484 - RNA, 20 nt, Artificial Sequence
  MKO10016484_A_Erdr1
  gRNA
uggcagagacaucuugaccg

SEQ ID NO: 16485 - RNA, 20 nt, Artificial Sequence
  MKO10016485_A_Erdr1
  gRNA
gaguccguccguccguccug

SEQ ID NO: 16486 - RNA, 20 nt, Artificial Sequence
  MKO10016486_A_Ereg
  gRNA
gauggaagacgauccccgug

SEQ ID NO: 16487 - RNA, 20 nt, Artificial Sequence
  MKO10016487_A_Ereg
  gRNA
cgcaacguauucuuugcuca

SEQ ID NO: 16488 - RNA, 20 nt, Artificial Sequence
  MKO10016488_A_Ereg
  gRNA
uaaggcgguacaguuauccu

SEQ ID NO: 16489 - RNA, 20 nt, Artificial Sequence
  MKO10016489_A_Erf
  gRNA
gccgcuuaaagcgcaguuua

SEQ ID NO: 16490 - RNA, 20 nt, Artificial Sequence
  MKO10016490_A_Erf
  gRNA
gccagccccauaucgaugaa

SEQ ID NO: 16491 - RNA, 20 nt, Artificial Sequence
  MKO10016491_A_Erf
  gRNA
ggggaccccuuaccccacga

SEQ ID NO: 16492 - RNA, 20 nt, Artificial Sequence
  MKO10016492_A_Ergic1
  gRNA
cuacgucgaugacccagaca

SEQ ID NO: 16493 - RNA, 20 nt, Artificial Sequence
  MKO10016493_A_Ergic1
  gRNA
uucgcagguuugacaucuac

SEQ ID NO: 16494 - RNA, 20 nt, Artificial Sequence
  MKO10016494_A_Ergic1
  gRNA
augaagaucccgcugaauaa

SEQ ID NO: 16495 - RNA, 20 nt, Artificial Sequence
  MKO10016495_A_Ergic2
  gRNA
ucuaauagcauuuaccacua

SEQ ID NO: 16496 - RNA, 20 nt, Artificial Sequence
  MKO10016496_A_Ergic2
  gRNA
uauguggagacgucagccag

SEQ ID NO: 16497 - RNA, 20 nt, Artificial Sequence
  MKO10016497_A_Ergic2
  gRNA
gacgucuccacauagcuguc

SEQ ID NO: 16498 - RNA, 20 nt, Artificial Sequence
  MKO10016498_A_Ergic3
  gRNA
gauaauacugcaacuccgau

SEQ ID NO: 16499 - RNA, 20 nt, Artificial Sequence
  MKO10016499_A_Ergic3
  gRNA
guagcagcucucacagcgau

SEQ ID NO: 16500 - RNA, 20 nt, Artificial Sequence
  MKO10016500_A_Ergic3
  gRNA
caugagaaggccacugacga

SEQ ID NO: 16501 - RNA, 20 nt, Artificial Sequence
  MKO10016501_A_Erg
  gRNA
auaguaagacguccacaucg

SEQ ID NO: 16502 - RNA, 20 nt, Artificial Sequence
  MKO10016502_A_Erg
  gRNA
gacuuccgaugacguugaua

SEQ ID NO: 16503 - RNA, 20 nt, Artificial Sequence
  MKO10016503_A_Erg
  gRNA
ggccuugucaguugugagcg

SEQ ID NO: 16504 - RNA, 20 nt, Artificial Sequence
  MKO10016504_A_Erh
  gRNA
auacuuacaccagacagcug

SEQ ID NO: 16505 - RNA, 20 nt, Artificial Sequence
  MKO10016505_A_Erh
  gRNA
ucagcauaaguccugcccuc

SEQ ID NO: 16506 - RNA, 20 nt, Artificial Sequence
  MKO10016506_A_Erh
  gRNA
acagccuaccaagaggccag

SEQ ID NO: 16507 - RNA, 20 nt, Artificial Sequence
  MKO10016507_A_Eri1
  gRNA
uuguaucaaccggaugagua

SEQ ID NO: 16508 - RNA, 20 nt, Artificial Sequence
  MKO10016508_A_Eri1
  gRNA
cuaagguguguguauucaac

SEQ ID NO: 16509 - RNA, 20 nt, Artificial Sequence
  MKO10016509_A_Eri1
  gRNA
aagcagcgaugcagacuuga

SEQ ID NO: 16510 - RNA, 20 nt, Artificial Sequence
  MKO10016510_A_Eri2
  gRNA
uuaggcggcuuggauuaauu

SEQ ID NO: 16511 - RNA, 20 nt, Artificial Sequence
  MKO10016511_A_Eri2
  gRNA
uugacuuugagucuaccugc

SEQ ID NO: 16512 - RNA, 20 nt, Artificial Sequence
  MKO10016512_A_Eri2
  gRNA
uuacucaaucugcucccucc

SEQ ID NO: 16513 - RNA, 20 nt, Artificial Sequence
  MKO10016513_A_Eri3
  gRNA
cgagccgcucccgucuguaa

SEQ ID NO: 16514 - RNA, 20 nt, Artificial Sequence
  MKO10016514_A_Eri3
  gRNA
ccauugccgcgccaaagccg

SEQ ID NO: 16515 - RNA, 20 nt, Artificial Sequence
  MKO10016515_A_Eri3
  gRNA
guaagcuguggguggacuac

SEQ ID NO: 16516 - RNA, 20 nt, Artificial Sequence
  MKO10016516_A_Erich1
  gRNA
acaguguagagccgacguuc

SEQ ID NO: 16517 - RNA, 20 nt, Artificial Sequence
  MKO10016517_A_Erich1
  gRNA
accucagugacguuauugua

SEQ ID NO: 16518 - RNA, 20 nt, Artificial Sequence
  MKO10016518_A_Erich1
  gRNA
ucccgcggacgugcucaucc

SEQ ID NO: 16519 - RNA, 20 nt, Artificial Sequence
  MKO10016519_A_Erich2
  gRNA
ugucgaaauacugcccgaga

SEQ ID NO: 16520 - RNA, 20 nt, Artificial Sequence
  MKO10016520_A_Erich2
  gRNA
gcaguauuucgacagccgug

SEQ ID NO: 16521 - RNA, 20 nt, Artificial Sequence
  MKO10016521_A_Erich2
  gRNA
ccuggacaagacugaugugc

SEQ ID NO: 16522 - RNA, 20 nt, Artificial Sequence
  MKO10016522_A_Erlec1
  gRNA
ucuuagccaacauauuccca

SEQ ID NO: 16523 - RNA, 20 nt, Artificial Sequence
  MKO10016523_A_Erlec1
  gRNA
auacuuccacuugugacaag

SEQ ID NO: 16524 - RNA, 20 nt, Artificial Sequence
  MKO10016524_A_Erlec1
  gRNA
uuccaaaagcucucuuggau

SEQ ID NO: 16525 - RNA, 20 nt, Artificial Sequence
  MKO10016525_A_Erlin1
  gRNA
aauauguuggcuccuuaugc

SEQ ID NO: 16526 - RNA, 20 nt, Artificial Sequence
  MKO10016526_A_Erlin1
  gRNA
cuauauugaccgaauagaag

SEQ ID NO: 16527 - RNA, 20 nt, Artificial Sequence
  MKO10016527_A_Erlin1
  gRNA
ggagcuuaccuuguuccaca

SEQ ID NO: 16528 - RNA, 20 nt, Artificial Sequence
  MKO10016528_A_Erlin2
  gRNA
cugcagcguucauacucuuc

SEQ ID NO: 16529 - RNA, 20 nt, Artificial Sequence
  MKO10016529_A_Erlin2
  gRNA
cacauccuauaagucuguac

SEQ ID NO: 16530 - RNA, 20 nt, Artificial Sequence
  MKO10016530_A_Erlin2
  gRNA
gaagugaagaacguaccaug

SEQ ID NO: 16531 - RNA, 20 nt, Artificial Sequence
  MKO10016531_A_Ermap
  gRNA
cggacaccuaccucgcaccc

SEQ ID NO: 16532 - RNA, 20 nt, Artificial Sequence
  MKO10016532_A_Ermap
  gRNA
acaugguacucagcgagaug

SEQ ID NO: 16533 - RNA, 20 nt, Artificial Sequence
  MKO10016533_A_Ermap
  gRNA
gucuugcacuauccauaaug

SEQ ID NO: 16534 - RNA, 20 nt, Artificial Sequence
  MKO10016534_A_Ermard
  gRNA
uggagcguagguuacguuca

SEQ ID NO: 16535 - RNA, 20 nt, Artificial Sequence
  MKO10016535_A_Ermard
  gRNA
ugaccuggucagauacgcgu

SEQ ID NO: 16536 - RNA, 20 nt, Artificial Sequence
  MKO10016536_A_Ermard
  gRNA
uguccaugcuguucgugaua

SEQ ID NO: 16537 - RNA, 20 nt, Artificial Sequence
  MKO10016537_A_Ermn
  gRNA
cgaguacaacugaaaucgaa

SEQ ID NO: 16538 - RNA, 20 nt, Artificial Sequence
  MKO10016538_A_Ermn
  gRNA
gaaccucuucguuguucacc

SEQ ID NO: 16539 - RNA, 20 nt, Artificial Sequence
  MKO10016539_A_Ermn
  gRNA
guucaaccuuguaguaugcc

SEQ ID NO: 16540 - RNA, 20 nt, Artificial Sequence
  MKO10016540_A_Ermp1
  gRNA
uagcugccgaaacguaagcc

SEQ ID NO: 16541 - RNA, 20 nt, Artificial Sequence
  MKO10016541_A_Ermp1
  gRNA
cagugaugcucgaaguucuc

SEQ ID NO: 16542 - RNA, 20 nt, Artificial Sequence
  MKO10016542_A_Ermp1
  gRNA
gauucgagcauuuauuaacc

SEQ ID NO: 16543 - RNA, 20 nt, Artificial Sequence
  MKO10016543_A_Ern1
  gRNA
acucacucuuccacgugugu

SEQ ID NO: 16544 - RNA, 20 nt, Artificial Sequence
  MKO10016544_A_Ern1
  gRNA
cuuguuguuugucucgaccc

SEQ ID NO: 16545 - RNA, 20 nt, Artificial Sequence
  MKO10016545_A_Ern1
  gRNA
cuuggaggcaagaacaacga

SEQ ID NO: 16546 - RNA, 20 nt, Artificial Sequence
  MKO10016546_A_Ern2
  gRNA
gacaccaucagagcugcgac

SEQ ID NO: 16547 - RNA, 20 nt, Artificial Sequence
  MKO10016547_A_Ern2
  gRNA
acauacaggcugccgucagc

SEQ ID NO: 16548 - RNA, 20 nt, Artificial Sequence
  MKO10016548_A_Ern2
  gRNA
cauucuagguccagucuguc

SEQ ID NO: 16549 - RNA, 20 nt, Artificial Sequence
  MKO10016549_A_Ero1lb
  gRNA
gcgccaucaacagcacgcua

SEQ ID NO: 16550 - RNA, 20 nt, Artificial Sequence
  MKO10016550_A_Ero1lb
  gRNA
acucaccuuauuugaacgcc

SEQ ID NO: 16551 - RNA, 20 nt, Artificial Sequence
  MKO10016551_A_Ero1lb
  gRNA
uaaagccgggcguucaaaua

SEQ ID NO: 16552 - RNA, 20 nt, Artificial Sequence
  MKO10016552_A_Ero1l
  gRNA
guaguuauuaaacuuaucga

SEQ ID NO: 16553 - RNA, 20 nt, Artificial Sequence
  MKO10016553_A_Ero1l
  gRNA
ugugagcaagcugagcgacu

SEQ ID NO: 16554 - RNA, 20 nt, Artificial Sequence
  MKO10016554_A_Ero1l
  gRNA
cucgcagacuuaauuccauc

SEQ ID NO: 16555 - RNA, 20 nt, Artificial Sequence
  MKO10016555_A_Erp27
  gRNA
cccgucuuaccagucgaaag

SEQ ID NO: 16556 - RNA, 20 nt, Artificial Sequence
  MKO10016556_A_Erp27
  gRNA
uucacgugaacaaccuccac

SEQ ID NO: 16557 - RNA, 20 nt, Artificial Sequence
  MKO10016557_A_Erp27
  gRNA
uaccgaucgugucuguguuc

SEQ ID NO: 16558 - RNA, 20 nt, Artificial Sequence
  MKO10016558_A_Erp29
  gRNA
cggcagcggccuacacacga

SEQ ID NO: 16559 - RNA, 20 nt, Artificial Sequence
  MKO10016559_A_Erp29
  gRNA
gaagggcacccuucgugugu

SEQ ID NO: 16560 - RNA, 20 nt, Artificial Sequence
  MKO10016560_A_Erp29
  gRNA
ucucuaucagcuuaccgauc

SEQ ID NO: 16561 - RNA, 20 nt, Artificial Sequence
  MKO10016561_A_Erp44
  gRNA
caagcgcuuucacugaucgc

SEQ ID NO: 16562 - RNA, 20 nt, Artificial Sequence
  MKO10016562_A_Erp44
  gRNA
aagcgcuugcagacuacauc

SEQ ID NO: 16563 - RNA, 20 nt, Artificial Sequence
  MKO10016563_A_Erp44
  gRNA
gugcugaucacaaucaacuc

SEQ ID NO: 16564 - RNA, 20 nt, Artificial Sequence
  MKO10016564_A_Errfi1
  gRNA
gcgcaaacacuuauccuacg

SEQ ID NO: 16565 - RNA, 20 nt, Artificial Sequence
  MKO10016565_A_Errfi1
  gRNA
auaaguguuugcgcuucccg

SEQ ID NO: 16566 - RNA, 20 nt, Artificial Sequence
  MKO10016566_A_Errfi1
  gRNA
ucuccauaauggucaggccu

SEQ ID NO: 16567 - RNA, 20 nt, Artificial Sequence
  MKO10016567_A_Erv3
  gRNA
ccaaucaaccgaguugaguc

SEQ ID NO: 16568 - RNA, 20 nt, Artificial Sequence
  MKO10016568_A_Erv3
  gRNA
agcauucaacccgaggaauu

SEQ ID NO: 16569 - RNA, 20 nt, Artificial Sequence
  MKO10016569_A_Erv3
  gRNA
gcaaacucgcucagacugua

SEQ ID NO: 16570 - RNA, 20 nt, Artificial Sequence
  MKO10016570_A_Esam
  gRNA
cucccgugccaucguguacc

SEQ ID NO: 16571 - RNA, 20 nt, Artificial Sequence
  MKO10016571_A_Esam
  gRNA
ugccaagugcaacgugaccu

SEQ ID NO: 16572 - RNA, 20 nt, Artificial Sequence
  MKO10016572_A_Esam
  gRNA
cugaccugucaucacgucca

SEQ ID NO: 16573 - RNA, 20 nt, Artificial Sequence
  MKO10016573_A_Esco1
  gRNA
cagucaagcuaagauugaug

SEQ ID NO: 16574 - RNA, 20 nt, Artificial Sequence
  MKO10016574_A_Esco1
  gRNA
cagcauauguucagcaucug

SEQ ID NO: 16575 - RNA, 20 nt, Artificial Sequence
  MKO10016575_A_Esco1
  gRNA
aguacacugugcugcugauu

SEQ ID NO: 16576 - RNA, 20 nt, Artificial Sequence
  MKO10016576_A_Esco2
  gRNA
auugacucacaaugacgagc

SEQ ID NO: 16577 - RNA, 20 nt, Artificial Sequence
  MKO10016577_A_Esco2
  gRNA
cgaaaaaugcugcuccgccu

SEQ ID NO: 16578 - RNA, 20 nt, Artificial Sequence
  MKO10016578_A_Esco2
  gRNA
cuuaucaacuuccucucgag

SEQ ID NO: 16579 - RNA, 20 nt, Artificial Sequence
  MKO10016579_A_Esd
  gRNA
uacuuacgagggcugguauc

SEQ ID NO: 16580 - RNA, 20 nt, Artificial Sequence
  MKO10016580_A_Esd
  gRNA
cuagguggcugcaauaucaa

SEQ ID NO: 16581 - RNA, 20 nt, Artificial Sequence
  MKO10016581_A_Esd
  gRNA
aauguacucuuacgucaccg

SEQ ID NO: 16582 - RNA, 20 nt, Artificial Sequence
  MKO10016582_A_Esf1
  gRNA
aguuagauaaagacgcuccu

SEQ ID NO: 16583 - RNA, 20 nt, Artificial Sequence
  MKO10016583_A_Esf1
  gRNA
ucgacuagcaguuuguaaca

SEQ ID NO: 16584 - RNA, 20 nt, Artificial Sequence
  MKO10016584_A_Esf1
  gRNA
aguauuucaaucguuugaac

SEQ ID NO: 16585 - RNA, 20 nt, Artificial Sequence
  MKO10016585_A_Esm1
  gRNA
caccgcauauuuggcgcucc

SEQ ID NO: 16586 - RNA, 20 nt, Artificial Sequence
  MKO10016586_A_Esm1
  gRNA
caaauaugcgguggauugcc

SEQ ID NO: 16587 - RNA, 20 nt, Artificial Sequence
  MKO10016587_A_Esm1
  gRNA
cccugucacauaugcccgac

SEQ ID NO: 16588 - RNA, 20 nt, Artificial Sequence
  MKO10016588_A_Esp15
  gRNA
gaucuuaugaggauguuaag

SEQ ID NO: 16589 - RNA, 20 nt, Artificial Sequence
  MKO10016589_A_Esp15
  gRNA
uuauccaaacuauaagagau

SEQ ID NO: 16590 - RNA, 20 nt, Artificial Sequence
  MKO10016590_A_Esp15
  gRNA
uuuccaacaauacuucuuga

SEQ ID NO: 16591 - RNA, 20 nt, Artificial Sequence
  MKO10016591_A_Esp16
  gRNA
gaucuuaugaggaugucacg

SEQ ID NO: 16592 - RNA, 20 nt, Artificial Sequence
  MKO10016592_A_Esp16
  gRNA
uuugccaaacuauaagagau

SEQ ID NO: 16593 - RNA, 20 nt, Artificial Sequence
  MKO10016593_A_Esp16
  gRNA
aagaugagaaaauacaucag

SEQ ID NO: 16594 - RNA, 20 nt, Artificial Sequence
  MKO10016594_A_Esp18
  gRNA
gccuaguuaaacuuuauucg

SEQ ID NO: 16595 - RNA, 20 nt, Artificial Sequence
  MKO10016595_A_Esp18
  gRNA
cuauguuauuucuuauaguu

SEQ ID NO: 16596 - RNA, 20 nt, Artificial Sequence
  MKO10016596_A_Esp18
  gRNA
uuuaaacuuacccuuccuuc

SEQ ID NO: 16597 - RNA, 20 nt, Artificial Sequence
  MKO10016597_A_Esp1
  gRNA
cggagcaaaugucguucacu

SEQ ID NO: 16598 - RNA, 20 nt, Artificial Sequence
  MKO10016598_A_Esp1
  gRNA
ccuuggugaauuagacaagu

SEQ ID NO: 16599 - RNA, 20 nt, Artificial Sequence
  MKO10016599_A_Esp1
  gRNA
cugccauccaugaucacuga

SEQ ID NO: 16600 - RNA, 20 nt, Artificial Sequence
  MKO10016600_A_Esp23
  gRNA
ccuacaucuagaacuagaau

SEQ ID NO: 16601 - RNA, 20 nt, Artificial Sequence
  MKO10016601_A_Esp23
  gRNA
ccaauucuaguucuagaugu

SEQ ID NO: 16602 - RNA, 20 nt, Artificial Sequence
  MKO10016602_A_Esp23
  gRNA
cuacugucagugcucacuga

SEQ ID NO: 16603 - RNA, 20 nt, Artificial Sequence
  MKO10016603_A_Esp24
  gRNA
uucgacuuuagagucgauag

SEQ ID NO: 16604 - RNA, 20 nt, Artificial Sequence
  MKO10016604_A_Esp24
  gRNA
uaauuaguugucaacauacc

SEQ ID NO: 16605 - RNA, 20 nt, Artificial Sequence
  MKO10016605_A_Esp24
  gRNA
auuccuucagugagcauuga

SEQ ID NO: 16606 - RNA, 20 nt, Artificial Sequence
  MKO10016606_A_Esp31
  gRNA
uuagguucugaaaaacgauc

SEQ ID NO: 16607 - RNA, 20 nt, Artificial Sequence
  MKO10016607_A_Esp31
  gRNA
uuggaguaacagccuaguuu

SEQ ID NO: 16608 - RNA, 20 nt, Artificial Sequence
  MKO10016608_A_Esp31
  gRNA
uuaucaucaauguucaccga

SEQ ID NO: 16609 - RNA, 20 nt, Artificial Sequence
  MKO10016609_A_Esp34
  gRNA
caagaauucuuaaagaaugc

SEQ ID NO: 16610 - RNA, 20 nt, Artificial Sequence
  MKO10016610_A_Esp34
  gRNA
acuccuucagugaacauuga

SEQ ID NO: 16611 - RNA, 20 nt, Artificial Sequence
  MKO10016611_A_Esp34
  gRNA
ucuacuguagguucugaaaa

SEQ ID NO: 16612 - RNA, 20 nt, Artificial Sequence
  MKO10016612_A_Esp36
  gRNA
uuacuagaauguccaauuca

SEQ ID NO: 16613 - RNA, 20 nt, Artificial Sequence
  MKO10016613_A_Esp36
  gRNA
ccuaauacuauuccaugaau

SEQ ID NO: 16614 - RNA, 20 nt, Artificial Sequence
  MKO10016614_A_Esp36
  gRNA
cugccuucagugagcauuga

SEQ ID NO: 16615 - RNA, 20 nt, Artificial Sequence
  MKO10016615_A_Esp38
  gRNA
augucacgugucucagacca

SEQ ID NO: 16616 - RNA, 20 nt, Artificial Sequence
  MKO10016616_A_Esp38
  gRNA
ccuugagaucagcagauaua

SEQ ID NO: 16617 - RNA, 20 nt, Artificial Sequence
  MKO10016617_A_Esp38
  gRNA
gauguauuucuucaucauuc

SEQ ID NO: 16618 - RNA, 20 nt, Artificial Sequence
  MKO10016618_A_Esp3
  gRNA
uuaccauccaugcucaccga

SEQ ID NO: 16619 - RNA, 20 nt, Artificial Sequence
  MKO10016619_A_Esp3
  gRNA
cacccuuccuucggugagca

SEQ ID NO: 16620 - RNA, 20 nt, Artificial Sequence
  MKO10016620_A_Esp3
  gRNA
ucuugauccauagucuuagc

SEQ ID NO: 16621 - RNA, 20 nt, Artificial Sequence
  MKO10016621_A_Esp4
  gRNA
cuugcguguuucguucuccu

SEQ ID NO: 16622 - RNA, 20 nt, Artificial Sequence
  MKO10016622_A_Esp4
  gRNA
cauguugaccagaauuugcu

SEQ ID NO: 16623 - RNA, 20 nt, Artificial Sequence
  MKO10016623_A_Esp4
  gRNA
cugccauccaugcucacuga

SEQ ID NO: 16624 - RNA, 20 nt, Artificial Sequence
  MKO10016624_A_Esp5
  gRNA
uucuaaacgcaaagucaucg

SEQ ID NO: 16625 - RNA, 20 nt, Artificial Sequence
  MKO10016625_A_Esp5
  gRNA
cgcccucuaaccaaugaaag

SEQ ID NO: 16626 - RNA, 20 nt, Artificial Sequence
  MKO10016626_A_Esp5
  gRNA
gauaccuaguaaagucaucg

SEQ ID NO: 16627 - RNA, 20 nt, Artificial Sequence
  MKO10016627_A_Esp6-esp5
  gRNA
uucuaaacgcaaagucaucg

SEQ ID NO: 16628 - RNA, 20 nt, Artificial Sequence
  MKO10016628_A_Esp6-esp5
  gRNA
gauaccuaguaaagucaucg

SEQ ID NO: 16629 - RNA, 20 nt, Artificial Sequence
  MKO10016629_A_Esp6-esp5
  gRNA
cuuccaucagugugcauuga

SEQ ID NO: 16630 - RNA, 20 nt, Artificial Sequence
  MKO10016630_A_Esp6
  gRNA
aguggcugaauacguaccag

SEQ ID NO: 16631 - RNA, 20 nt, Artificial Sequence
  MKO10016631_A_Esp6
  gRNA
cuggguuaucgagcaaucuc

SEQ ID NO: 16632 - RNA, 20 nt, Artificial Sequence
  MKO10016632_A_Esp6
  gRNA
cugccauccaugcccacaga

SEQ ID NO: 16633 - RNA, 20 nt, Artificial Sequence
  MKO10016633_A_Esp8
  gRNA
cuaugaaguuucguucacau

SEQ ID NO: 16634 - RNA, 20 nt, Artificial Sequence
  MKO10016634_A_Esp8
  gRNA
ggcaggaaguguacucucua

SEQ ID NO: 16635 - RNA, 20 nt, Artificial Sequence
  MKO10016635_A_Esp8
  gRNA
caucaauuugcucugaagaa

SEQ ID NO: 16636 - RNA, 20 nt, Artificial Sequence
  MKO10016636_A_Espl1
  gRNA
gcaacuaaacgacaggcggu

SEQ ID NO: 16637 - RNA, 20 nt, Artificial Sequence
  MKO10016637_A_Espl1
  gRNA
ggcagcugucguacaaugcc

SEQ ID NO: 16638 - RNA, 20 nt, Artificial Sequence
  MKO10016638_A_Espl1
  gRNA
cuuuagucagaagcucuaug

SEQ ID NO: 16639 - RNA, 20 nt, Artificial Sequence
  MKO10016639_A_Espnl
  gRNA
cgacgugcgccugagagccc

SEQ ID NO: 16640 - RNA, 20 nt, Artificial Sequence
  MKO10016640_A_Espnl
  gRNA
ccggccgagacauuucccgc

SEQ ID NO: 16641 - RNA, 20 nt, Artificial Sequence
  MKO10016641_A_Espnl
  gRNA
uauacccaucuucaucccgc

SEQ ID NO: 16642 - RNA, 20 nt, Artificial Sequence
  MKO10016642_A_Espn
  gRNA
ugagcgaguccaccuccaca

SEQ ID NO: 16643 - RNA, 20 nt, Artificial Sequence
  MKO10016643_A_Espn
  gRNA
cgucguuccucgucuucuac

SEQ ID NO: 16644 - RNA, 20 nt, Artificial Sequence
  MKO10016644_A_Espn
  gRNA
ggcuucccuagcuugccccg

SEQ ID NO: 16645 - RNA, 20 nt, Artificial Sequence
  MKO10016645_A_Esr1
  gRNA
guaacacuugcgcagccgac

SEQ ID NO: 16646 - RNA, 20 nt, Artificial Sequence
  MKO10016646_A_Esr1
  gRNA
ggcauacggaaagaccgccg

SEQ ID NO: 16647 - RNA, 20 nt, Artificial Sequence
  MKO10016647_A_Esr1
  gRNA
ucugacaaucgacgccagaa

SEQ ID NO: 16648 - RNA, 20 nt, Artificial Sequence
  MKO10016648_A_Esr2
  gRNA
uuacuaguccaagcgccaag

SEQ ID NO: 16649 - RNA, 20 nt, Artificial Sequence
  MKO10016649_A_Esr2
  gRNA
caggcaaugcaccugcucgc

SEQ ID NO: 16650 - RNA, 20 nt, Artificial Sequence
  MKO10016650_A_Esr2
  gRNA
uugaucuccaugucuugcgu

SEQ ID NO: 16651 - RNA, 20 nt, Artificial Sequence
  MKO10016651_A_Esrp1
  gRNA
cucuuuccgaagaucgaaaa

SEQ ID NO: 16652 - RNA, 20 nt, Artificial Sequence
  MKO10016652_A_Esrp1
  gRNA
cucucccgauaucgacaagc

SEQ ID NO: 16653 - RNA, 20 nt, Artificial Sequence
  MKO10016653_A_Esrp1
  gRNA
agugacucugugucccgaua

SEQ ID NO: 16654 - RNA, 20 nt, Artificial Sequence
  MKO10016654_A_Esrp2
  gRNA
caagucgcuaguucgcgccg

SEQ ID NO: 16655 - RNA, 20 nt, Artificial Sequence
  MKO10016655_A_Esrp2
  gRNA
ccugaguccacaaugccgcg

SEQ ID NO: 16656 - RNA, 20 nt, Artificial Sequence
  MKO10016656_A_Esrp2
  gRNA
uaccauuggacccuucaagu

SEQ ID NO: 16657 - RNA, 20 nt, Artificial Sequence
  MKO10016657_A_Esrra
  gRNA
uguacuucugccguccgccg

SEQ ID NO: 16658 - RNA, 20 nt, Artificial Sequence
  MKO10016658_A_Esrra
  gRNA
guacguccugcugaaagcuc

SEQ ID NO: 16659 - RNA, 20 nt, Artificial Sequence
  MKO10016659_A_Esrra
  gRNA
ugcgacaccagagcguucac

SEQ ID NO: 16660 - RNA, 20 nt, Artificial Sequence
  MKO10016660_A_Esrrb
  gRNA
ccagccgucgcuuguacuuc

SEQ ID NO: 16661 - RNA, 20 nt, Artificial Sequence
  MKO10016661_A_Esrrb
  gRNA
gcgaguccagaccguuggcg

SEQ ID NO: 16662 - RNA, 20 nt, Artificial Sequence
  MKO10016662_A_Esrrb
  gRNA
cccgugccgcaagagcuacg

SEQ ID NO: 16663 - RNA, 20 nt, Artificial Sequence
  MKO10016663_A_Esrrg
  gRNA
guugacgcuguccgucaggg

SEQ ID NO: 16664 - RNA, 20 nt, Artificial Sequence
  MKO10016664_A_Esrrg
  gRNA
gggauccucuacgauggugc

SEQ ID NO: 16665 - RNA, 20 nt, Artificial Sequence
  MKO10016665_A_Esrrg
  gRNA
guccgucuugacagagugcg

SEQ ID NO: 16666 - RNA, 20 nt, Artificial Sequence
  MKO10016666_A_Esx1
  gRNA
guucgaaucccucggguucc

SEQ ID NO: 16667 - RNA, 20 nt, Artificial Sequence
  MKO10016667_A_Esx1
  gRNA
ccaaguggagacgacuucgg

SEQ ID NO: 16668 - RNA, 20 nt, Artificial Sequence
  MKO10016668_A_Esx1
  gRNA
ugcggcgaagacugagcaac

SEQ ID NO: 16669 - RNA, 20 nt, Artificial Sequence
  MKO10016669_A_Esyt1
  gRNA
aggugauguacagauugacg

SEQ ID NO: 16670 - RNA, 20 nt, Artificial Sequence
  MKO10016670_A_Esyt1
  gRNA
uugacgccaaugauucguaa

SEQ ID NO: 16671 - RNA, 20 nt, Artificial Sequence
  MKO10016671_A_Esyt1
  gRNA
cuuuagccauuacgaaucau

SEQ ID NO: 16672 - RNA, 20 nt, Artificial Sequence
  MKO10016672_A_Esyt2
  gRNA
gcauuugcuccacgcacagc

SEQ ID NO: 16673 - RNA, 20 nt, Artificial Sequence
  MKO10016673_A_Esyt2
  gRNA
accauagagccagcugugcg

SEQ ID NO: 16674 - RNA, 20 nt, Artificial Sequence
  MKO10016674_A_Esyt2
  gRNA
ccuuaacaccauugacucuc

SEQ ID NO: 16675 - RNA, 20 nt, Artificial Sequence
  MKO10016675_A_Esyt3
  gRNA
uaccuugacgccguucaccu

SEQ ID NO: 16676 - RNA, 20 nt, Artificial Sequence
  MKO10016676_A_Esyt3
  gRNA
ggacgccgcucacaccgccc

SEQ ID NO: 16677 - RNA, 20 nt, Artificial Sequence
  MKO10016677_A_Esyt3
  gRNA
gcguguggagugggccaaua

SEQ ID NO: 16678 - RNA, 20 nt, Artificial Sequence
  MKO10016678_A_Euaa1
  gRNA
guaaguuauacuuccacucg

SEQ ID NO: 16679 - RNA, 20 nt, Artificial Sequence
  MKO10016679_A_Euaa1
  gRNA
ugaagcaugccaucgguuag

SEQ ID NO: 16680 - RNA, 20 nt, Artificial Sequence
  MKO10016680_A_Euaa1
  gRNA
gccaguacaaaucgugaaaa

SEQ ID NO: 16681 - RNA, 20 nt, Artificial Sequence
  MKO10016681_A_Etf1
  gRNA
cgacaauaaguuucauacag

SEQ ID NO: 16682 - RNA, 20 nt, Artificial Sequence
  MKO10016682_A_Etf1
  gRNA
aaaauguuagcagacgaguu

SEQ ID NO: 16683 - RNA, 20 nt, Artificial Sequence
  MKO10016683_A_Etf1
  gRNA
caaagaccagauuucacgag

SEQ ID NO: 16684 - RNA, 20 nt, Artificial Sequence
  MKO10016684_A_Etfa
  gRNA
uuugugagaacuaucuaugc

SEQ ID NO: 16685 - RNA, 20 nt, Artificial Sequence
  MKO10016685_A_Etfa
  gRNA
agcucucaccuugucacacu

SEQ ID NO: 16686 - RNA, 20 nt, Artificial Sequence
  MKO10016686_A_Etfa
  gRNA
auuaaguuuggcagcuacuc

SEQ ID NO: 16687 - RNA, 20 nt, Artificial Sequence
  MKO10016687_A_Etfb
  gRNA
ggagaccauccgaacugcuc

SEQ ID NO: 16688 - RNA, 20 nt, Artificial Sequence
  MKO10016688_A_Etfb
  gRNA
cacacagauucggguaaagc

SEQ ID NO: 16689 - RNA, 20 nt, Artificial Sequence
  MKO10016689_A_Etfb
  gRNA
acgggaaauugacggggguc

SEQ ID NO: 16690 - RNA, 20 nt, Artificial Sequence
  MKO10016690_A_Etfdh
  gRNA
caucguacgccuaggacauc

SEQ ID NO: 16691 - RNA, 20 nt, Artificial Sequence
  MKO10016691_A_Etfdh
  gRNA
ggucuuccgaugaacaauca

SEQ ID NO: 16692 - RNA, 20 nt, Artificial Sequence
  MKO10016692_A_Etfdh
  gRNA
auaguuggugccggcccagc

SEQ ID NO: 16693 - RNA, 20 nt, Artificial Sequence
  MKO10016693_A_Ethe1
  gRNA
uacccggcucacgauuacca

SEQ ID NO: 16694 - RNA, 20 nt, Artificial Sequence
  MKO10016694_A_Ethe1
  gRNA
ucaccgugguaaucgugagc

SEQ ID NO: 16695 - RNA, 20 nt, Artificial Sequence
  MKO10016695_A_Ethe1
  gRNA
gggcucaagcuguuguacgc

SEQ ID NO: 16696 - RNA, 20 nt, Artificial Sequence
  MKO10016696_A_Etl4
  gRNA
uacucgcgcgagccuucccg

SEQ ID NO: 16697 - RNA, 20 nt, Artificial Sequence
  MKO10016697_A_Etl4
  gRNA
cgcgcgaguacgacugccuc

SEQ ID NO: 16698 - RNA, 20 nt, Artificial Sequence
  MKO10016698_A_Etl4
  gRNA
cacaugacgaaagccgugaa

SEQ ID NO: 16699 - RNA, 20 nt, Artificial Sequence
  MKO10016699_A_Etnk1
  gRNA
acuguuagucgaccgagacg

SEQ ID NO: 16700 - RNA, 20 nt, Artificial Sequence
  MKO10016700_A_Etnk1
  gRNA
gaaaaguuuccgcgugcugc

SEQ ID NO: 16701 - RNA, 20 nt, Artificial Sequence
  MKO10016701_A_Etnk1
  gRNA
caugcuauucaugcgcacaa

SEQ ID NO: 16702 - RNA, 20 nt, Artificial Sequence
  MKO10016702_A_Etnk2
  gRNA
ggacaugcgggacugcgugu

SEQ ID NO: 16703 - RNA, 20 nt, Artificial Sequence
  MKO10016703_A_Etnk2
  gRNA
gaugcaucguuauuucacgc

SEQ ID NO: 16704 - RNA, 20 nt, Artificial Sequence
  MKO10016704_A_Etnk2
  gRNA
agccgugugcucgcagcagu

SEQ ID NO: 16705 - RNA, 20 nt, Artificial Sequence
  MKO10016705_A_Etnppl
  gRNA
gaacugccgugccagacgua

SEQ ID NO: 16706 - RNA, 20 nt, Artificial Sequence
  MKO10016706_A_Etnppl
  gRNA
caucaaaauaaugcgagccc

SEQ ID NO: 16707 - RNA, 20 nt, Artificial Sequence
  MKO10016707_A_Etnppl
  gRNA
ugaucucaauuaaugacgac

SEQ ID NO: 16708 - RNA, 20 nt, Artificial Sequence
  MKO10016708_A_Etohi1
  gRNA
gagaguacagcuuucuacaa

SEQ ID NO: 16709 - RNA, 20 nt, Artificial Sequence
  MKO10016709_A_Etohi1
  gRNA
uauguguucguuugagucuu

SEQ ID NO: 16710 - RNA, 20 nt, Artificial Sequence
  MKO10016710_A_Etohi1
  gRNA
acuggguuuagguuacaguu

SEQ ID NO: 16711 - RNA, 20 nt, Artificial Sequence
  MKO10016711_A_Ets1
  gRNA
cagaaacccacguccgggac

SEQ ID NO: 16712 - RNA, 20 nt, Artificial Sequence
  MKO10016712_A_Ets1
  gRNA
cuuacugaugaaguaauccg

SEQ ID NO: 16713 - RNA, 20 nt, Artificial Sequence
  MKO10016713_A_Ets1
  gRNA
gagagucggcuugagaucga

SEQ ID NO: 16714 - RNA, 20 nt, Artificial Sequence
  MKO10016714_A_Ets2
  gRNA
caaaaggagcaacgacgucu

SEQ ID NO: 16715 - RNA, 20 nt, Artificial Sequence
  MKO10016715_A_Ets2
  gRNA
accucaacgcgguuccucau

SEQ ID NO: 16716 - RNA, 20 nt, Artificial Sequence
  MKO10016716_A_Ets2
  gRNA
caagacgucguugcuccuuu

SEQ ID NO: 16717 - RNA, 20 nt, Artificial Sequence
  MKO10016717_A_Etv1
  gRNA
aaaagugccuguacaauguc

SEQ ID NO: 16718 - RNA, 20 nt, Artificial Sequence
  MKO10016718_A_Etv1
  gRNA
cuucuuaccugacauuguac

SEQ ID NO: 16719 - RNA, 20 nt, Artificial Sequence
  MKO10016719_A_Etv1
  gRNA
ugcagcuuaccuguggucca

SEQ ID NO: 16720 - RNA, 20 nt, Artificial Sequence
  MKO10016720_A_Etv2
  gRNA
cgcggcuauugcccguccag

SEQ ID NO: 16721 - RNA, 20 nt, Artificial Sequence
  MKO10016721_A_Etv2
  gRNA
guucggacuacaccaccacg

SEQ ID NO: 16722 - RNA, 20 nt, Artificial Sequence
  MKO10016722_A_Etv2
  gRNA
ucacgaagacguaccuuucc

SEQ ID NO: 16723 - RNA, 20 nt, Artificial Sequence
  MKO10016723_A_Etv3
  gRNA
cuggacggaagaaccgcgag

SEQ ID NO: 16724 - RNA, 20 nt, Artificial Sequence
  MKO10016724_A_Etv3
  gRNA
cggcucuaccuuaauccgag

SEQ ID NO: 16725 - RNA, 20 nt, Artificial Sequence
  MKO10016725_A_Etv3
  gRNA
uucaucaacauucgcucgag

SEQ ID NO: 16726 - RNA, 20 nt, Artificial Sequence
  MKO10016726_A_Etv4
  gRNA
gagcuugggcgaagcgcuga

SEQ ID NO: 16727 - RNA, 20 nt, Artificial Sequence
  MKO10016727_A_Etv4
  gRNA
cuucugcgagccacgucucu

SEQ ID NO: 16728 - RNA, 20 nt, Artificial Sequence
  MKO10016728_A_Etv4
  gRNA
cggggucugugcggggacuc

SEQ ID NO: 16729 - RNA, 20 nt, Artificial Sequence
  MKO10016729_A_Etv5
  gRNA
cuuucagaaaucucgaucag

SEQ ID NO: 16730 - RNA, 20 nt, Artificial Sequence
  MKO10016730_A_Etv5
  gRNA
uagcaccaagagccugcucg

SEQ ID NO: 16731 - RNA, 20 nt, Artificial Sequence
  MKO10016731_A_Etv5
  gRNA
aaaagugccucuacaacuau

SEQ ID NO: 16732 - RNA, 20 nt, Artificial Sequence
  MKO10016732_A_Etv6
  gRNA
gcauggcgugcucuuccggu

SEQ ID NO: 16733 - RNA, 20 nt, Artificial Sequence
  MKO10016733_A_Etv6
  gRNA
gugaacaugaagcggagucg

SEQ ID NO: 16734 - RNA, 20 nt, Artificial Sequence
  MKO10016734_A_Etv6
  gRNA
cugacaggggguacguuucc

SEQ ID NO: 16735 - RNA, 20 nt, Artificial Sequence
  MKO10016735_A_Eva1a
  gRNA
gcagacaccgccgcuucgag

SEQ ID NO: 16736 - RNA, 20 nt, Artificial Sequence
  MKO10016736_A_Eva1a
  gRNA
aggagcgcgaacgaaucauc

SEQ ID NO: 16737 - RNA, 20 nt, Artificial Sequence
  MKO10016737_A_Eva1a
  gRNA
cguggccacugguuccgugc

SEQ ID NO: 16738 - RNA, 20 nt, Artificial Sequence
  MKO10016738_A_Eva1b
  gRNA
cacccuagagccggaagacg

SEQ ID NO: 16739 - RNA, 20 nt, Artificial Sequence
  MKO10016739_A_Eva1b
  gRNA
gggguccggggucgcgagcg

SEQ ID NO: 16740 - RNA, 20 nt, Artificial Sequence
  MKO10016740_A_Eva1b
  gRNA
cucaccucugaugugcgcau

SEQ ID NO: 16741 - RNA, 20 nt, Artificial Sequence
  MKO10016741_A_Eva1c
  gRNA
uccgcgcucaccgauuucuc

SEQ ID NO: 16742 - RNA, 20 nt, Artificial Sequence
  MKO10016742_A_Eva1c
  gRNA
ggcccugauucugcgccgau

SEQ ID NO: 16743 - RNA, 20 nt, Artificial Sequence
  MKO10016743_A_Eva1c
  gRNA
aacaucuacuccgccgccua

SEQ ID NO: 16744 - RNA, 20 nt, Artificial Sequence
  MKO10016744_A_Evc2
  gRNA
uucgaaagguugacugaugu

SEQ ID NO: 16745 - RNA, 20 nt, Artificial Sequence
  MKO10016745_A_Evc2
  gRNA
cuugcugugaaggagucgcc

SEQ ID NO: 16746 - RNA, 20 nt, Artificial Sequence
  MKO10016746_A_Evc2
  gRNA
ugucagcuacacagccucgc

SEQ ID NO: 16747 - RNA, 20 nt, Artificial Sequence
  MKO10016747_A_Evc
  gRNA
gcuguagguugaccgcaugc

SEQ ID NO: 16748 - RNA, 20 nt, Artificial Sequence
  MKO10016748_A_Evc
  gRNA
uguucauagccucuggccga

SEQ ID NO: 16749 - RNA, 20 nt, Artificial Sequence
  MKO10016749_A_Evc
  gRNA
gagugcucacccggaacuuc

SEQ ID NO: 16750 - RNA, 20 nt, Artificial Sequence
  MKO10016750_A_Evi2a-evi2b
  gRNA
cagaagccgucucagugcgc

SEQ ID NO: 16751 - RNA, 20 nt, Artificial Sequence
  MKO10016751_A_Evi2a-evi2b
  gRNA
gguguuucagugcggauuaa

SEQ ID NO: 16752 - RNA, 20 nt, Artificial Sequence
  MKO10016752_A_Evi2a-evi2b
  gRNA
ccgacacguuccugucuucg

SEQ ID NO: 16753 - RNA, 20 nt, Artificial Sequence
  MKO10016753_A_Evi2a
  gRNA
ggacugcugagucggacacu

SEQ ID NO: 16754 - RNA, 20 nt, Artificial Sequence
  MKO10016754_A_Evi2a
  gRNA
agaaagucaccguugcuccg

SEQ ID NO: 16755 - RNA, 20 nt, Artificial Sequence
  MKO10016755_A_Evi2a
  gRNA
gcacaccaggagauugcaau

SEQ ID NO: 16756 - RNA, 20 nt, Artificial Sequence
  MKO10016756_A_Evi2b
  gRNA
gacaacugaugcacgcuuug

SEQ ID NO: 16757 - RNA, 20 nt, Artificial Sequence
  MKO10016757_A_Evi2b
  gRNA
uauaauaguaccgauuaaua

SEQ ID NO: 16758 - RNA, 20 nt, Artificial Sequence
  MKO10016758_A_Evi2b
  gRNA
ucaguuguaacauauaacga

SEQ ID NO: 16759 - RNA, 20 nt, Artificial Sequence
  MKO10016759_A_Evi5l
  gRNA
uguauucgugcgacugaugc

SEQ ID NO: 16760 - RNA, 20 nt, Artificial Sequence
  MKO10016760_A_Evi5l
  gRNA
gccagacgauggcccgaaag

SEQ ID NO: 16761 - RNA, 20 nt, Artificial Sequence
  MKO10016761_A_Evi5l
  gRNA
auucauggagcgcauggacu

SEQ ID NO: 16762 - RNA, 20 nt, Artificial Sequence
  MKO10016762_A_Evi5
  gRNA
cccuuagguggcgacagaca

SEQ ID NO: 16763 - RNA, 20 nt, Artificial Sequence
  MKO10016763_A_Evi5
  gRNA
cguuggauuguugcugaugc

SEQ ID NO: 16764 - RNA, 20 nt, Artificial Sequence
  MKO10016764_A_Evi5
  gRNA
ucuuuaggcauacuccuuag

SEQ ID NO: 16765 - RNA, 20 nt, Artificial Sequence
  MKO10016765_A_Evl
  gRNA
auucugcaccugacgcugug

SEQ ID NO: 16766 - RNA, 20 nt, Artificial Sequence
  MKO10016766_A_Evl
  gRNA
cgagaugcccgucaggucua

SEQ ID NO: 16767 - RNA, 20 nt, Artificial Sequence
  MKO10016767_A_Evl
  gRNA
cuugaccccgaccacucuga

SEQ ID NO: 16768 - RNA, 20 nt, Artificial Sequence
  MKO10016768_A_Evpl
  gRNA
gccgcgccuugucuacaucc

SEQ ID NO: 16769 - RNA, 20 nt, Artificial Sequence
  MKO10016769_A_Evpl
  gRNA
cacacgcgcccagucgaccc

SEQ ID NO: 16770 - RNA, 20 nt, Artificial Sequence
  MKO10016770_A_Evpl
  gRNA
ucucaccaggaucggcagaa

SEQ ID NO: 16771 - RNA, 20 nt, Artificial Sequence
  MKO10016771_A_Evx1
  gRNA
ccagaugcgccgauaccgca

SEQ ID NO: 16772 - RNA, 20 nt, Artificial Sequence
  MKO10016772_A_Evx1
  gRNA
ucucugguccaacgccgcca

SEQ ID NO: 16773 - RNA, 20 nt, Artificial Sequence
  MKO10016773_A_Evx1
  gRNA
ggcgcacggacucggcgccu

SEQ ID NO: 16774 - RNA, 20 nt, Artificial Sequence
  MKO10016774_A_Evx2
  gRNA
ucgccgcaccugaucggcgc

SEQ ID NO: 16775 - RNA, 20 nt, Artificial Sequence
  MKO10016775_A_Evx2
  gRNA
acggcggguggcucggacuu

SEQ ID NO: 16776 - RNA, 20 nt, Artificial Sequence
  MKO10016776_A_Evx2
  gRNA
gcugcacuacuacccgcacg

SEQ ID NO: 16777 - RNA, 20 nt, Artificial Sequence
  MKO10016777_A_Ewsr1
  gRNA
cuguacgccugcggggcagu

SEQ ID NO: 16778 - RNA, 20 nt, Artificial Sequence
  MKO10016778_A_Ewsr1
  gRNA
caacagccaccgcaccuacc

SEQ ID NO: 16779 - RNA, 20 nt, Artificial Sequence
  MKO10016779_A_Ewsr1
  gRNA
ugcauaugcagucugcccgu

SEQ ID NO: 16780 - RNA, 20 nt, Artificial Sequence
  MKO10016780_A_Exd1
  gRNA
gaccucaaguacugcccguc

SEQ ID NO: 16781 - RNA, 20 nt, Artificial Sequence
  MKO10016781_A_Exd1
  gRNA
caccugacgggcaguacuug

SEQ ID NO: 16782 - RNA, 20 nt, Artificial Sequence
  MKO10016782_A_Exd1
  gRNA
ccgaagaacacuuucacccc

SEQ ID NO: 16783 - RNA, 20 nt, Artificial Sequence
  MKO10016783_A_Exd2
  gRNA
gacaucccauuccgaagcaa

SEQ ID NO: 16784 - RNA, 20 nt, Artificial Sequence
  MKO10016784_A_Exd2
  gRNA
aaaguacggaccaaaucaac

SEQ ID NO: 16785 - RNA, 20 nt, Artificial Sequence
  MKO10016785_A_Exd2
  gRNA
caauauauccaaaagcgucc

SEQ ID NO: 16786 - RNA, 20 nt, Artificial Sequence
  MKO10016786_A_Exo1
  gRNA
caauaaccccgauaucguga

SEQ ID NO: 16787 - RNA, 20 nt, Artificial Sequence
  MKO10016787_A_Exo1
  gRNA
ccacgaggcaauccacuccu

SEQ ID NO: 16788 - RNA, 20 nt, Artificial Sequence
  MKO10016788_A_Exo1
  gRNA
uaucaacaucacgcacgcca

SEQ ID NO: 16789 - RNA, 20 nt, Artificial Sequence
  MKO10016789_A_Exo5
  gRNA
ugacgcgcccuuccgacugu

SEQ ID NO: 16790 - RNA, 20 nt, Artificial Sequence
  MKO10016790_A_Exo5
  gRNA
uggcugaacucaagacacga

SEQ ID NO: 16791 - RNA, 20 nt, Artificial Sequence
  MKO10016791_A_Exo5
  gRNA
acuauguggacaucugcgag

SEQ ID NO: 16792 - RNA, 20 nt, Artificial Sequence
  MKO10016792_A_Exoc1
  gRNA
gaccacugaacgccccgugc

SEQ ID NO: 16793 - RNA, 20 nt, Artificial Sequence
  MKO10016793_A_Exoc1
  gRNA
cgaccacagcaaggucucgc

SEQ ID NO: 16794 - RNA, 20 nt, Artificial Sequence
  MKO10016794_A_Exoc1
  gRNA
acacucugauucucuccgcu

SEQ ID NO: 16795 - RNA, 20 nt, Artificial Sequence
  MKO10016795_A_Exoc2
  gRNA
cuccguccugcgaauccucu

SEQ ID NO: 16796 - RNA, 20 nt, Artificial Sequence
  MKO10016796_A_Exoc2
  gRNA
gugauucucuaugagauacc

SEQ ID NO: 16797 - RNA, 20 nt, Artificial Sequence
  MKO10016797_A_Exoc2
  gRNA
cagacauccauucugccgug

SEQ ID NO: 16798 - RNA, 20 nt, Artificial Sequence
  MKO10016798_A_Exoc3l4
  gRNA
cauagcgcgccgagcauagg

SEQ ID NO: 16799 - RNA, 20 nt, Artificial Sequence
  MKO10016799_A_Exoc3l4
  gRNA
cgccuaugcucggcgcgcua

SEQ ID NO: 16800 - RNA, 20 nt, Artificial Sequence
  MKO10016800_A_Exoc3l4
  gRNA
uggcgcuaucuccgcggagc

SEQ ID NO: 16801 - RNA, 20 nt, Artificial Sequence
  MKO10016801_A_Exoc3l
  gRNA
cgaggaguugcugcacgcua

SEQ ID NO: 16802 - RNA, 20 nt, Artificial Sequence
  MKO10016802_A_Exoc3l
  gRNA
gguagccuugcccgccgagu

SEQ ID NO: 16803 - RNA, 20 nt, Artificial Sequence
  MKO10016803_A_Exoc3l
  gRNA
aauacagcguaacuauuccc

SEQ ID NO: 16804 - RNA, 20 nt, Artificial Sequence
  MKO10016804_A_Exoc3
  gRNA
acugugacaacuagaaucga

SEQ ID NO: 16805 - RNA, 20 nt, Artificial Sequence
  MKO10016805_A_Exoc3
  gRNA
ccgccgggauccuaccuugc

SEQ ID NO: 16806 - RNA, 20 nt, Artificial Sequence
  MKO10016806_A_Exoc3
  gRNA
caaugcacugaaugacguca

SEQ ID NO: 16807 - RNA, 20 nt, Artificial Sequence
  MKO10016807_A_Exoc4
  gRNA
uaagcacguccugaaccuac

SEQ ID NO: 16808 - RNA, 20 nt, Artificial Sequence
  MKO10016808_A_Exoc4
  gRNA
cuucguaagcuguggauuga

SEQ ID NO: 16809 - RNA, 20 nt, Artificial Sequence
  MKO10016809_A_Exoc4
  gRNA
cagaacgcaucacuaacucg

SEQ ID NO: 16810 - RNA, 20 nt, Artificial Sequence
  MKO10016810_A_Exoc5
  gRNA
aauacauugaacgucucgug

SEQ ID NO: 16811 - RNA, 20 nt, Artificial Sequence
  MKO10016811_A_Exoc5
  gRNA
gccuaucgaaagguaacucc

SEQ ID NO: 16812 - RNA, 20 nt, Artificial Sequence
  MKO10016812_A_Exoc5
  gRNA
gccuccacugcacguugccu

SEQ ID NO: 16813 - RNA, 20 nt, Artificial Sequence
  MKO10016813_A_Exoc6b
  gRNA
cagcauuagcuuaucgacag

SEQ ID NO: 16814 - RNA, 20 nt, Artificial Sequence
  MKO10016814_A_Exoc6b
  gRNA
acugagcugcugaaaguacg

SEQ ID NO: 16815 - RNA, 20 nt, Artificial Sequence
  MKO10016815_A_Exoc6b
  gRNA
uccuauuaguguccgucacc

SEQ ID NO: 16816 - RNA, 20 nt, Artificial Sequence
  MKO10016816_A_Exoc6
  gRNA
agguuaccgauaccaaccga

SEQ ID NO: 16817 - RNA, 20 nt, Artificial Sequence
  MKO10016817_A_Exoc6
  gRNA
auaaacuucuugugugcguu

SEQ ID NO: 16818 - RNA, 20 nt, Artificial Sequence
  MKO10016818_A_Exoc6
  gRNA
uuacggaacuccucaaagua

SEQ ID NO: 16819 - RNA, 20 nt, Artificial Sequence
  MKO10016819_A_Exoc7
  gRNA
cuaccacguagccagcgaca

SEQ ID NO: 16820 - RNA, 20 nt, Artificial Sequence
  MKO10016820_A_Exoc7
  gRNA
gaugaucuucuccgugucgc

SEQ ID NO: 16821 - RNA, 20 nt, Artificial Sequence
  MKO10016821_A_Exoc7
  gRNA
gucguuuauccgagacagcc

SEQ ID NO: 16822 - RNA, 20 nt, Artificial Sequence
  MKO10016822_A_Exoc8
  gRNA
ccccgagagccgaaucuucc

SEQ ID NO: 16823 - RNA, 20 nt, Artificial Sequence
  MKO10016823_A_Exoc8
  gRNA
cccucucgagggacgcccgc

SEQ ID NO: 16824 - RNA, 20 nt, Artificial Sequence
  MKO10016824_A_Exoc8
  gRNA
gcucgcaagccuucgugcac

SEQ ID NO: 16825 - RNA, 20 nt, Artificial Sequence
  MKO10016825_A_Exog
  gRNA
ccacgcccugucuuacgauc

SEQ ID NO: 16826 - RNA, 20 nt, Artificial Sequence
  MKO10016826_A_Exog
  gRNA
aucgccgcgagucccugaga

SEQ ID NO: 16827 - RNA, 20 nt, Artificial Sequence
  MKO10016827_A_Exog
  gRNA
gacucgcggcgauuucugaa

SEQ ID NO: 16828 - RNA, 20 nt, Artificial Sequence
  MKO10016828_A_Exosc10
  gRNA
guccgccuagggcauguuac

SEQ ID NO: 16829 - RNA, 20 nt, Artificial Sequence
  MKO10016829_A_Exosc10
  gRNA
cgauaccaaugacgugauau

SEQ ID NO: 16830 - RNA, 20 nt, Artificial Sequence
  MKO10016830_A_Exosc10
  gRNA
ucauacucgucaccgaacug

SEQ ID NO: 16831 - RNA, 20 nt, Artificial Sequence
  MKO10016831_A_Exosc1
  gRNA
cuuuaccgcgccauucucgc

SEQ ID NO: 16832 - RNA, 20 nt, Artificial Sequence
  MKO10016832_A_Exosc1
  gRNA
ccggcagcggcaccuacacc

SEQ ID NO: 16833 - RNA, 20 nt, Artificial Sequence
  MKO10016833_A_Exosc1
  gRNA
ccggggaugcaguaccucac

SEQ ID NO: 16834 - RNA, 20 nt, Artificial Sequence
  MKO10016834_A_Exosc2
  gRNA
ggccaugagaggcuucuugc

SEQ ID NO: 16835 - RNA, 20 nt, Artificial Sequence
  MKO10016835_A_Exosc2
  gRNA
cucucauccaugaaccuacc

SEQ ID NO: 16836 - RNA, 20 nt, Artificial Sequence
  MKO10016836_A_Exosc2
  gRNA
agagaagcucauugcgucug

SEQ ID NO: 16837 - RNA, 20 nt, Artificial Sequence
  MKO10016837_A_Exosc3
  gRNA
gcacccgcauucaggcguaa

SEQ ID NO: 16838 - RNA, 20 nt, Artificial Sequence
  MKO10016838_A_Exosc3
  gRNA
aggcggcggcggcguuuacu

SEQ ID NO: 16839 - RNA, 20 nt, Artificial Sequence
  MKO10016839_A_Exosc3
  gRNA
ggcauagugaucgcuaaauc

SEQ ID NO: 16840 - RNA, 20 nt, Artificial Sequence
  MKO10016840_A_Exosc4
  gRNA
gcacgugcugucggacgaca

SEQ ID NO: 16841 - RNA, 20 nt, Artificial Sequence
  MKO10016841_A_Exosc4
  gRNA
uggcucggcuuacaucgagc

SEQ ID NO: 16842 - RNA, 20 nt, Artificial Sequence
  MKO10016842_A_Exosc4
  gRNA
caaacacgcccauccgcgcc

SEQ ID NO: 16843 - RNA, 20 nt, Artificial Sequence
  MKO10016843_A_Exosc5
  gRNA
uauuccugaccagccgcucg

SEQ ID NO: 16844 - RNA, 20 nt, Artificial Sequence
  MKO10016844_A_Exosc5
  gRNA
uuaccaggcagcccgaucuu

SEQ ID NO: 16845 - RNA, 20 nt, Artificial Sequence
  MKO10016845_A_Exosc5
  gRNA
uggagucuaugggccggccg

SEQ ID NO: 16846 - RNA, 20 nt, Artificial Sequence
  MKO10016846_A_Exosc6
  gRNA
gcgacgccggcgaccggaga

SEQ ID NO: 16847 - RNA, 20 nt, Artificial Sequence
  MKO10016847_A_Exosc6
  gRNA
cgcggcggaaaucgcagagc

SEQ ID NO: 16848 - RNA, 20 nt, Artificial Sequence
  MKO10016848_A_Exosc6
  gRNA
accggagcgacgaggauucg

SEQ ID NO: 16849 - RNA, 20 nt, Artificial Sequence
  MKO10016849_A_Exosc7
  gRNA
agccacggccauccacccga

SEQ ID NO: 16850 - RNA, 20 nt, Artificial Sequence
  MKO10016850_A_Exosc7
  gRNA
ccuccucgcccuucgaauuc

SEQ ID NO: 16851 - RNA, 20 nt, Artificial Sequence
  MKO10016851_A_Exosc7
  gRNA
aagcuggagaaaccgaauga

SEQ ID NO: 16852 - RNA, 20 nt, Artificial Sequence
  MKO10016852_A_Exosc8
  gRNA
ccaguagaugcccccgauag

SEQ ID NO: 16853 - RNA, 20 nt, Artificial Sequence
  MKO10016853_A_Exosc8
  gRNA
uuuaacgccacaaaugaccg

SEQ ID NO: 16854 - RNA, 20 nt, Artificial Sequence
  MKO10016854_A_Exosc8
  gRNA
cucaccgacauauccucuau

SEQ ID NO: 16855 - RNA, 20 nt, Artificial Sequence
  MKO10016855_A_Exosc9
  gRNA
caucaggaucucauucggaa

SEQ ID NO: 16856 - RNA, 20 nt, Artificial Sequence
  MKO10016856_A_Exosc9
  gRNA
gaaucucucuguguugucgc

SEQ ID NO: 16857 - RNA, 20 nt, Artificial Sequence
  MKO10016857_A_Exosc9
  gRNA
uuguuucuccgaaacucaau

SEQ ID NO: 16858 - RNA, 20 nt, Artificial Sequence
  MKO10016858_A_Exph5
  gRNA
agagcgguaugccuccgccc

SEQ ID NO: 16859 - RNA, 20 nt, Artificial Sequence
  MKO10016859_A_Exph5
  gRNA
cucauucagacgaccugcga

SEQ ID NO: 16860 - RNA, 20 nt, Artificial Sequence
  MKO10016860_A_Exph5
  gRNA
uaaaaccaccccuuacauau

SEQ ID NO: 16861 - RNA, 20 nt, Artificial Sequence
  MKO10016861_A_Ext1
  gRNA
caaucucucaucgccuauga

SEQ ID NO: 16862 - RNA, 20 nt, Artificial Sequence
  MKO10016862_A_Ext1
  gRNA
cgaugagagauugcuauuac

SEQ ID NO: 16863 - RNA, 20 nt, Artificial Sequence
  MKO10016863_A_Ext1
  gRNA
gacccaagccugcgaccacg

SEQ ID NO: 16864 - RNA, 20 nt, Artificial Sequence
  MKO10016864_A_Ext2
  gRNA
ggcagcgcuuucgcacggac

SEQ ID NO: 16865 - RNA, 20 nt, Artificial Sequence
  MKO10016865_A_Ext2
  gRNA
cgauuacccccaagugcugc

SEQ ID NO: 16866 - RNA, 20 nt, Artificial Sequence
  MKO10016866_A_Ext2
  gRNA
ggacaucgcucagcaccgcc

SEQ ID NO: 16867 - RNA, 20 nt, Artificial Sequence
  MKO10016867_A_Extl1
  gRNA
aguuauccauaccacccuag

SEQ ID NO: 16868 - RNA, 20 nt, Artificial Sequence
  MKO10016868_A_Extl1
  gRNA
cgcagggcgaggacccucga

SEQ ID NO: 16869 - RNA, 20 nt, Artificial Sequence
  MKO10016869_A_Extl1
  gRNA
uagccccccgggagcacucu

SEQ ID NO: 16870 - RNA, 20 nt, Artificial Sequence
  MKO10016870_A_Extl2
  gRNA
ccacauuccggaauacccgu

SEQ ID NO: 16871 - RNA, 20 nt, Artificial Sequence
  MKO10016871_A_Extl2
  gRNA
gcgucucaucgaucagcgcg

SEQ ID NO: 16872 - RNA, 20 nt, Artificial Sequence
  MKO10016872_A_Extl2
  gRNA
ugacacacucauuagugccc

SEQ ID NO: 16873 - RNA, 20 nt, Artificial Sequence
  MKO10016873_A_Extl3
  gRNA
ucccuggccgguaccaugcg

SEQ ID NO: 16874 - RNA, 20 nt, Artificial Sequence
  MKO10016874_A_Extl3
  gRNA
gaggugagcaucaucgucga

SEQ ID NO: 16875 - RNA, 20 nt, Artificial Sequence
  MKO10016875_A_Extl3
  gRNA
agaagcacgugaucgcauug

SEQ ID NO: 16876 - RNA, 20 nt, Artificial Sequence
  MKO10016876_A_Eya1
  gRNA
ccguacagcuaccagaugca

SEQ ID NO: 16877 - RNA, 20 nt, Artificial Sequence
  MKO10016877_A_Eya1
  gRNA
uacgccacguacccacagcc

SEQ ID NO: 16878 - RNA, 20 nt, Artificial Sequence
  MKO10016878_A_Eya1
  gRNA
cuguccaggcuguggguacg

SEQ ID NO: 16879 - RNA, 20 nt, Artificial Sequence
  MKO10016879_A_Eya2
  gRNA
cggaguuggguacgcuguau

SEQ ID NO: 16880 - RNA, 20 nt, Artificial Sequence
  MKO10016880_A_Eya2
  gRNA
cuauacagcguacccaacuc

SEQ ID NO: 16881 - RNA, 20 nt, Artificial Sequence
  MKO10016881_A_Eya2
  gRNA
aacggacugaccaacaccgc

SEQ ID NO: 16882 - RNA, 20 nt, Artificial Sequence
  MKO10016882_A_Eya3
  gRNA
ggugcaggcaccauagcacu

SEQ ID NO: 16883 - RNA, 20 nt, Artificial Sequence
  MKO10016883_A_Eya3
  gRNA
uugcagaugaaguggguauc

SEQ ID NO: 16884 - RNA, 20 nt, Artificial Sequence
  MKO10016884_A_Eya3
  gRNA
caguaccugguuugagaugc

SEQ ID NO: 16885 - RNA, 20 nt, Artificial Sequence
  MKO10016885_A_Eya4
  gRNA
agaguacugcugcgccgacc

SEQ ID NO: 16886 - RNA, 20 nt, Artificial Sequence
  MKO10016886_A_Eya4
  gRNA
aagcgcuccaucuccagucg

SEQ ID NO: 16887 - RNA, 20 nt, Artificial Sequence
  MKO10016887_A_Eya4
  gRNA
agugaguccacuaccacgac

SEQ ID NO: 16888 - RNA, 20 nt, Artificial Sequence
  MKO10016888_A_Ezh1
  gRNA
gagaccgcaucaacauaucc

SEQ ID NO: 16889 - RNA, 20 nt, Artificial Sequence
  MKO10016889_A_Ezh1
  gRNA
ucgacagcucaaacggcucc

SEQ ID NO: 16890 - RNA, 20 nt, Artificial Sequence
  MKO10016890_A_Ezh1
  gRNA
uucaccucgucacccaugua

SEQ ID NO: 16891 - RNA, 20 nt, Artificial Sequence
  MKO10016891_A_Ezh2
  gRNA
agaacuucaucccccauaua

SEQ ID NO: 16892 - RNA, 20 nt, Artificial Sequence
  MKO10016892_A_Ezh2
  gRNA
acacgcuuccgccaacaaac

SEQ ID NO: 16893 - RNA, 20 nt, Artificial Sequence
  MKO10016893_A_Ezh2
  gRNA
uuccaaucgucagaaaauuu

SEQ ID NO: 16894 - RNA, 20 nt, Artificial Sequence
  MKO10016894_A_Ezr
  gRNA
uguggcacgcggaacaccga

SEQ ID NO: 16895 - RNA, 20 nt, Artificial Sequence
  MKO10016895_A_Ezr
  gRNA
ggcaguagaucucgucgcug

SEQ ID NO: 16896 - RNA, 20 nt, Artificial Sequence
  MKO10016896_A_Ezr
  gRNA
cgucuggcaggucuccgcac

SEQ ID NO: 16897 - RNA, 20 nt, Artificial Sequence
  MKO10016897_A_F10
  gRNA
cgucguccucgaagauuuca

SEQ ID NO: 16898 - RNA, 20 nt, Artificial Sequence
  MKO10016898_A_F10
  gRNA
uuacacgugcaccugcucgg

SEQ ID NO: 16899 - RNA, 20 nt, Artificial Sequence
  MKO10016899_A_F10
  gRNA
ugccaucucgacacgcuccu

SEQ ID NO: 16900 - RNA, 20 nt, Artificial Sequence
  MKO10016900_A_F11r
  gRNA
gaaggugacucgguccgcau

SEQ ID NO: 16901 - RNA, 20 nt, Artificial Sequence
  MKO10016901_A_F11r
  gRNA
cacugcucaaucugacgucc

SEQ ID NO: 16902 - RNA, 20 nt, Artificial Sequence
  MKO10016902_A_F11r
  gRNA
cauaccagaucccccgacuu

SEQ ID NO: 16903 - RNA, 20 nt, Artificial Sequence
  MKO10016903_A_F11
  gRNA
aacaugacaggcgcgaucuc

SEQ ID NO: 16904 - RNA, 20 nt, Artificial Sequence
  MKO10016904_A_F11
  gRNA
cuucggaugauccuaccaaa

SEQ ID NO: 16905 - RNA, 20 nt, Artificial Sequence
  MKO10016905_A_F11
  gRNA
gccauugagcuucguuauug

SEQ ID NO: 16906 - RNA, 20 nt, Artificial Sequence
  MKO10016906_A_F12
  gRNA
cucuccuauaggcuccacca

SEQ ID NO: 16907 - RNA, 20 nt, Artificial Sequence
  MKO10016907_A_F12
  gRNA
uuacccacugugggcccauc

SEQ ID NO: 16908 - RNA, 20 nt, Artificial Sequence
  MKO10016908_A_F12
  gRNA
ucuuaccaggggcgggagcc

SEQ ID NO: 16909 - RNA, 20 nt, Artificial Sequence
  MKO10016909_A_F13a1
  gRNA
gaacggaaagucgcaccgac

SEQ ID NO: 16910 - RNA, 20 nt, Artificial Sequence
  MKO10016910_A_F13a1
  gRNA
ccucguaggucgcuacccuc

SEQ ID NO: 16911 - RNA, 20 nt, Artificial Sequence
  MKO10016911_A_F13a1
  gRNA
cccaucaaagucagccgagu

SEQ ID NO: 16912 - RNA, 20 nt, Artificial Sequence
  MKO10016912_A_F13b
  gRNA
cuggcuaugcaaccgaaagu

SEQ ID NO: 16913 - RNA, 20 nt, Artificial Sequence
  MKO10016913_A_F13b
  gRNA
ggucuucucaaccguccugc

SEQ ID NO: 16914 - RNA, 20 nt, Artificial Sequence
  MKO10016914_A_F13b
  gRNA
uuugaauguucucugcgucg

SEQ ID NO: 16915 - RNA, 20 nt, Artificial Sequence
  MKO10016915_A_F2rl1
  gRNA
ccgacucaucaucaccgugc

SEQ ID NO: 16916 - RNA, 20 nt, Artificial Sequence
  MKO10016916_A_F2rl1
  gRNA
ucggcagaggagcgcguuuc

SEQ ID NO: 16917 - RNA, 20 nt, Artificial Sequence
  MKO10016917_A_F2rl1
  gRNA
aggagaccgaggccgccaga

SEQ ID NO: 16918 - RNA, 20 nt, Artificial Sequence
  MKO10016918_A_F2rl2
  gRNA
cgcacgcgucaacgacaucg

SEQ ID NO: 16919 - RNA, 20 nt, Artificial Sequence
  MKO10016919_A_F2rl2
  gRNA
guugccguagaaaacaaccg

SEQ ID NO: 16920 - RNA, 20 nt, Artificial Sequence
  MKO10016920_A_F2rl2
  gRNA
gcccagcugcaaccaagaua

SEQ ID NO: 16921 - RNA, 20 nt, Artificial Sequence
  MKO10016921_A_F2rl3
  gRNA
aauuugcccggguagccucg

SEQ ID NO: 16922 - RNA, 20 nt, Artificial Sequence
  MKO10016922_A_F2rl3
  gRNA
cgcagugcacgggcccgcaa

SEQ ID NO: 16923 - RNA, 20 nt, Artificial Sequence
  MKO10016923_A_F2rl3
  gRNA
acgaugauguagagaguacc

SEQ ID NO: 16924 - RNA, 20 nt, Artificial Sequence
  MKO10016924_A_F2r
  gRNA
ggaucggauacaccaccgcc

SEQ ID NO: 16925 - RNA, 20 nt, Artificial Sequence
  MKO10016925_A_F2r
  gRNA
gggcgacgaucagcaagcgc

SEQ ID NO: 16926 - RNA, 20 nt, Artificial Sequence
  MKO10016926_A_F2r
  gRNA
acugauuggcaguucggguc

SEQ ID NO: 16927 - RNA, 20 nt, Artificial Sequence
  MKO10016927_A_F2
  gRNA
gguagcggcuccgccacagc

SEQ ID NO: 16928 - RNA, 20 nt, Artificial Sequence
  MKO10016928_A_F2
  gRNA
caaccuagagcgugagugcg

SEQ ID NO: 16929 - RNA, 20 nt, Artificial Sequence
  MKO10016929_A_F2
  gRNA
caguccaugaaagucucucg

SEQ ID NO: 16930 - RNA, 20 nt, Artificial Sequence
  MKO10016930_A_F3
  gRNA
ccucacagacgagaucguga

SEQ ID NO: 16931 - RNA, 20 nt, Artificial Sequence
  MKO10016931_A_F3
  gRNA
cucacccugcggcaagucuu

SEQ ID NO: 16932 - RNA, 20 nt, Artificial Sequence
  MKO10016932_A_F3
  gRNA
ccuucacgaucucgucugug

SEQ ID NO: 16933 - RNA, 20 nt, Artificial Sequence
  MKO10016933_A_F5
  gRNA
accacacguucccugccgag

SEQ ID NO: 16934 - RNA, 20 nt, Artificial Sequence
  MKO10016934_A_F5
  gRNA
auuucaacucgggucugauu

SEQ ID NO: 16935 - RNA, 20 nt, Artificial Sequence
  MKO10016935_A_F5
  gRNA
uuaccugaguugcuagaucg

SEQ ID NO: 16936 - RNA, 20 nt, Artificial Sequence
  MKO10016936_A_F7
  gRNA
cguaagacuugagaugaucc

SEQ ID NO: 16937 - RNA, 20 nt, Artificial Sequence
  MKO10016937_A_F7
  gRNA
cuacacgcuacagccagaug

SEQ ID NO: 16938 - RNA, 20 nt, Artificial Sequence
  MKO10016938_A_F7
  gRNA
aaggcgugccaacucacucc

SEQ ID NO: 16939 - RNA, 20 nt, Artificial Sequence
  MKO10016939_A_F830016B08Rik
  gRNA
ccuuaaucaggguauccacc

SEQ ID NO: 16940 - RNA, 20 nt, Artificial Sequence
  MKO10016940_A_F830016B08Rik
  gRNA
ugccacuacuccaaucuuga

SEQ ID NO: 16941 - RNA, 20 nt, Artificial Sequence
  MKO10016941_A_F830016B08Rik
  gRNA
cuuggucuguaaaguuaggc

SEQ ID NO: 16942 - RNA, 20 nt, Artificial Sequence
  MKO10016942_A_F830045P16Rik
  gRNA
cucugcauuacaaacucguc

SEQ ID NO: 16943 - RNA, 20 nt, Artificial Sequence
  MKO10016943_A_F830045P16Rik
  gRNA
uagcacugcgaucgucucac

SEQ ID NO: 16944 - RNA, 20 nt, Artificial Sequence
  MKO10016944_A_F830045P16Rik
  gRNA
guaagucccaucagaguuuc

SEQ ID NO: 16945 - RNA, 20 nt, Artificial Sequence
  MKO10016945_A_F8a
  gRNA
gugcgacgcgcgccaacgcu

SEQ ID NO: 16946 - RNA, 20 nt, Artificial Sequence
  MKO10016946_A_F8a
  gRNA
uguagucgcgcgccaacagc

SEQ ID NO: 16947 - RNA, 20 nt, Artificial Sequence
  MKO10016947_A_F8a
  gRNA
gcaugcguguaaauagcgcc

SEQ ID NO: 16948 - RNA, 20 nt, Artificial Sequence
  MKO10016948_A_F8
  gRNA
agcgaagagugcuauuugca

SEQ ID NO: 16949 - RNA, 20 nt, Artificial Sequence
  MKO10016949_A_F8
  gRNA
guuugcuagguccuaccauu

SEQ ID NO: 16950 - RNA, 20 nt, Artificial Sequence
  MKO10016950_A_F8
  gRNA
auacuagcagagcuccaaug

SEQ ID NO: 16951 - RNA, 20 nt, Artificial Sequence
  MKO10016951_A_F9
  gRNA
aaacuagaagaguuuguucg

SEQ ID NO: 16952 - RNA, 20 nt, Artificial Sequence
  MKO10016952_A_F9
  gRNA
cagaaguccugugaaccaac

SEQ ID NO: 16953 - RNA, 20 nt, Artificial Sequence
  MKO10016953_A_F9
  gRNA
cguccaaagagauauaauuc

SEQ ID NO: 16954 - RNA, 20 nt, Artificial Sequence
  MKO10016954_A_Fa2h
  gRNA
cuacuaccgaacccucaccc

SEQ ID NO: 16955 - RNA, 20 nt, Artificial Sequence
  MKO10016955_A_Fa2h
  gRNA
guucauaggccucuuugugc

SEQ ID NO: 16956 - RNA, 20 nt, Artificial Sequence
  MKO10016956_A_Fa2h
  gRNA
gagguuucugccaguccacc

SEQ ID NO: 16957 - RNA, 20 nt, Artificial Sequence
  MKO10016957_A_Faah
  gRNA
uuugaacgagggugugacau

SEQ ID NO: 16958 - RNA, 20 nt, Artificial Sequence
  MKO10016958_A_Faah
  gRNA
agccuacugggaaccgccuc

SEQ ID NO: 16959 - RNA, 20 nt, Artificial Sequence
  MKO10016959_A_Faah
  gRNA
gggacguuggugugcacaaa

SEQ ID NO: 16960 - RNA, 20 nt, Artificial Sequence
  MKO10016960_A_Fabp12
  gRNA
gcaaugguggaccagcuuca

SEQ ID NO: 16961 - RNA, 20 nt, Artificial Sequence
  MKO10016961_A_Fabp12
  gRNA
gaucuuagauaaugacuccu

SEQ ID NO: 16962 - RNA, 20 nt, Artificial Sequence
  MKO10016962_A_Fabp12
  gRNA
acuuccauguuccuugaagc

SEQ ID NO: 16963 - RNA, 20 nt, Artificial Sequence
  MKO10016963_A_Fabp1
  gRNA
gguccgcaaugaguucaccc

SEQ ID NO: 16964 - RNA, 20 nt, Artificial Sequence
  MKO10016964_A_Fabp1
  gRNA
aaguccgugacugaacucaa

SEQ ID NO: 16965 - RNA, 20 nt, Artificial Sequence
  MKO10016965_A_Fabp1
  gRNA
ccugcaggcagucgucaagc

SEQ ID NO: 16966 - RNA, 20 nt, Artificial Sequence
  MKO10016966_A_Fabp2
  gRNA
cguuccgucugcuagacugu

SEQ ID NO: 16967 - RNA, 20 nt, Artificial Sequence
  MKO10016967_A_Fabp2
  gRNA
ggagcugauugcuguccgag

SEQ ID NO: 16968 - RNA, 20 nt, Artificial Sequence
  MKO10016968_A_Fabp2
  gRNA
ggccaagcgauucuuuaaga

SEQ ID NO: 16969 - RNA, 20 nt, Artificial Sequence
  MKO10016969_A_Fabp3
  gRNA
aguugacgggaaacucaucc

SEQ ID NO: 16970 - RNA, 20 nt, Artificial Sequence
  MKO10016970_A_Fabp3
  gRNA
uccacagucacuggugacgc

SEQ ID NO: 16971 - RNA, 20 nt, Artificial Sequence
  MKO10016971_A_Fabp3
  gRNA
ucugacucaccuugaccuuc

SEQ ID NO: 16972 - RNA, 20 nt, Artificial Sequence
  MKO10016972_A_Fabp4
  gRNA
augaaaucaccgcagacgac

SEQ ID NO: 16973 - RNA, 20 nt, Artificial Sequence
  MKO10016973_A_Fabp4
  gRNA
gaauuccacgcccaguuuga

SEQ ID NO: 16974 - RNA, 20 nt, Artificial Sequence
  MKO10016974_A_Fabp4
  gRNA
ugcccuuucauaaacucuug

SEQ ID NO: 16975 - RNA, 20 nt, Artificial Sequence
  MKO10016975_A_Fabp5
  gRNA
ccaucccacaggaguaggac

SEQ ID NO: 16976 - RNA, 20 nt, Artificial Sequence
  MKO10016976_A_Fabp5
  gRNA
ucccaccauggccagucuua

SEQ ID NO: 16977 - RNA, 20 nt, Artificial Sequence
  MKO10016977_A_Fabp5
  gRNA
cccuucgagauccuuaagac

SEQ ID NO: 16978 - RNA, 20 nt, Artificial Sequence
  MKO10016978_A_Fabp6
  gRNA
ccuaugagcgcguaagcaag

SEQ ID NO: 16979 - RNA, 20 nt, Artificial Sequence
  MKO10016979_A_Fabp6
  gRNA
cacccacgaccuccgaaguc

SEQ ID NO: 16980 - RNA, 20 nt, Artificial Sequence
  MKO10016980_A_Fabp6
  gRNA
cuugaacuucuugcccccca

SEQ ID NO: 16981 - RNA, 20 nt, Artificial Sequence
  MKO10016981_A_Fabp7
  gRNA
cacguuucccacuugccuag

SEQ ID NO: 16982 - RNA, 20 nt, Artificial Sequence
  MKO10016982_A_Fabp7
  gRNA
uagaugcuuucugcgcaacc

SEQ ID NO: 16983 - RNA, 20 nt, Artificial Sequence
  MKO10016983_A_Fabp7
  gRNA
cuugccauccuuaauuucuc

SEQ ID NO: 16984 - RNA, 20 nt, Artificial Sequence
  MKO10016984_A_Fabp9
  gRNA
uugaaacuaauacuaacgcu

SEQ ID NO: 16985 - RNA, 20 nt, Artificial Sequence
  MKO10016985_A_Fabp9
  gRNA
gaucauugacccaccuucaa

SEQ ID NO: 16986 - RNA, 20 nt, Artificial Sequence
  MKO10016986_A_Fabp9
  gRNA
uagagccuuauaaccuuuga

SEQ ID NO: 16987 - RNA, 20 nt, Artificial Sequence
  MKO10016987_A_Fadd
  gRNA
ccgcagcgccuuaaccaguc

SEQ ID NO: 16988 - RNA, 20 nt, Artificial Sequence
  MKO10016988_A_Fadd
  gRNA
uagaucgugucggcgcagcg

SEQ ID NO: 16989 - RNA, 20 nt, Artificial Sequence
  MKO10016989_A_Fadd
  gRNA
ccggacugguuaaggcgcug

SEQ ID NO: 16990 - RNA, 20 nt, Artificial Sequence
  MKO10016990_A_Fads1
  gRNA
gcgggccacaguagagcgaa

SEQ ID NO: 16991 - RNA, 20 nt, Artificial Sequence
  MKO10016991_A_Fads1
  gRNA
uguagggggcccccgccagc

SEQ ID NO: 16992 - RNA, 20 nt, Artificial Sequence
  MKO10016992_A_Fads1
  gRNA
ucgaggugccaaagacugac

SEQ ID NO: 16993 - RNA, 20 nt, Artificial Sequence
  MKO10016993_A_Fads2
  gRNA
agccagugccgaaguacgag

SEQ ID NO: 16994 - RNA, 20 nt, Artificial Sequence
  MKO10016994_A_Fads2
  gRNA
acaugcaggcucuuuauguc

SEQ ID NO: 16995 - RNA, 20 nt, Artificial Sequence
  MKO10016995_A_Fads2
  gRNA
caaggggcugccacucgcca

SEQ ID NO: 16996 - RNA, 20 nt, Artificial Sequence
  MKO10016996_A_Fads3
  gRNA
uguggcccagcaguucguga

SEQ ID NO: 16997 - RNA, 20 nt, Artificial Sequence
  MKO10016997_A_Fads3
  gRNA
cucggaaguccucgaucagc

SEQ ID NO: 16998 - RNA, 20 nt, Artificial Sequence
  MKO10016998_A_Fads3
  gRNA
aguggcggaaauuccaccag

SEQ ID NO: 16999 - RNA, 20 nt, Artificial Sequence
  MKO10016999_A_Fads6
  gRNA
gguccccaucauaacgccgc

SEQ ID NO: 17000 - RNA, 20 nt, Artificial Sequence
  MKO10017000_A_Fads6
  gRNA
ccauuauacacucaccguca

SEQ ID NO: 17001 - RNA, 20 nt, Artificial Sequence
  MKO10017001_A_Fads6
  gRNA
aucgcccagacccaccacgu

SEQ ID NO: 17002 - RNA, 20 nt, Artificial Sequence
  MKO10017002_A_Faf1
  gRNA
uucgaccuguaaugccaucc

SEQ ID NO: 17003 - RNA, 20 nt, Artificial Sequence
  MKO10017003_A_Faf1
  gRNA
cugccuuucuacaaucugcc

SEQ ID NO: 17004 - RNA, 20 nt, Artificial Sequence
  MKO10017004_A_Faf1
  gRNA
ucauugcaggcagcuauuaa

SEQ ID NO: 17005 - RNA, 20 nt, Artificial Sequence
  MKO10017005_A_Faf2
  gRNA
ugaccuggcuguacguuccc

SEQ ID NO: 17006 - RNA, 20 nt, Artificial Sequence
  MKO10017006_A_Faf2
  gRNA
gugacccggcugcgaggguc

SEQ ID NO: 17007 - RNA, 20 nt, Artificial Sequence
  MKO10017007_A_Faf2
  gRNA
uauaucaaguaucguguaau

SEQ ID NO: 17008 - RNA, 20 nt, Artificial Sequence
  MKO10017008_A_Fahd1
  gRNA
cguacgcgguggacggcuuc

SEQ ID NO: 17009 - RNA, 20 nt, Artificial Sequence
  MKO10017009_A_Fahd1
  gRNA
guccaccgcguacgcucccg

SEQ ID NO: 17010 - RNA, 20 nt, Artificial Sequence
  MKO10017010_A_Fahd1
  gRNA
gggcaagaauaucgucugcg

SEQ ID NO: 17011 - RNA, 20 nt, Artificial Sequence
  MKO10017011_A_Fahd2a
  gRNA
gucgagauggccguggucau

SEQ ID NO: 17012 - RNA, 20 nt, Artificial Sequence
  MKO10017012_A_Fahd2a
  gRNA
accugugaccgagggaugac

SEQ ID NO: 17013 - RNA, 20 nt, Artificial Sequence
  MKO10017013_A_Fahd2a
  gRNA
aagaucugcugucgagugaa

SEQ ID NO: 17014 - RNA, 20 nt, Artificial Sequence
  MKO10017014_A_Fah
  gRNA
agaaugcgcuguugccaaau

SEQ ID NO: 17015 - RNA, 20 nt, Artificial Sequence
  MKO10017015_A_Fah
  gRNA
ccgauggcuacaccaauccg

SEQ ID NO: 17016 - RNA, 20 nt, Artificial Sequence
  MKO10017016_A_Fah
  gRNA
uaggacucaccuaugguagc

SEQ ID NO: 17017 - RNA, 20 nt, Artificial Sequence
  MKO10017017_A_Faim2
  gRNA
uaugaaggugguuuccccgc

SEQ ID NO: 17018 - RNA, 20 nt, Artificial Sequence
  MKO10017018_A_Faim2
  gRNA
ucaggucuauaccauccuau

SEQ ID NO: 17019 - RNA, 20 nt, Artificial Sequence
  MKO10017019_A_Faim2
  gRNA
cucauaggaggguggcgccg

SEQ ID NO: 17020 - RNA, 20 nt, Artificial Sequence
  MKO10017020_A_Faim3
  gRNA
cggccaaggacacgccacca

SEQ ID NO: 17021 - RNA, 20 nt, Artificial Sequence
  MKO10017021_A_Faim3
  gRNA
cacucccucaacuacacgua

SEQ ID NO: 17022 - RNA, 20 nt, Artificial Sequence
  MKO10017022_A_Faim3
  gRNA
gagugggcauucgaugauaa

SEQ ID NO: 17023 - RNA, 20 nt, Artificial Sequence
  MKO10017023_A_Faim
  gRNA
cucguaugcgaagccacuua

SEQ ID NO: 17024 - RNA, 20 nt, Artificial Sequence
  MKO10017024_A_Faim
  gRNA
ugacggaucucguagcuguu

SEQ ID NO: 17025 - RNA, 20 nt, Artificial Sequence
  MKO10017025_A_Faim
  gRNA
cuucgcauacgaguacacgc

SEQ ID NO: 17026 - RNA, 20 nt, Artificial Sequence
  MKO10017026_A_Fam101a
  gRNA
cggugcggggacccuacgcc

SEQ ID NO: 17027 - RNA, 20 nt, Artificial Sequence
  MKO10017027_A_Fam101a
  gRNA
guagcuccgccaggugcagu

SEQ ID NO: 17028 - RNA, 20 nt, Artificial Sequence
  MKO10017028_A_Fam101a
  gRNA
uacuuaccggauuucaugug

SEQ ID NO: 17029 - RNA, 20 nt, Artificial Sequence
  MKO10017029_A_Fam101b
  gRNA
ggggagcgcgcuccggucgc

SEQ ID NO: 17030 - RNA, 20 nt, Artificial Sequence
  MKO10017030_A_Fam101b
  gRNA
gaaaaaaggcgacggcgucc

SEQ ID NO: 17031 - RNA, 20 nt, Artificial Sequence
  MKO10017031_A_Fam101b
  gRNA
gcugaggaaacgcgcgggcu

SEQ ID NO: 17032 - RNA, 20 nt, Artificial Sequence
  MKO10017032_A_Fam102a
  gRNA
acuguguacgauggcggaag

SEQ ID NO: 17033 - RNA, 20 nt, Artificial Sequence
  MKO10017033_A_Fam102a
  gRNA
cgacaccaagaauacccgcc

SEQ ID NO: 17034 - RNA, 20 nt, Artificial Sequence
  MKO10017034_A_Fam102a
  gRNA
ugacacucacgucuugaaac

SEQ ID NO: 17035 - RNA, 20 nt, Artificial Sequence
  MKO10017035_A_Fam102b
  gRNA
uaccacccgccgcuguuuac

SEQ ID NO: 17036 - RNA, 20 nt, Artificial Sequence
  MKO10017036_A_Fam102b
  gRNA
augagcgccagcgccuccac

SEQ ID NO: 17037 - RNA, 20 nt, Artificial Sequence
  MKO10017037_A_Fam102b
  gRNA
ugcaagcaaauuguguucac

SEQ ID NO: 17038 - RNA, 20 nt, Artificial Sequence
  MKO10017038_A_Fam103a1
  gRNA
accaguugccucuauuucuu

SEQ ID NO: 17039 - RNA, 20 nt, Artificial Sequence
  MKO10017039_A_Fam103a1
  gRNA
gaaagaugacaaagaauacc

SEQ ID NO: 17040 - RNA, 20 nt, Artificial Sequence
  MKO10017040_A_Fam103a1
  gRNA
uucugucaauaguaaccaua

SEQ ID NO: 17041 - RNA, 20 nt, Artificial Sequence
  MKO10017041_A_Fam104a
  gRNA
ccgcgccgacagcgaacagu

SEQ ID NO: 17042 - RNA, 20 nt, Artificial Sequence
  MKO10017042_A_Fam104a
  gRNA
cagcuccgacuguucgcugu

SEQ ID NO: 17043 - RNA, 20 nt, Artificial Sequence
  MKO10017043_A_Fam104a
  gRNA
ccggaggagcaucaugucgg

SEQ ID NO: 17044 - RNA, 20 nt, Artificial Sequence
  MKO10017044_A_Fam105a
  gRNA
ccccgcgugccagacugaug

SEQ ID NO: 17045 - RNA, 20 nt, Artificial Sequence
  MKO10017045_A_Fam105a
  gRNA
uuggcuuguaacuaguaucc

SEQ ID NO: 17046 - RNA, 20 nt, Artificial Sequence
  MKO10017046_A_Fam105a
  gRNA
gaugcccuaaguauaaauac

SEQ ID NO: 17047 - RNA, 20 nt, Artificial Sequence
  MKO10017047_A_Fam105b
  gRNA
agcugauaaacaaguauacc

SEQ ID NO: 17048 - RNA, 20 nt, Artificial Sequence
  MKO10017048_A_Fam105b
  gRNA
gugcacaguaguuaucacca

SEQ ID NO: 17049 - RNA, 20 nt, Artificial Sequence
  MKO10017049_A_Fam105b
  gRNA
gucaaaccuucuuccuuagc

SEQ ID NO: 17050 - RNA, 20 nt, Artificial Sequence
  MKO10017050_A_Fam107a
  gRNA
gaguucuagagcaccgucgc

SEQ ID NO: 17051 - RNA, 20 nt, Artificial Sequence
  MKO10017051_A_Fam107a
  gRNA
ucaguguggugauucugcgu

SEQ ID NO: 17052 - RNA, 20 nt, Artificial Sequence
  MKO10017052_A_Fam107a
  gRNA
cgaugucagcccgcucccuc

SEQ ID NO: 17053 - RNA, 20 nt, Artificial Sequence
  MKO10017053_A_Fam107b
  gRNA
uucuggggccuaauuagcuc

SEQ ID NO: 17054 - RNA, 20 nt, Artificial Sequence
  MKO10017054_A_Fam107b
  gRNA
augacaauccugagcuaauu

SEQ ID NO: 17055 - RNA, 20 nt, Artificial Sequence
  MKO10017055_A_Fam107b
  gRNA
ucagaagaagaaauccgacc

SEQ ID NO: 17056 - RNA, 20 nt, Artificial Sequence
  MKO10017056_A_Fam109a
  gRNA
ccgaucccggccguacgugc

SEQ ID NO: 17057 - RNA, 20 nt, Artificial Sequence
  MKO10017057_A_Fam109a
  gRNA
gcccagcugcaugcgcgaua

SEQ ID NO: 17058 - RNA, 20 nt, Artificial Sequence
  MKO10017058_A_Fam109a
  gRNA
cuuacccgccaacccgagcc

SEQ ID NO: 17059 - RNA, 20 nt, Artificial Sequence
  MKO10017059_A_Fam109b
  gRNA
ggcaucaaagcgaauagcga

SEQ ID NO: 17060 - RNA, 20 nt, Artificial Sequence
  MKO10017060_A_Fam109b
  gRNA
ucaaaucccgaccuauuggc

SEQ ID NO: 17061 - RNA, 20 nt, Artificial Sequence
  MKO10017061_A_Fam109b
  gRNA
gcuauucgcuuugaugcccc

SEQ ID NO: 17062 - RNA, 20 nt, Artificial Sequence
  MKO10017062_A_Fam110a
  gRNA
ucggcgcaccgcgacaguac

SEQ ID NO: 17063 - RNA, 20 nt, Artificial Sequence
  MKO10017063_A_Fam110a
  gRNA
uccgccacccaguacugucg

SEQ ID NO: 17064 - RNA, 20 nt, Artificial Sequence
  MKO10017064_A_Fam110a
  gRNA
gcgcucacucaaguccgacu

SEQ ID NO: 17065 - RNA, 20 nt, Artificial Sequence
  MKO10017065_A_Fam110b
  gRNA
cucacguugcacaccgcucu

SEQ ID NO: 17066 - RNA, 20 nt, Artificial Sequence
  MKO10017066_A_Fam110b
  gRNA
aguagucggguccuuuguuc

SEQ ID NO: 17067 - RNA, 20 nt, Artificial Sequence
  MKO10017067_A_Fam110b
  gRNA
caggggcaccgccgacguga

SEQ ID NO: 17068 - RNA, 20 nt, Artificial Sequence
  MKO10017068_A_Fam110c
  gRNA
uccacagcgcucuuguucgc

SEQ ID NO: 17069 - RNA, 20 nt, Artificial Sequence
  MKO10017069_A_Fam110c
  gRNA
cugcgggugucgcguagcaa

SEQ ID NO: 17070 - RNA, 20 nt, Artificial Sequence
  MKO10017070_A_Fam110c
  gRNA
cucccgcuacucgauagcca

SEQ ID NO: 17071 - RNA, 20 nt, Artificial Sequence
  MKO10017071_A_Fam111a
  gRNA
cuuucauagagagugacgau

SEQ ID NO: 17072 - RNA, 20 nt, Artificial Sequence
  MKO10017072_A_Fam111a
  gRNA
cccgucugcuguauaccaga

SEQ ID NO: 17073 - RNA, 20 nt, Artificial Sequence
  MKO10017073_A_Fam111a
  gRNA
aauuaaggacuauuucucuc

SEQ ID NO: 17074 - RNA, 20 nt, Artificial Sequence
  MKO10017074_A_Fam114a1
  gRNA
acccugggucgcuuucugcg

SEQ ID NO: 17075 - RNA, 20 nt, Artificial Sequence
  MKO10017075_A_Fam114a1
  gRNA
guccucgcagaaagcgaccc

SEQ ID NO: 17076 - RNA, 20 nt, Artificial Sequence
  MKO10017076_A_Fam114a1
  gRNA
gccaauucugcaucucccga

SEQ ID NO: 17077 - RNA, 20 nt, Artificial Sequence
  MKO10017077_A_Fam114a2
  gRNA
uacuguagcuaccguagcug

SEQ ID NO: 17078 - RNA, 20 nt, Artificial Sequence
  MKO10017078_A_Fam114a2
  gRNA
gaagcuacuccgguuaccac

SEQ ID NO: 17079 - RNA, 20 nt, Artificial Sequence
  MKO10017079_A_Fam114a2
  gRNA
gugggguuauuggggcaguu

SEQ ID NO: 17080 - RNA, 20 nt, Artificial Sequence
  MKO10017080_A_Fam115a
  gRNA
cacugcaaaucuucgaacgc

SEQ ID NO: 17081 - RNA, 20 nt, Artificial Sequence
  MKO10017081_A_Fam115a
  gRNA
cuuaacccccacaucgcuug

SEQ ID NO: 17082 - RNA, 20 nt, Artificial Sequence
  MKO10017082_A_Fam115a
  gRNA
gagccgcuaucggcuuccag

SEQ ID NO: 17083 - RNA, 20 nt, Artificial Sequence
  MKO10017083_A_Fam115c
  gRNA
cucagaacaccccauuaccg

SEQ ID NO: 17084 - RNA, 20 nt, Artificial Sequence
  MKO10017084_A_Fam115c
  gRNA
ccugaggaagauacugcgac

SEQ ID NO: 17085 - RNA, 20 nt, Artificial Sequence
  MKO10017085_A_Fam115c
  gRNA
uacgcaccuagcuuguagua

SEQ ID NO: 17086 - RNA, 20 nt, Artificial Sequence
  MKO10017086_A_Fam115e
  gRNA
cgcuuaaggacgauguuauc

SEQ ID NO: 17087 - RNA, 20 nt, Artificial Sequence
  MKO10017087_A_Fam115e
  gRNA
cugaacaauacccgaucgca

SEQ ID NO: 17088 - RNA, 20 nt, Artificial Sequence
  MKO10017088_A_Fam115e
  gRNA
auuuccagguaagacgaccc

SEQ ID NO: 17089 - RNA, 20 nt, Artificial Sequence
  MKO10017089_A_Fam117a
  gRNA
gguccggcguacguucuccc

SEQ ID NO: 17090 - RNA, 20 nt, Artificial Sequence
  MKO10017090_A_Fam117a
  gRNA
gagaacguacgccggaccug

SEQ ID NO: 17091 - RNA, 20 nt, Artificial Sequence
  MKO10017091_A_Fam117a
  gRNA
agucgcaggacggggggucc

SEQ ID NO: 17092 - RNA, 20 nt, Artificial Sequence
  MKO10017092_A_Fam117b
  gRNA
cacuggccccgagacauucg

SEQ ID NO: 17093 - RNA, 20 nt, Artificial Sequence
  MKO10017093_A_Fam117b
  gRNA
gcgggaacgagcgugcucuu

SEQ ID NO: 17094 - RNA, 20 nt, Artificial Sequence
  MKO10017094_A_Fam117b
  gRNA
aagagcacgcucguucccgc

SEQ ID NO: 17095 - RNA, 20 nt, Artificial Sequence
  MKO10017095_A_Fam118a
  gRNA
cggaguacaagaagagcgcc

SEQ ID NO: 17096 - RNA, 20 nt, Artificial Sequence
  MKO10017096_A_Fam118a
  gRNA
ucucgccacagcccacgaac

SEQ ID NO: 17097 - RNA, 20 nt, Artificial Sequence
  MKO10017097_A_Fam118a
  gRNA
cugcauugaggcggucaucg

SEQ ID NO: 17098 - RNA, 20 nt, Artificial Sequence
  MKO10017098_A_Fam118b
  gRNA
gaggacaaugccgcuaggau

SEQ ID NO: 17099 - RNA, 20 nt, Artificial Sequence
  MKO10017099_A_Fam118b
  gRNA
gucagucguuugaaauauuc

SEQ ID NO: 17100 - RNA, 20 nt, Artificial Sequence
  MKO10017100_A_Fam118b
  gRNA
gggcuuaauccaggccuuac

SEQ ID NO: 17101 - RNA, 20 nt, Artificial Sequence
  MKO10017101_A_Fam120a
  gRNA
cauucaugacacgucugacc

SEQ ID NO: 17102 - RNA, 20 nt, Artificial Sequence
  MKO10017102_A_Fam120a
  gRNA
caaccucgugcaucagauac

SEQ ID NO: 17103 - RNA, 20 nt, Artificial Sequence
  MKO10017103_A_Fam120a
  gRNA
uggugagacucuucccguug

SEQ ID NO: 17104 - RNA, 20 nt, Artificial Sequence
  MKO10017104_A_Fam120b
  gRNA
gcguagacgcgcugccggac

SEQ ID NO: 17105 - RNA, 20 nt, Artificial Sequence
  MKO10017105_A_Fam120b
  gRNA
cgcgucuacgcacuccuacu

SEQ ID NO: 17106 - RNA, 20 nt, Artificial Sequence
  MKO10017106_A_Fam120b
  gRNA
ucugcaugcauuuaucgcuc

SEQ ID NO: 17107 - RNA, 20 nt, Artificial Sequence
  MKO10017107_A_Fam120c
  gRNA
cccuugugacgucgugauca

SEQ ID NO: 17108 - RNA, 20 nt, Artificial Sequence
  MKO10017108_A_Fam120c
  gRNA
cuagguccgagcucaucagc

SEQ ID NO: 17109 - RNA, 20 nt, Artificial Sequence
  MKO10017109_A_Fam120c
  gRNA
gagccuugaagaccaccauu

SEQ ID NO: 17110 - RNA, 20 nt, Artificial Sequence
  MKO10017110_A_Fam122a
  gRNA
cgacucgucgccgguguucc

SEQ ID NO: 17111 - RNA, 20 nt, Artificial Sequence
  MKO10017111_A_Fam122a
  gRNA
ucgcgcccgcgggcaacucc

SEQ ID NO: 17112 - RNA, 20 nt, Artificial Sequence
  MKO10017112_A_Fam122a
  gRNA
gaagcgcaucgauuucauuc

SEQ ID NO: 17113 - RNA, 20 nt, Artificial Sequence
  MKO10017113_A_Fam122b
  gRNA
gagcacuguuggaccgucuc

SEQ ID NO: 17114 - RNA, 20 nt, Artificial Sequence
  MKO10017114_A_Fam122b
  gRNA
ucaggcuuucgucccaugac

SEQ ID NO: 17115 - RNA, 20 nt, Artificial Sequence
  MKO10017115_A_Fam122b
  gRNA
gagccauauccacuuagaac

SEQ ID NO: 17116 - RNA, 20 nt, Artificial Sequence
  MKO10017116_A_Fam122c
  gRNA
gcagucguacaucugccaac

SEQ ID NO: 17117 - RNA, 20 nt, Artificial Sequence
  MKO10017117_A_Fam122c
  gRNA
ucccccuuucugaaucagca

SEQ ID NO: 17118 - RNA, 20 nt, Artificial Sequence
  MKO10017118_A_Fam122c
  gRNA
uacggaacaaugucuaaauc

SEQ ID NO: 17119 - RNA, 20 nt, Artificial Sequence
  MKO10017119_A_Fam124a
  gRNA
cacgcgcgccaugaacccga

SEQ ID NO: 17120 - RNA, 20 nt, Artificial Sequence
  MKO10017120_A_Fam124a
  gRNA
accucacuggcagcgggcau

SEQ ID NO: 17121 - RNA, 20 nt, Artificial Sequence
  MKO10017121_A_Fam124a
  gRNA
ucuaugagcugaucuugcgc

SEQ ID NO: 17122 - RNA, 20 nt, Artificial Sequence
  MKO10017122_A_Fam124b
  gRNA
ccugccagggugaacgccgu

SEQ ID NO: 17123 - RNA, 20 nt, Artificial Sequence
  MKO10017123_A_Fam124b
  gRNA
gagguucaaaguacauucgc

SEQ ID NO: 17124 - RNA, 20 nt, Artificial Sequence
  MKO10017124_A_Fam124b
  gRNA
ccaucaucaauuccgaaccc

SEQ ID NO: 17125 - RNA, 20 nt, Artificial Sequence
  MKO10017125_A_Fam126a
  gRNA
guggugcuaccucgccgugu

SEQ ID NO: 17126 - RNA, 20 nt, Artificial Sequence
  MKO10017126_A_Fam126a
  gRNA
cagcgccauagacccaaugc

SEQ ID NO: 17127 - RNA, 20 nt, Artificial Sequence
  MKO10017127_A_Fam126a
  gRNA
ccagguuguaaacccccagc

SEQ ID NO: 17128 - RNA, 20 nt, Artificial Sequence
  MKO10017128_A_Fam126b
  gRNA
aguuccugcccgaauugauu

SEQ ID NO: 17129 - RNA, 20 nt, Artificial Sequence
  MKO10017129_A_Fam126b
  gRNA
gcucugaaguucgacuuaag

SEQ ID NO: 17130 - RNA, 20 nt, Artificial Sequence
  MKO10017130_A_Fam126b
  gRNA
cuuacuucaugguauauuga

SEQ ID NO: 17131 - RNA, 20 nt, Artificial Sequence
  MKO10017131_A_Fam129a
  gRNA
cugcaaucaugugcgcagcg

SEQ ID NO: 17132 - RNA, 20 nt, Artificial Sequence
  MKO10017132_A_Fam129a
  gRNA
agcgcugaacuucugcuguu

SEQ ID NO: 17133 - RNA, 20 nt, Artificial Sequence
  MKO10017133_A_Fam129a
  gRNA
agggacucaccagugggguc

SEQ ID NO: 17134 - RNA, 20 nt, Artificial Sequence
  MKO10017134_A_Fam129b
  gRNA
gggugguaucugccgcucau

SEQ ID NO: 17135 - RNA, 20 nt, Artificial Sequence
  MKO10017135_A_Fam129b
  gRNA
guagcccgcgcuguugauga

SEQ ID NO: 17136 - RNA, 20 nt, Artificial Sequence
  MKO10017136_A_Fam129b
  gRNA
gguggagccugauuucgaug

SEQ ID NO: 17137 - RNA, 20 nt, Artificial Sequence
  MKO10017137_A_Fam129c
  gRNA
accgguggcucucagacgaa

SEQ ID NO: 17138 - RNA, 20 nt, Artificial Sequence
  MKO10017138_A_Fam129c
  gRNA
gcgcaccgcgccuggaggcu

SEQ ID NO: 17139 - RNA, 20 nt, Artificial Sequence
  MKO10017139_A_Fam129c
  gRNA
ucuagaaugguucagucaca

SEQ ID NO: 17140 - RNA, 20 nt, Artificial Sequence
  MKO10017140_A_Fam131a
  gRNA
caccgaugauucuuacgacg

SEQ ID NO: 17141 - RNA, 20 nt, Artificial Sequence
  MKO10017141_A_Fam131a
  gRNA
gaguggaucgaacucccucg

SEQ ID NO: 17142 - RNA, 20 nt, Artificial Sequence
  MKO10017142_A_Fam131a
  gRNA
guccucgucguaagaaucau

SEQ ID NO: 17143 - RNA, 20 nt, Artificial Sequence
  MKO10017143_A_Fam131b
  gRNA
agggaacgaagugauugccg

SEQ ID NO: 17144 - RNA, 20 nt, Artificial Sequence
  MKO10017144_A_Fam131b
  gRNA
aaggaggcacguuuccuagc

SEQ ID NO: 17145 - RNA, 20 nt, Artificial Sequence
  MKO10017145_A_Fam131b
  gRNA
cuggccaagucaucauucuc

SEQ ID NO: 17146 - RNA, 20 nt, Artificial Sequence
  MKO10017146_A_Fam131c
  gRNA
cgcgccucgcgcagcucguc

SEQ ID NO: 17147 - RNA, 20 nt, Artificial Sequence
  MKO10017147_A_Fam131c
  gRNA
uccagccuuuccacucgaug

SEQ ID NO: 17148 - RNA, 20 nt, Artificial Sequence
  MKO10017148_A_Fam131c
  gRNA
ccacaagggaugacguagcc

SEQ ID NO: 17149 - RNA, 20 nt, Artificial Sequence
  MKO10017149_A_Fam132a
  gRNA
uccucuagaaaacggugucg

SEQ ID NO: 17150 - RNA, 20 nt, Artificial Sequence
  MKO10017150_A_Fam132a
  gRNA
gccuuucaaacggcaguaga

SEQ ID NO: 17151 - RNA, 20 nt, Artificial Sequence
  MKO10017151_A_Fam132a
  gRNA
cucaaccaccagccguuggc

SEQ ID NO: 17152 - RNA, 20 nt, Artificial Sequence
  MKO10017152_A_Fam132b
  gRNA
gacacgggaagggcuacccg

SEQ ID NO: 17153 - RNA, 20 nt, Artificial Sequence
  MKO10017153_A_Fam132b
  gRNA
cggcgugcguugcacgagcu

SEQ ID NO: 17154 - RNA, 20 nt, Artificial Sequence
  MKO10017154_A_Fam132b
  gRNA
ugcuccguagcccgaaguug

SEQ ID NO: 17155 - RNA, 20 nt, Artificial Sequence
  MKO10017155_A_Fam133b
  gRNA
aggauuaucugaaucgacca

SEQ ID NO: 17156 - RNA, 20 nt, Artificial Sequence
  MKO10017156_A_Fam133b
  gRNA
cuugaucgagccauugcuau

SEQ ID NO: 17157 - RNA, 20 nt, Artificial Sequence
  MKO10017157_A_Fam133b
  gRNA
gagcucauccaaaaaaagac

SEQ ID NO: 17158 - RNA, 20 nt, Artificial Sequence
  MKO10017158_A_Fam134a
  gRNA
cgcuuucucccugacguuuc

SEQ ID NO: 17159 - RNA, 20 nt, Artificial Sequence
  MKO10017159_A_Fam134a
  gRNA
uguugucuucgucgucccuc

SEQ ID NO: 17160 - RNA, 20 nt, Artificial Sequence
  MKO10017160_A_Fam134a
  gRNA
acaacucgggcacacucagc

SEQ ID NO: 17161 - RNA, 20 nt, Artificial Sequence
  MKO10017161_A_Fam134b
  gRNA
cagaucucucacguuucuuc

SEQ ID NO: 17162 - RNA, 20 nt, Artificial Sequence
  MKO10017162_A_Fam134b
  gRNA
uccaugauucugcaaugcac

SEQ ID NO: 17163 - RNA, 20 nt, Artificial Sequence
  MKO10017163_A_Fam134b
  gRNA
gccagugcauugcagaauca

SEQ ID NO: 17164 - RNA, 20 nt, Artificial Sequence
  MKO10017164_A_Fam134c
  gRNA
uucacacuuacgcaucaagu

SEQ ID NO: 17165 - RNA, 20 nt, Artificial Sequence
  MKO10017165_A_Fam134c
  gRNA
uugcugucuaucaccgucug

SEQ ID NO: 17166 - RNA, 20 nt, Artificial Sequence
  MKO10017166_A_Fam134c
  gRNA
ucugcacucagaacgugcca

SEQ ID NO: 17167 - RNA, 20 nt, Artificial Sequence
  MKO10017167_A_Fam135a
  gRNA
cguuacaguucacgcgucau

SEQ ID NO: 17168 - RNA, 20 nt, Artificial Sequence
  MKO10017168_A_Fam135a
  gRNA
gccaguuuguuacacgcaac

SEQ ID NO: 17169 - RNA, 20 nt, Artificial Sequence
  MKO10017169_A_Fam135a
  gRNA
ccgacugcuuauuaguugca

SEQ ID NO: 17170 - RNA, 20 nt, Artificial Sequence
  MKO10017170_A_Fam135b
  gRNA
aggcugagugcuucuaucgu

SEQ ID NO: 17171 - RNA, 20 nt, Artificial Sequence
  MKO10017171_A_Fam135b
  gRNA
agccaccagcgcagcaugua

SEQ ID NO: 17172 - RNA, 20 nt, Artificial Sequence
  MKO10017172_A_Fam135b
  gRNA
ucugcacuuccacccgagga

SEQ ID NO: 17173 - RNA, 20 nt, Artificial Sequence
  MKO10017173_A_Fam136a
  gRNA
gcgccgcuaccugcaucuuc

SEQ ID NO: 17174 - RNA, 20 nt, Artificial Sequence
  MKO10017174_A_Fam136a
  gRNA
cgagcgcugccaugcgccuc

SEQ ID NO: 17175 - RNA, 20 nt, Artificial Sequence
  MKO10017175_A_Fam136a
  gRNA
cauggcagcgcucgaugcau

SEQ ID NO: 17176 - RNA, 20 nt, Artificial Sequence
  MKO10017176_A_Fam13a
  gRNA
gacgauauuugugacuacgu

SEQ ID NO: 17177 - RNA, 20 nt, Artificial Sequence
  MKO10017177_A_Fam13a
  gRNA
aagcucagugacaaccacga

SEQ ID NO: 17178 - RNA, 20 nt, Artificial Sequence
  MKO10017178_A_Fam13a
  gRNA
aaauugaugcccucgcugcc

SEQ ID NO: 17179 - RNA, 20 nt, Artificial Sequence
  MKO10017179_A_Fam13b
  gRNA
cuucggcagagauacgacag

SEQ ID NO: 17180 - RNA, 20 nt, Artificial Sequence
  MKO10017180_A_Fam13b
  gRNA
ucuuagcauuuacacggaug

SEQ ID NO: 17181 - RNA, 20 nt, Artificial Sequence
  MKO10017181_A_Fam13b
  gRNA
uucaugaugugaugcuacau

SEQ ID NO: 17182 - RNA, 20 nt, Artificial Sequence
  MKO10017182_A_Fam13c
  gRNA
guugaagucgcaccguuucc

SEQ ID NO: 17183 - RNA, 20 nt, Artificial Sequence
  MKO10017183_A_Fam13c
  gRNA
ggcgcacucugcguggaagc

SEQ ID NO: 17184 - RNA, 20 nt, Artificial Sequence
  MKO10017184_A_Fam13c
  gRNA
aaacggugcgacuucaacca

SEQ ID NO: 17185 - RNA, 20 nt, Artificial Sequence
  MKO10017185_A_Fam149a
  gRNA
auugucuacggagcggagcu

SEQ ID NO: 17186 - RNA, 20 nt, Artificial Sequence
  MKO10017186_A_Fam149a
  gRNA
acguuucucguaaaauucgu

SEQ ID NO: 17187 - RNA, 20 nt, Artificial Sequence
  MKO10017187_A_Fam149a
  gRNA
aagccauugauaaauucgcc

SEQ ID NO: 17188 - RNA, 20 nt, Artificial Sequence
  MKO10017188_A_Fam149b
  gRNA
cucgucgauggcuguaaaca

SEQ ID NO: 17189 - RNA, 20 nt, Artificial Sequence
  MKO10017189_A_Fam149b
  gRNA
aggcgugcuaccugagguga

SEQ ID NO: 17190 - RNA, 20 nt, Artificial Sequence
  MKO10017190_A_Fam149b
  gRNA
cacggccuuccgaguguauc

SEQ ID NO: 17191 - RNA, 20 nt, Artificial Sequence
  MKO10017191_A_Fam150a
  gRNA
aagcuggcgucgagcaaucc

SEQ ID NO: 17192 - RNA, 20 nt, Artificial Sequence
  MKO10017192_A_Fam150a
  gRNA
cagcgcgugucgcugagcuc

SEQ ID NO: 17193 - RNA, 20 nt, Artificial Sequence
  MKO10017193_A_Fam150a
  gRNA
aucgacuuuaucacaauacc

SEQ ID NO: 17194 - RNA, 20 nt, Artificial Sequence
  MKO10017194_A_Fam150b
  gRNA
accggggacgagcgcagucc

SEQ ID NO: 17195 - RNA, 20 nt, Artificial Sequence
  MKO10017195_A_Fam150b
  gRNA
cgccagccgaguaaguaacc

SEQ ID NO: 17196 - RNA, 20 nt, Artificial Sequence
  MKO10017196_A_Fam150b
  gRNA
gggcaaagucggacucgcca

SEQ ID NO: 17197 - RNA, 20 nt, Artificial Sequence
  MKO10017197_A_Fam151a
  gRNA
gaagccgaugucaccguaga

SEQ ID NO: 17198 - RNA, 20 nt, Artificial Sequence
  MKO10017198_A_Fam151a
  gRNA
ugugagaacgaugcaauuug

SEQ ID NO: 17199 - RNA, 20 nt, Artificial Sequence
  MKO10017199_A_Fam151a
  gRNA
gugggccauaaugggcaccu

SEQ ID NO: 17200 - RNA, 20 nt, Artificial Sequence
  MKO10017200_A_Fam151b
  gRNA
cgccgucuucugccgugauc

SEQ ID NO: 17201 - RNA, 20 nt, Artificial Sequence
  MKO10017201_A_Fam151b
  gRNA
uucaggcuacaguuggucga

SEQ ID NO: 17202 - RNA, 20 nt, Artificial Sequence
  MKO10017202_A_Fam151b
  gRNA
ccaugcucugauccgucacu

SEQ ID NO: 17203 - RNA, 20 nt, Artificial Sequence
  MKO10017203_A_Fam154a
  gRNA
gccuccgggcuauaucuucg

SEQ ID NO: 17204 - RNA, 20 nt, Artificial Sequence
  MKO10017204_A_Fam154a
  gRNA
acuuccucgaagauauagcc

SEQ ID NO: 17205 - RNA, 20 nt, Artificial Sequence
  MKO10017205_A_Fam154a
  gRNA
gaaauuccuucaagcccgag

SEQ ID NO: 17206 - RNA, 20 nt, Artificial Sequence
  MKO10017206_A_Fam154b
  gRNA
ucuaauggcaacuacgcggc

SEQ ID NO: 17207 - RNA, 20 nt, Artificial Sequence
  MKO10017207_A_Fam154b
  gRNA
cuuacccgcaggugcaaauc

SEQ ID NO: 17208 - RNA, 20 nt, Artificial Sequence
  MKO10017208_A_Fam154b
  gRNA
ccucgacuauguucccuauc

SEQ ID NO: 17209 - RNA, 20 nt, Artificial Sequence
  MKO10017209_A_Fam155a
  gRNA
guggaguuguccucgagcgu

SEQ ID NO: 17210 - RNA, 20 nt, Artificial Sequence
  MKO10017210_A_Fam155a
  gRNA
gcccgcucugaaucgaugaa

SEQ ID NO: 17211 - RNA, 20 nt, Artificial Sequence
  MKO10017211_A_Fam155a
  gRNA
aaccguucaucgauucagag

SEQ ID NO: 17212 - RNA, 20 nt, Artificial Sequence
  MKO10017212_A_Fam159a
  gRNA
cuccagcaucggagcgcucg

SEQ ID NO: 17213 - RNA, 20 nt, Artificial Sequence
  MKO10017213_A_Fam159a
  gRNA
ggucgucgcagcaguacuug

SEQ ID NO: 17214 - RNA, 20 nt, Artificial Sequence
  MKO10017214_A_Fam159a
  gRNA
acagcagccgcuucgccccc

SEQ ID NO: 17215 - RNA, 20 nt, Artificial Sequence
  MKO10017215_A_Fam159b
  gRNA
gccgcgcugcucuauugcug

SEQ ID NO: 17216 - RNA, 20 nt, Artificial Sequence
  MKO10017216_A_Fam159b
  gRNA
gccgcagcaauagagcagcg

SEQ ID NO: 17217 - RNA, 20 nt, Artificial Sequence
  MKO10017217_A_Fam159b
  gRNA
aggccauugucuaaucuuug

SEQ ID NO: 17218 - RNA, 20 nt, Artificial Sequence
  MKO10017218_A_Fam160a1
  gRNA
gauacccuucauucaucgag

SEQ ID NO: 17219 - RNA, 20 nt, Artificial Sequence
  MKO10017219_A_Fam160a1
  gRNA
ugcugcgauggggccaaucc

SEQ ID NO: 17220 - RNA, 20 nt, Artificial Sequence
  MKO10017220_A_Fam160a1
  gRNA
cccgaaaagggguguugauc

SEQ ID NO: 17221 - RNA, 20 nt, Artificial Sequence
  MKO10017221_A_Fam160a2
  gRNA
gccucaggugguacgaaucc

SEQ ID NO: 17222 - RNA, 20 nt, Artificial Sequence
  MKO10017222_A_Fam160a2
  gRNA
aagagugaucugcgauguag

SEQ ID NO: 17223 - RNA, 20 nt, Artificial Sequence
  MKO10017223_A_Fam160a2
  gRNA
augauuggcacugcuugcgc

SEQ ID NO: 17224 - RNA, 20 nt, Artificial Sequence
  MKO10017224_A_Fam160b1
  gRNA
cauucuccguuggcguugca

SEQ ID NO: 17225 - RNA, 20 nt, Artificial Sequence
  MKO10017225_A_Fam160b1
  gRNA
acuuacgucggcuuucccua

SEQ ID NO: 17226 - RNA, 20 nt, Artificial Sequence
  MKO10017226_A_Fam160b1
  gRNA
ccggauucgucccagaagcu

SEQ ID NO: 17227 - RNA, 20 nt, Artificial Sequence
  MKO10017227_A_Fam160b2
  gRNA
ccccccaggcaugcgacaac

SEQ ID NO: 17228 - RNA, 20 nt, Artificial Sequence
  MKO10017228_A_Fam160b2
  gRNA
aacaccuguugucgcaugcc

SEQ ID NO: 17229 - RNA, 20 nt, Artificial Sequence
  MKO10017229_A_Fam160b2
  gRNA
cacuacuauaucgagagcac

SEQ ID NO: 17230 - RNA, 20 nt, Artificial Sequence
  MKO10017230_A_Fam161a
  gRNA
augcccaccgcgucuucccg

SEQ ID NO: 17231 - RNA, 20 nt, Artificial Sequence
  MKO10017231_A_Fam161a
  gRNA
ggaucagcgauucgucuucg

SEQ ID NO: 17232 - RNA, 20 nt, Artificial Sequence
  MKO10017232_A_Fam161a
  gRNA
acgucugcaagcugaccgac

SEQ ID NO: 17233 - RNA, 20 nt, Artificial Sequence
  MKO10017233_A_Fam161b
  gRNA
ccgaacggcugcccgcaccc

SEQ ID NO: 17234 - RNA, 20 nt, Artificial Sequence
  MKO10017234_A_Fam161b
  gRNA
agguagacgugugccggcac

SEQ ID NO: 17235 - RNA, 20 nt, Artificial Sequence
  MKO10017235_A_Fam161b
  gRNA
cugucagcaccgcccgaaac

SEQ ID NO: 17236 - RNA, 20 nt, Artificial Sequence
  MKO10017236_A_Fam162a
  gRNA
ucuaaugauugcccugaccg

SEQ ID NO: 17237 - RNA, 20 nt, Artificial Sequence
  MKO10017237_A_Fam162a
  gRNA
gaaaugcuuccucgucucua

SEQ ID NO: 17238 - RNA, 20 nt, Artificial Sequence
  MKO10017238_A_Fam162a
  gRNA
agcacucacgagauugucuc

SEQ ID NO: 17239 - RNA, 20 nt, Artificial Sequence
  MKO10017239_A_Fam162b
  gRNA
agccgcagcguucugcgacu

SEQ ID NO: 17240 - RNA, 20 nt, Artificial Sequence
  MKO10017240_A_Fam162b
  gRNA
cacacuuacgguacaagggg

SEQ ID NO: 17241 - RNA, 20 nt, Artificial Sequence
  MKO10017241_A_Fam162b
  gRNA
cgggcguuucaaaucuauag

SEQ ID NO: 17242 - RNA, 20 nt, Artificial Sequence
  MKO10017242_A_Fam163a
  gRNA
acaucgguacuaauagcccu

SEQ ID NO: 17243 - RNA, 20 nt, Artificial Sequence
  MKO10017243_A_Fam163a
  gRNA
gucagcuguccguauguaaa

SEQ ID NO: 17244 - RNA, 20 nt, Artificial Sequence
  MKO10017244_A_Fam163a
  gRNA
ccuggagccuacaguagcac

SEQ ID NO: 17245 - RNA, 20 nt, Artificial Sequence
  MKO10017245_A_Fam163b
  gRNA
cgcaaccucguguugaccaa

SEQ ID NO: 17246 - RNA, 20 nt, Artificial Sequence
  MKO10017246_A_Fam163b
  gRNA
caggcccguuggucaacacg

SEQ ID NO: 17247 - RNA, 20 nt, Artificial Sequence
  MKO10017247_A_Fam163b
  gRNA
gaagugggcggaugacagcc

SEQ ID NO: 17248 - RNA, 20 nt, Artificial Sequence
  MKO10017248_A_Fam166a
  gRNA
cuauccucaacugcgcuacc

SEQ ID NO: 17249 - RNA, 20 nt, Artificial Sequence
  MKO10017249_A_Fam166a
  gRNA
ccccaaccuaauccaacgca

SEQ ID NO: 17250 - RNA, 20 nt, Artificial Sequence
  MKO10017250_A_Fam166a
  gRNA
auggggaugaauuaccguga

SEQ ID NO: 17251 - RNA, 20 nt, Artificial Sequence
  MKO10017251_A_Fam166b
  gRNA
gagccuuucaugcccgcgcc

SEQ ID NO: 17252 - RNA, 20 nt, Artificial Sequence
  MKO10017252_A_Fam166b
  gRNA
cccaugcugaaccgaaguag

SEQ ID NO: 17253 - RNA, 20 nt, Artificial Sequence
  MKO10017253_A_Fam166b
  gRNA
ggcacguagccuccguagug

SEQ ID NO: 17254 - RNA, 20 nt, Artificial Sequence
  MKO10017254_A_Fam167a
  gRNA
gucaccccugccggcacucg

SEQ ID NO: 17255 - RNA, 20 nt, Artificial Sequence
  MKO10017255_A_Fam167a
  gRNA
caacgaugccgccuuugagc

SEQ ID NO: 17256 - RNA, 20 nt, Artificial Sequence
  MKO10017256_A_Fam167a
  gRNA
cuauagcuucaucgauacuc

SEQ ID NO: 17257 - RNA, 20 nt, Artificial Sequence
  MKO10017257_A_Fam167b
  gRNA
ggcaguccacucgagguaug

SEQ ID NO: 17258 - RNA, 20 nt, Artificial Sequence
  MKO10017258_A_Fam167b
  gRNA
cucuguaccaagcccggcuc

SEQ ID NO: 17259 - RNA, 20 nt, Artificial Sequence
  MKO10017259_A_Fam167b
  gRNA
ucagcagagggugaagcguc

SEQ ID NO: 17260 - RNA, 20 nt, Artificial Sequence
  MKO10017260_A_Fam168a
  gRNA
cuugguacaggauauaccgc

SEQ ID NO: 17261 - RNA, 20 nt, Artificial Sequence
  MKO10017261_A_Fam168a
  gRNA
gaccgagaaccgaacuuacc

SEQ ID NO: 17262 - RNA, 20 nt, Artificial Sequence
  MKO10017262_A_Fam168a
  gRNA
agguuaccccacagcauacc

SEQ ID NO: 17263 - RNA, 20 nt, Artificial Sequence
  MKO10017263_A_Fam168b
  gRNA
cccaagcauaccugggcgua

SEQ ID NO: 17264 - RNA, 20 nt, Artificial Sequence
  MKO10017264_A_Fam168b
  gRNA
ccagcagaguccauacgccc

SEQ ID NO: 17265 - RNA, 20 nt, Artificial Sequence
  MKO10017265_A_Fam168b
  gRNA
gcgaauccuaccuuccaaac

SEQ ID NO: 17266 - RNA, 20 nt, Artificial Sequence
  MKO10017266_A_Fam169a
  gRNA
gcgccugaagauucucuuac

SEQ ID NO: 17267 - RNA, 20 nt, Artificial Sequence
  MKO10017267_A_Fam169a
  gRNA
gucugauugccgccauagag

SEQ ID NO: 17268 - RNA, 20 nt, Artificial Sequence
  MKO10017268_A_Fam169a
  gRNA
cucucguaggugagcacucu

SEQ ID NO: 17269 - RNA, 20 nt, Artificial Sequence
  MKO10017269_A_Fam169b
  gRNA
aguucuuaggaugucuucga

SEQ ID NO: 17270 - RNA, 20 nt, Artificial Sequence
  MKO10017270_A_Fam169b
  gRNA
cuucaugagcccuucccgcg

SEQ ID NO: 17271 - RNA, 20 nt, Artificial Sequence
  MKO10017271_A_Fam169b
  gRNA
gacugaguaaaaugcaaccg

SEQ ID NO: 17272 - RNA, 20 nt, Artificial Sequence
  MKO10017272_A_Fam170a
  gRNA
gccucgcacccuuacuacga

SEQ ID NO: 17273 - RNA, 20 nt, Artificial Sequence
  MKO10017273_A_Fam170a
  gRNA
agcugccgcuguugucgcaa

SEQ ID NO: 17274 - RNA, 20 nt, Artificial Sequence
  MKO10017274_A_Fam170a
  gRNA
ccgcgguugaagagagacca

SEQ ID NO: 17275 - RNA, 20 nt, Artificial Sequence
  MKO10017275_A_Fam170b
  gRNA
acagacaccugggaccgccg

SEQ ID NO: 17276 - RNA, 20 nt, Artificial Sequence
  MKO10017276_A_Fam170b
  gRNA
uacagggcgcacacgcucuc

SEQ ID NO: 17277 - RNA, 20 nt, Artificial Sequence
  MKO10017277_A_Fam170b
  gRNA
uacauucacuacuguccgaa

SEQ ID NO: 17278 - RNA, 20 nt, Artificial Sequence
  MKO10017278_A_Fam171a1
  gRNA
ccacuuacccgguaaucgga

SEQ ID NO: 17279 - RNA, 20 nt, Artificial Sequence
  MKO10017279_A_Fam171a1
  gRNA
ugaacgcuccgcuacgcuga

SEQ ID NO: 17280 - RNA, 20 nt, Artificial Sequence
  MKO10017280_A_Fam171a1
  gRNA
ccauccaauccucgcaagua

SEQ ID NO: 17281 - RNA, 20 nt, Artificial Sequence
  MKO10017281_A_Fam171a2
  gRNA
gugagcguccaccugcuaac

SEQ ID NO: 17282 - RNA, 20 nt, Artificial Sequence
  MKO10017282_A_Fam171a2
  gRNA
agggccucaguagacgucuu

SEQ ID NO: 17283 - RNA, 20 nt, Artificial Sequence
  MKO10017283_A_Fam171a2
  gRNA
uacuacggacucagagggcg

SEQ ID NO: 17284 - RNA, 20 nt, Artificial Sequence
  MKO10017284_A_Fam171b
  gRNA
caucacaucagcaacgugac

SEQ ID NO: 17285 - RNA, 20 nt, Artificial Sequence
  MKO10017285_A_Fam171b
  gRNA
uaagcugaguccuaacugau

SEQ ID NO: 17286 - RNA, 20 nt, Artificial Sequence
  MKO10017286_A_Fam171b
  gRNA
gacugacgaugucauugacc

SEQ ID NO: 17287 - RNA, 20 nt, Artificial Sequence
  MKO10017287_A_Fam172a
  gRNA
acuaccgagaagacuuacac

SEQ ID NO: 17288 - RNA, 20 nt, Artificial Sequence
  MKO10017288_A_Fam172a
  gRNA
gaaguaccgcaacccucaaa

SEQ ID NO: 17289 - RNA, 20 nt, Artificial Sequence
  MKO10017289_A_Fam172a
  gRNA
acgacgcuucuuuguuuccu

SEQ ID NO: 17290 - RNA, 20 nt, Artificial Sequence
  MKO10017290_A_Fam173a
  gRNA
cuuauucaggugcccuacgu

SEQ ID NO: 17291 - RNA, 20 nt, Artificial Sequence
  MKO10017291_A_Fam173a
  gRNA
gugcuggcggcccaccaaug

SEQ ID NO: 17292 - RNA, 20 nt, Artificial Sequence
  MKO10017292_A_Fam173a
  gRNA
ugggauaugagcugaacccg

SEQ ID NO: 17293 - RNA, 20 nt, Artificial Sequence
  MKO10017293_A_Fam173b
  gRNA
acggggaggacggccgaauc

SEQ ID NO: 17294 - RNA, 20 nt, Artificial Sequence
  MKO10017294_A_Fam173b
  gRNA
gguacuccagauaucgugcc

SEQ ID NO: 17295 - RNA, 20 nt, Artificial Sequence
  MKO10017295_A_Fam173b
  gRNA
cugucggauuccagacucgu

SEQ ID NO: 17296 - RNA, 20 nt, Artificial Sequence
  MKO10017296_A_Fam174a
  gRNA
guccggggcgguaccgucga

SEQ ID NO: 17297 - RNA, 20 nt, Artificial Sequence
  MKO10017297_A_Fam174a
  gRNA
gagaccaugccgaccccgcg

SEQ ID NO: 17298 - RNA, 20 nt, Artificial Sequence
  MKO10017298_A_Fam174a
  gRNA
caccguaccuccuagucuug

SEQ ID NO: 17299 - RNA, 20 nt, Artificial Sequence
  MKO10017299_A_Fam174b
  gRNA
ccacgaucaccgucgccuuc

SEQ ID NO: 17300 - RNA, 20 nt, Artificial Sequence
  MKO10017300_A_Fam174b
  gRNA
ucgcagagccgaguccgcuu

SEQ ID NO: 17301 - RNA, 20 nt, Artificial Sequence
  MKO10017301_A_Fam174b
  gRNA
gccauuuccacacguuccgc

SEQ ID NO: 17302 - RNA, 20 nt, Artificial Sequence
  MKO10017302_A_Fam175a
  gRNA
ugaucugauccgagugacga

SEQ ID NO: 17303 - RNA, 20 nt, Artificial Sequence
  MKO10017303_A_Fam175a
  gRNA
acgccuuauauaaaccucaa

SEQ ID NO: 17304 - RNA, 20 nt, Artificial Sequence
  MKO10017304_A_Fam175a
  gRNA
cuucaccuuucauuucaccg

SEQ ID NO: 17305 - RNA, 20 nt, Artificial Sequence
  MKO10017305_A_Fam175b
  gRNA
agaccaggucuggcacgccg

SEQ ID NO: 17306 - RNA, 20 nt, Artificial Sequence
  MKO10017306_A_Fam175b
  gRNA
uucucuuuagaccaaaccgc

SEQ ID NO: 17307 - RNA, 20 nt, Artificial Sequence
  MKO10017307_A_Fam175b
  gRNA
acagaauucugaaagaucgg

SEQ ID NO: 17308 - RNA, 20 nt, Artificial Sequence
  MKO10017308_A_Fam177a
  gRNA
caagcauaccgggucgacag

SEQ ID NO: 17309 - RNA, 20 nt, Artificial Sequence
  MKO10017309_A_Fam177a
  gRNA
cuauagauaaguaaugaaag

SEQ ID NO: 17310 - RNA, 20 nt, Artificial Sequence
  MKO10017310_A_Fam177a
  gRNA
aguaccugagaggguugaug

SEQ ID NO: 17311 - RNA, 20 nt, Artificial Sequence
  MKO10017311_A_Fam178a
  gRNA
cccuacaccagacgacuuua

SEQ ID NO: 17312 - RNA, 20 nt, Artificial Sequence
  MKO10017312_A_Fam178a
  gRNA
aaccuuuccuuaaagucguc

SEQ ID NO: 17313 - RNA, 20 nt, Artificial Sequence
  MKO10017313_A_Fam178a
  gRNA
gucugggcgcuucucuagaa

SEQ ID NO: 17314 - RNA, 20 nt, Artificial Sequence
  MKO10017314_A_Fam178b
  gRNA
gcugugcggcuuuagacgag

SEQ ID NO: 17315 - RNA, 20 nt, Artificial Sequence
  MKO10017315_A_Fam178b
  gRNA
gaaguucuccgugucccugc

SEQ ID NO: 17316 - RNA, 20 nt, Artificial Sequence
  MKO10017316_A_Fam178b
  gRNA
cccuccagaucccaaccaga

SEQ ID NO: 17317 - RNA, 20 nt, Artificial Sequence
  MKO10017317_A_Fam179a
  gRNA
aggccgcuuaccgcguaugu

SEQ ID NO: 17318 - RNA, 20 nt, Artificial Sequence
  MKO10017318_A_Fam179a
  gRNA
agcgcaguguaaguauugcc

SEQ ID NO: 17319 - RNA, 20 nt, Artificial Sequence
  MKO10017319_A_Fam179a
  gRNA
agugucccucggacuagugu

SEQ ID NO: 17320 - RNA, 20 nt, Artificial Sequence
  MKO10017320_A_Fam179b
  gRNA
gugugcuuuggacuaguucg

SEQ ID NO: 17321 - RNA, 20 nt, Artificial Sequence
  MKO10017321_A_Fam179b
  gRNA
cgaucaccuucuucccgaag

SEQ ID NO: 17322 - RNA, 20 nt, Artificial Sequence
  MKO10017322_A_Fam179b
  gRNA
ggaagaaggugaucgcacca

SEQ ID NO: 17323 - RNA, 20 nt, Artificial Sequence
  MKO10017323_A_Fam180a
  gRNA
uccgauaggcuguguacgcc

SEQ ID NO: 17324 - RNA, 20 nt, Artificial Sequence
  MKO10017324_A_Fam180a
  gRNA
agcguaucccagauauccga

SEQ ID NO: 17325 - RNA, 20 nt, Artificial Sequence
  MKO10017325_A_Fam180a
  gRNA
cagaaucgucagcgccuucc

SEQ ID NO: 17326 - RNA, 20 nt, Artificial Sequence
  MKO10017326_A_Fam181a
  gRNA
acuugcgaugguccacagag

SEQ ID NO: 17327 - RNA, 20 nt, Artificial Sequence
  MKO10017327_A_Fam181a
  gRNA
uccgugucagcuaguacccu

SEQ ID NO: 17328 - RNA, 20 nt, Artificial Sequence
  MKO10017328_A_Fam181a
  gRNA
cgcacccugccgccgcucug

SEQ ID NO: 17329 - RNA, 20 nt, Artificial Sequence
  MKO10017329_A_Fam181b
  gRNA
ugcguugccgccgccccauc

SEQ ID NO: 17330 - RNA, 20 nt, Artificial Sequence
  MKO10017330_A_Fam181b
  gRNA
guagcccgcgcuguaaucau

SEQ ID NO: 17331 - RNA, 20 nt, Artificial Sequence
  MKO10017331_A_Fam181b
  gRNA
cuucggcaguggcaacgauu

SEQ ID NO: 17332 - RNA, 20 nt, Artificial Sequence
  MKO10017332_A_Fam183b
  gRNA
ucacgugaauccccugcgca

SEQ ID NO: 17333 - RNA, 20 nt, Artificial Sequence
  MKO10017333_A_Fam183b
  gRNA
uuagaucaacccagaccguc

SEQ ID NO: 17334 - RNA, 20 nt, Artificial Sequence
  MKO10017334_A_Fam183b
  gRNA
ccuuguacagagugaugucg

SEQ ID NO: 17335 - RNA, 20 nt, Artificial Sequence
  MKO10017335_A_Fam184a
  gRNA
cagcugacacaaucgcucgu

SEQ ID NO: 17336 - RNA, 20 nt, Artificial Sequence
  MKO10017336_A_Fam184a
  gRNA
cuccuugaccguguuguuca

SEQ ID NO: 17337 - RNA, 20 nt, Artificial Sequence
  MKO10017337_A_Fam184a
  gRNA
ugaacacgaugcugcgauuc

SEQ ID NO: 17338 - RNA, 20 nt, Artificial Sequence
  MKO10017338_A_Fam184b
  gRNA
aggucagcguggagucaaua

SEQ ID NO: 17339 - RNA, 20 nt, Artificial Sequence
  MKO10017339_A_Fam184b
  gRNA
uuaugcccucaauacccgcc

SEQ ID NO: 17340 - RNA, 20 nt, Artificial Sequence
  MKO10017340_A_Fam184b
  gRNA
ucugaugucugacuuuacga

SEQ ID NO: 17341 - RNA, 20 nt, Artificial Sequence
  MKO10017341_A_Fam185a
  gRNA
acagaucacaucgccuccuu

SEQ ID NO: 17342 - RNA, 20 nt, Artificial Sequence
  MKO10017342_A_Fam185a
  gRNA
cuguaaaaucgacacugagc

SEQ ID NO: 17343 - RNA, 20 nt, Artificial Sequence
  MKO10017343_A_Fam185a
  gRNA
aaguuaccuucacagacugc

SEQ ID NO: 17344 - RNA, 20 nt, Artificial Sequence
  MKO10017344_A_Fam186b
  gRNA
uccguguccgugccgaagau

SEQ ID NO: 17345 - RNA, 20 nt, Artificial Sequence
  MKO10017345_A_Fam186b
  gRNA
cggacacggauucgagggug

SEQ ID NO: 17346 - RNA, 20 nt, Artificial Sequence
  MKO10017346_A_Fam186b
  gRNA
aagacgaagcccuagacgaa

SEQ ID NO: 17347 - RNA, 20 nt, Artificial Sequence
  MKO10017347_A_Fam187a
  gRNA
cgccucgcuacauuaagacu

SEQ ID NO: 17348 - RNA, 20 nt, Artificial Sequence
  MKO10017348_A_Fam187a
  gRNA
gaagccgcucacguucgcgu

SEQ ID NO: 17349 - RNA, 20 nt, Artificial Sequence
  MKO10017349_A_Fam187a
  gRNA
agcaugcucuggucgggccc

SEQ ID NO: 17350 - RNA, 20 nt, Artificial Sequence
  MKO10017350_A_Fam187b
  gRNA
acgucuaggcuacugcuaug

SEQ ID NO: 17351 - RNA, 20 nt, Artificial Sequence
  MKO10017351_A_Fam187b
  gRNA
ccuagacguuugcgcucacc

SEQ ID NO: 17352 - RNA, 20 nt, Artificial Sequence
  MKO10017352_A_Fam187b
  gRNA
aguaucucuguacuggccgu

SEQ ID NO: 17353 - RNA, 20 nt, Artificial Sequence
  MKO10017353_A_Fam188a
  gRNA
cauaccugagcaaucccgcc

SEQ ID NO: 17354 - RNA, 20 nt, Artificial Sequence
  MKO10017354_A_Fam188a
  gRNA
ugcuguuauugcaccugucc

SEQ ID NO: 17355 - RNA, 20 nt, Artificial Sequence
  MKO10017355_A_Fam188a
  gRNA
agaaauccuagccgcuuccu

SEQ ID NO: 17356 - RNA, 20 nt, Artificial Sequence
  MKO10017356_A_Fam188b
  gRNA
ggaaagagcguucaagcguc

SEQ ID NO: 17357 - RNA, 20 nt, Artificial Sequence
  MKO10017357_A_Fam188b
  gRNA
aaucaggccagacuuaggcc

SEQ ID NO: 17358 - RNA, 20 nt, Artificial Sequence
  MKO10017358_A_Fam188b
  gRNA
aagucuggccugauuguccg

SEQ ID NO: 17359 - RNA, 20 nt, Artificial Sequence
  MKO10017359_A_Fam189a1
  gRNA
ucacuuaccacaagcgagag

SEQ ID NO: 17360 - RNA, 20 nt, Artificial Sequence
  MKO10017360_A_Fam189a1
  gRNA
gagcugcaacaccacucauc

SEQ ID NO: 17361 - RNA, 20 nt, Artificial Sequence
  MKO10017361_A_Fam189a1
  gRNA
uuagaucaaguucgacagug

SEQ ID NO: 17362 - RNA, 20 nt, Artificial Sequence
  MKO10017362_A_Fam189a2
  gRNA
aguuuguguccagcgugccc

SEQ ID NO: 17363 - RNA, 20 nt, Artificial Sequence
  MKO10017363_A_Fam189a2
  gRNA
uacaauacauggccuucugc

SEQ ID NO: 17364 - RNA, 20 nt, Artificial Sequence
  MKO10017364_A_Fam189a2
  gRNA
ugcauccuccuaaaucucgc

SEQ ID NO: 17365 - RNA, 20 nt, Artificial Sequence
  MKO10017365_A_Fam189b
  gRNA
ugucccuagcuggcguucuc

SEQ ID NO: 17366 - RNA, 20 nt, Artificial Sequence
  MKO10017366_A_Fam189b
  gRNA
gcaccuaccacuagagugaa

SEQ ID NO: 17367 - RNA, 20 nt, Artificial Sequence
  MKO10017367_A_Fam189b
  gRNA
acagauuauugcagcacaaa

SEQ ID NO: 17368 - RNA, 20 nt, Artificial Sequence
  MKO10017368_A_Fam192a
  gRNA
acccucggucucuguacgaa

SEQ ID NO: 17369 - RNA, 20 nt, Artificial Sequence
  MKO10017369_A_Fam192a
  gRNA
agccguucguacagagaccg

SEQ ID NO: 17370 - RNA, 20 nt, Artificial Sequence
  MKO10017370_A_Fam192a
  gRNA
ccaccuugagccuugucauc

SEQ ID NO: 17371 - RNA, 20 nt, Artificial Sequence
  MKO10017371_A_Fam193a
  gRNA
gguccgaugcauauaccgcc

SEQ ID NO: 17372 - RNA, 20 nt, Artificial Sequence
  MKO10017372_A_Fam193a
  gRNA
uacugauggaucgugcugcc

SEQ ID NO: 17373 - RNA, 20 nt, Artificial Sequence
  MKO10017373_A_Fam193a
  gRNA
cugccuggcgguauaugcau

SEQ ID NO: 17374 - RNA, 20 nt, Artificial Sequence
  MKO10017374_A_Fam193b
  gRNA
cacucgcugccccgacgagc

SEQ ID NO: 17375 - RNA, 20 nt, Artificial Sequence
  MKO10017375_A_Fam193b
  gRNA
ugcgguggaccaccgagaug

SEQ ID NO: 17376 - RNA, 20 nt, Artificial Sequence
  MKO10017376_A_Fam193b
  gRNA
ggacucccaagcgagcugcc

SEQ ID NO: 17377 - RNA, 20 nt, Artificial Sequence
  MKO10017377_A_Fam194a
  gRNA
guuuccguuaucucaauaga

SEQ ID NO: 17378 - RNA, 20 nt, Artificial Sequence
  MKO10017378_A_Fam194a
  gRNA
acucaagcuucuauguuaag

SEQ ID NO: 17379 - RNA, 20 nt, Artificial Sequence
  MKO10017379_A_Fam194a
  gRNA
ugucugaagugacuguagau

SEQ ID NO: 17380 - RNA, 20 nt, Artificial Sequence
  MKO10017380_A_Fam195a
  gRNA
uaccuauugaccucgaugag

SEQ ID NO: 17381 - RNA, 20 nt, Artificial Sequence
  MKO10017381_A_Fam195a
  gRNA
aacguccgauuuguguccga

SEQ ID NO: 17382 - RNA, 20 nt, Artificial Sequence
  MKO10017382_A_Fam195a
  gRNA
gcugugcccaccacucaucg

SEQ ID NO: 17383 - RNA, 20 nt, Artificial Sequence
  MKO10017383_A_Fam195b
  gRNA
ccugcguguuccggcgcuuc

SEQ ID NO: 17384 - RNA, 20 nt, Artificial Sequence
  MKO10017384_A_Fam195b
  gRNA
cgcacauucucuucgugugc

SEQ ID NO: 17385 - RNA, 20 nt, Artificial Sequence
  MKO10017385_A_Fam195b
  gRNA
accugagugaccugaagcgc

SEQ ID NO: 17386 - RNA, 20 nt, Artificial Sequence
  MKO10017386_A_Fam196a
  gRNA
uugggaauggaucggcgugc

SEQ ID NO: 17387 - RNA, 20 nt, Artificial Sequence
  MKO10017387_A_Fam196a
  gRNA
gauucacaagaccaccgcau

SEQ ID NO: 17388 - RNA, 20 nt, Artificial Sequence
  MKO10017388_A_Fam196a
  gRNA
cagcuaauugugacacgugc

SEQ ID NO: 17389 - RNA, 20 nt, Artificial Sequence
  MKO10017389_A_Fam196b
  gRNA
aucgcagcaagugcgauuca

SEQ ID NO: 17390 - RNA, 20 nt, Artificial Sequence
  MKO10017390_A_Fam196b
  gRNA
ugaaacaaccgcaccaccgc

SEQ ID NO: 17391 - RNA, 20 nt, Artificial Sequence
  MKO10017391_A_Fam196b
  gRNA
cuuauaggcggaacuucuau

SEQ ID NO: 17392 - RNA, 20 nt, Artificial Sequence
  MKO10017392_A_Fam198a
  gRNA
cuaauagaagcucacgaucc

SEQ ID NO: 17393 - RNA, 20 nt, Artificial Sequence
  MKO10017393_A_Fam198a
  gRNA
gacgcaccaacuuccccccg

SEQ ID NO: 17394 - RNA, 20 nt, Artificial Sequence
  MKO10017394_A_Fam198a
  gRNA
uccguagguccacgaccgcc

SEQ ID NO: 17395 - RNA, 20 nt, Artificial Sequence
  MKO10017395_A_Fam198b
  gRNA
cugcggauuccgaccucgaa

SEQ ID NO: 17396 - RNA, 20 nt, Artificial Sequence
  MKO10017396_A_Fam198b
  gRNA
accgugccacggauauucgc

SEQ ID NO: 17397 - RNA, 20 nt, Artificial Sequence
  MKO10017397_A_Fam198b
  gRNA
uaccacucuuagagauaggu

SEQ ID NO: 17398 - RNA, 20 nt, Artificial Sequence
  MKO10017398_A_Fam199x
  gRNA
cccuuguaggccgcugacga

SEQ ID NO: 17399 - RNA, 20 nt, Artificial Sequence
  MKO10017399_A_Fam199x
  gRNA
agguggaaccucacuucgug

SEQ ID NO: 17400 - RNA, 20 nt, Artificial Sequence
  MKO10017400_A_Fam199x
  gRNA
ccucaucuaucagcacguac

SEQ ID NO: 17401 - RNA, 20 nt, Artificial Sequence
  MKO10017401_A_Fam19a1
  gRNA
uuugugaccgcuccucgaug

SEQ ID NO: 17402 - RNA, 20 nt, Artificial Sequence
  MKO10017402_A_Fam19a1
  gRNA
uuguaacaagaaccgcaucg

SEQ ID NO: 17403 - RNA, 20 nt, Artificial Sequence
  MKO10017403_A_Fam19a1
  gRNA
cccacuuaccuggccggugc

SEQ ID NO: 17404 - RNA, 20 nt, Artificial Sequence
  MKO10017404_A_Fam19a2
  gRNA
ccgagcugcuccgucuugug

SEQ ID NO: 17405 - RNA, 20 nt, Artificial Sequence
  MKO10017405_A_Fam19a2
  gRNA
ggaaacggcuuucccccaca

SEQ ID NO: 17406 - RNA, 20 nt, Artificial Sequence
  MKO10017406_A_Fam19a2
  gRNA
cagcuccauccuuugcgauc

SEQ ID NO: 17407 - RNA, 20 nt, Artificial Sequence
  MKO10017407_A_Fam19a3
  gRNA
augugcagcaaucaccucgc

SEQ ID NO: 17408 - RNA, 20 nt, Artificial Sequence
  MKO10017408_A_Fam19a3
  gRNA
agcgcuccucaaugcgguuc

SEQ ID NO: 17409 - RNA, 20 nt, Artificial Sequence
  MKO10017409_A_Fam19a3
  gRNA
uuccccagaccugcggaugu

SEQ ID NO: 17410 - RNA, 20 nt, Artificial Sequence
  MKO10017410_A_Fam19a4
  gRNA
cugcaauaagaaccgcauag

SEQ ID NO: 17411 - RNA, 20 nt, Artificial Sequence
  MKO10017411_A_Fam19a4
  gRNA
cgcagguaccuggcuugauc

SEQ ID NO: 17412 - RNA, 20 nt, Artificial Sequence
  MKO10017412_A_Fam19a4
  gRNA
acagcagaccauuaacacau

SEQ ID NO: 17413 - RNA, 20 nt, Artificial Sequence
  MKO10017413_A_Fam19a5
  gRNA
ggaacugcgcgugaaucacc

SEQ ID NO: 17414 - RNA, 20 nt, Artificial Sequence
  MKO10017414_A_Fam19a5
  gRNA
agccacggaggacgaucgcc

SEQ ID NO: 17415 - RNA, 20 nt, Artificial Sequence
  MKO10017415_A_Fam19a5
  gRNA
gguggucuuuauccgcccuc

SEQ ID NO: 17416 - RNA, 20 nt, Artificial Sequence
  MKO10017416_A_Fam203a
  gRNA
gcucaucgaagccgucaugc

SEQ ID NO: 17417 - RNA, 20 nt, Artificial Sequence
  MKO10017417_A_Fam203a
  gRNA
ucccguaccugcuuccgacc

SEQ ID NO: 17418 - RNA, 20 nt, Artificial Sequence
  MKO10017418_A_Fam203a
  gRNA
ucaacaggugcgugguccaa

SEQ ID NO: 17419 - RNA, 20 nt, Artificial Sequence
  MKO10017419_A_Fam207a
  gRNA
ugaagcuucgccgugagcga

SEQ ID NO: 17420 - RNA, 20 nt, Artificial Sequence
  MKO10017420_A_Fam207a
  gRNA
accgucuggcuugcugccgc

SEQ ID NO: 17421 - RNA, 20 nt, Artificial Sequence
  MKO10017421_A_Fam207a
  gRNA
acagauagacccuagugcgu

SEQ ID NO: 17422 - RNA, 20 nt, Artificial Sequence
  MKO10017422_A_Fam209
  gRNA
ccaucucagcagcguccgca

SEQ ID NO: 17423 - RNA, 20 nt, Artificial Sequence
  MKO10017423_A_Fam209
  gRNA
uacuuuaacccagcucgaga

SEQ ID NO: 17424 - RNA, 20 nt, Artificial Sequence
  MKO10017424_A_Fam209
  gRNA
uaugugaugcugaaguuucg

SEQ ID NO: 17425 - RNA, 20 nt, Artificial Sequence
  MKO10017425_A_Fam20a
  gRNA
cccgcuccaguuucgaccag

SEQ ID NO: 17426 - RNA, 20 nt, Artificial Sequence
  MKO10017426_A_Fam20a
  gRNA
acagccacgggcuguacucc

SEQ ID NO: 17427 - RNA, 20 nt, Artificial Sequence
  MKO10017427_A_Fam20a
  gRNA
cuccuuugcagauuacagcc

SEQ ID NO: 17428 - RNA, 20 nt, Artificial Sequence
  MKO10017428_A_Fam20b
  gRNA
cuugaaagcucucguaguga

SEQ ID NO: 17429 - RNA, 20 nt, Artificial Sequence
  MKO10017429_A_Fam20b
  gRNA
agacgcgggccugagucaua

SEQ ID NO: 17430 - RNA, 20 nt, Artificial Sequence
  MKO10017430_A_Fam20b
  gRNA
ugcagaaacaucgacauccc

SEQ ID NO: 17431 - RNA, 20 nt, Artificial Sequence
  MKO10017431_A_Fam20c
  gRNA
cgcaguaaggcaucgauggc

SEQ ID NO: 17432 - RNA, 20 nt, Artificial Sequence
  MKO10017432_A_Fam20c
  gRNA
ucuuaucccgcgucacaucc

SEQ ID NO: 17433 - RNA, 20 nt, Artificial Sequence
  MKO10017433_A_Fam20c
  gRNA
ugacgcgggauaagaagcua

SEQ ID NO: 17434 - RNA, 20 nt, Artificial Sequence
  MKO10017434_A_Fam210a
  gRNA
gccagccgagacauaguccg

SEQ ID NO: 17435 - RNA, 20 nt, Artificial Sequence
  MKO10017435_A_Fam210a
  gRNA
gaucaccauuggcgcauaaa

SEQ ID NO: 17436 - RNA, 20 nt, Artificial Sequence
  MKO10017436_A_Fam210a
  gRNA
gucaaccccaccgccuguca

SEQ ID NO: 17437 - RNA, 20 nt, Artificial Sequence
  MKO10017437_A_Fam210b
  gRNA
gucagauacuuccgcagcgu

SEQ ID NO: 17438 - RNA, 20 nt, Artificial Sequence
  MKO10017438_A_Fam210b
  gRNA
cgacugcugcgcacggcccg

SEQ ID NO: 17439 - RNA, 20 nt, Artificial Sequence
  MKO10017439_A_Fam210b
  gRNA
uuuccaagaguacggggccg

SEQ ID NO: 17440 - RNA, 20 nt, Artificial Sequence
  MKO10017440_A_Fam211a
  gRNA
gccgcgaacgacccgacuuc

SEQ ID NO: 17441 - RNA, 20 nt, Artificial Sequence
  MKO10017441_A_Fam211a
  gRNA
ccccccuaucaccggcgcgu

SEQ ID NO: 17442 - RNA, 20 nt, Artificial Sequence
  MKO10017442_A_Fam211a
  gRNA
cgugugugaucggguccacc

SEQ ID NO: 17443 - RNA, 20 nt, Artificial Sequence
  MKO10017443_A_Fam211b
  gRNA
ggcccgcgcccuacgagcgc

SEQ ID NO: 17444 - RNA, 20 nt, Artificial Sequence
  MKO10017444_A_Fam211b
  gRNA
gccgcucccgaagcguggac

SEQ ID NO: 17445 - RNA, 20 nt, Artificial Sequence
  MKO10017445_A_Fam211b
  gRNA
gcagcacauaucacgcuacc

SEQ ID NO: 17446 - RNA, 20 nt, Artificial Sequence
  MKO10017446_A_Fam212a
  gRNA
ggcgacuucgacaguucaug

SEQ ID NO: 17447 - RNA, 20 nt, Artificial Sequence
  MKO10017447_A_Fam212a
  gRNA
gugacauuccuaugcgcagu

SEQ ID NO: 17448 - RNA, 20 nt, Artificial Sequence
  MKO10017448_A_Fam212a
  gRNA
gcuuccugagccagcuccgc

SEQ ID NO: 17449 - RNA, 20 nt, Artificial Sequence
  MKO10017449_A_Fam212b
  gRNA
accuccacguugaugucacg

SEQ ID NO: 17450 - RNA, 20 nt, Artificial Sequence
  MKO10017450_A_Fam212b
  gRNA
gcgugcggcccgacagagac

SEQ ID NO: 17451 - RNA, 20 nt, Artificial Sequence
  MKO10017451_A_Fam212b
  gRNA
cuaucugcgucgccucaaac

SEQ ID NO: 17452 - RNA, 20 nt, Artificial Sequence
  MKO10017452_A_Fam213a
  gRNA
uccuucaccaccgcauagag

SEQ ID NO: 17453 - RNA, 20 nt, Artificial Sequence
  MKO10017453_A_Fam213a
  gRNA
aacaucaucuuccgccucuc

SEQ ID NO: 17454 - RNA, 20 nt, Artificial Sequence
  MKO10017454_A_Fam213a
  gRNA
cuaucacaaaaacuccucca

SEQ ID NO: 17455 - RNA, 20 nt, Artificial Sequence
  MKO10017455_A_Fam213b
  gRNA
ggaccaacacgaugugcgcc

SEQ ID NO: 17456 - RNA, 20 nt, Artificial Sequence
  MKO10017456_A_Fam213b
  gRNA
uuggaggcuacaucacgaac

SEQ ID NO: 17457 - RNA, 20 nt, Artificial Sequence
  MKO10017457_A_Fam213b
  gRNA
gcagccgaagcgucgcagac

SEQ ID NO: 17458 - RNA, 20 nt, Artificial Sequence
  MKO10017458_A_Fam214a
  gRNA
aucaacgacgagcauagucc

SEQ ID NO: 17459 - RNA, 20 nt, Artificial Sequence
  MKO10017459_A_Fam214a
  gRNA
cuugucgcugcauucauguc

SEQ ID NO: 17460 - RNA, 20 nt, Artificial Sequence
  MKO10017460_A_Fam214a
  gRNA
gcaugccacuucugacgugc

SEQ ID NO: 17461 - RNA, 20 nt, Artificial Sequence
  MKO10017461_A_Fam214b
  gRNA
uguuucugagcaaaaugcgc

SEQ ID NO: 17462 - RNA, 20 nt, Artificial Sequence
  MKO10017462_A_Fam214b
  gRNA
ugacgggcagcgugacaugu

SEQ ID NO: 17463 - RNA, 20 nt, Artificial Sequence
  MKO10017463_A_Fam214b
  gRNA
caacuuacagcuucaggcga

SEQ ID NO: 17464 - RNA, 20 nt, Artificial Sequence
  MKO10017464_A_Fam216a
  gRNA
agaucuuagcaacgcugcac

SEQ ID NO: 17465 - RNA, 20 nt, Artificial Sequence
  MKO10017465_A_Fam216a
  gRNA
augcugcucgccagugcccu

SEQ ID NO: 17466 - RNA, 20 nt, Artificial Sequence
  MKO10017466_A_Fam216a
  gRNA
acuggcgagcagcauaaagc

SEQ ID NO: 17467 - RNA, 20 nt, Artificial Sequence
  MKO10017467_A_Fam216b
  gRNA
acuugaauucgagguauucg

SEQ ID NO: 17468 - RNA, 20 nt, Artificial Sequence
  MKO10017468_A_Fam216b
  gRNA
aaccguggcugaggcucgca

SEQ ID NO: 17469 - RNA, 20 nt, Artificial Sequence
  MKO10017469_A_Fam216b
  gRNA
cagagacuaugccuugucua

SEQ ID NO: 17470 - RNA, 20 nt, Artificial Sequence
  MKO10017470_A_Fam217a
  gRNA
uauuagcagaacaguaguca

SEQ ID NO: 17471 - RNA, 20 nt, Artificial Sequence
  MKO10017471_A_Fam217a
  gRNA
ugcaauaucagcuguucugc

SEQ ID NO: 17472 - RNA, 20 nt, Artificial Sequence
  MKO10017472_A_Fam217a
  gRNA
uggaguucuccuguuaauaa

SEQ ID NO: 17473 - RNA, 20 nt, Artificial Sequence
  MKO10017473_A_Fam217b
  gRNA
cguucccacggaaggaauac

SEQ ID NO: 17474 - RNA, 20 nt, Artificial Sequence
  MKO10017474_A_Fam217b
  gRNA
guaaggagcuuaccccgucc

SEQ ID NO: 17475 - RNA, 20 nt, Artificial Sequence
  MKO10017475_A_Fam217b
  gRNA
gggacugucaucagaaaagc

SEQ ID NO: 17476 - RNA, 20 nt, Artificial Sequence
  MKO10017476_A_Fam219a
  gRNA
ccggucgaucuccuccauca

SEQ ID NO: 17477 - RNA, 20 nt, Artificial Sequence
  MKO10017477_A_Fam219a
  gRNA
aggcuggucgucccuaauaa

SEQ ID NO: 17478 - RNA, 20 nt, Artificial Sequence
  MKO10017478_A_Fam219a
  gRNA
ugcccaugcugccguucuuc

SEQ ID NO: 17479 - RNA, 20 nt, Artificial Sequence
  MKO10017479_A_Fam219b
  gRNA
gggaccggucauggcgaccg

SEQ ID NO: 17480 - RNA, 20 nt, Artificial Sequence
  MKO10017480_A_Fam219b
  gRNA
acgaaccgacccgauucuuc

SEQ ID NO: 17481 - RNA, 20 nt, Artificial Sequence
  MKO10017481_A_Fam219b
  gRNA
aguuccgcgggcaugcggug

SEQ ID NO: 17482 - RNA, 20 nt, Artificial Sequence
  MKO10017482_A_Fam21
  gRNA
guugcucaaacgcgcuaucc

SEQ ID NO: 17483 - RNA, 20 nt, Artificial Sequence
  MKO10017483_A_Fam21
  gRNA
ggcugugaacuacggguuac

SEQ ID NO: 17484 - RNA, 20 nt, Artificial Sequence
  MKO10017484_A_Fam21
  gRNA
auuaugcagacgacaaugug

SEQ ID NO: 17485 - RNA, 20 nt, Artificial Sequence
  MKO10017485_A_Fam220a
  gRNA
gucucaccgauacuuugagc

SEQ ID NO: 17486 - RNA, 20 nt, Artificial Sequence
  MKO10017486_A_Fam220a
  gRNA
ucccuugaccguuucaaucc

SEQ ID NO: 17487 - RNA, 20 nt, Artificial Sequence
  MKO10017487_A_Fam220a
  gRNA
gcuggcccagcucaaaguau

SEQ ID NO: 17488 - RNA, 20 nt, Artificial Sequence
  MKO10017488_A_Fam221a
  gRNA
gaucagcacagugccgcucu

SEQ ID NO: 17489 - RNA, 20 nt, Artificial Sequence
  MKO10017489_A_Fam221a
  gRNA
gauguuccuuaugcggcaau

SEQ ID NO: 17490 - RNA, 20 nt, Artificial Sequence
  MKO10017490_A_Fam221a
  gRNA
gcccugccgugccgagugag

SEQ ID NO: 17491 - RNA, 20 nt, Artificial Sequence
  MKO10017491_A_Fam221b
  gRNA
ggcgcugcccgcauuauuua

SEQ ID NO: 17492 - RNA, 20 nt, Artificial Sequence
  MKO10017492_A_Fam221b
  gRNA
accaguucugcccgcuuagc

SEQ ID NO: 17493 - RNA, 20 nt, Artificial Sequence
  MKO10017493_A_Fam221b
  gRNA
ggguugaauccuucucccac

SEQ ID NO: 17494 - RNA, 20 nt, Artificial Sequence
  MKO10017494_A_Fam222a
  gRNA
cgacccguuggcccuuucga

SEQ ID NO: 17495 - RNA, 20 nt, Artificial Sequence
  MKO10017495_A_Fam222a
  gRNA
ggggcuguaacgcuggccgc

SEQ ID NO: 17496 - RNA, 20 nt, Artificial Sequence
  MKO10017496_A_Fam222a
  gRNA
acucacacuugcgcagaucc

SEQ ID NO: 17497 - RNA, 20 nt, Artificial Sequence
  MKO10017497_A_Fam222b
  gRNA
cacguucgucguacugugaa

SEQ ID NO: 17498 - RNA, 20 nt, Artificial Sequence
  MKO10017498_A_Fam222b
  gRNA
acgggugcaccccucgacug

SEQ ID NO: 17499 - RNA, 20 nt, Artificial Sequence
  MKO10017499_A_Fam222b
  gRNA
ucucacacgcagaugaacac

SEQ ID NO: 17500 - RNA, 20 nt, Artificial Sequence
  MKO10017500_A_Fam227a
  gRNA
gagccaccgauaucuugcca

SEQ ID NO: 17501 - RNA, 20 nt, Artificial Sequence
  MKO10017501_A_Fam227a
  gRNA
accaccaggcgcucguccaa

SEQ ID NO: 17502 - RNA, 20 nt, Artificial Sequence
  MKO10017502_A_Fam227a
  gRNA
cuccagcacuguccgaacgu

SEQ ID NO: 17503 - RNA, 20 nt, Artificial Sequence
  MKO10017503_A_Fam227b
  gRNA
ucgacgauaucauacagccg

SEQ ID NO: 17504 - RNA, 20 nt, Artificial Sequence
  MKO10017504_A_Fam227b
  gRNA
guaugauaucgucgacagcu

SEQ ID NO: 17505 - RNA, 20 nt, Artificial Sequence
  MKO10017505_A_Fam227b
  gRNA
agaaauuaccggauccccca

SEQ ID NO: 17506 - RNA, 20 nt, Artificial Sequence
  MKO10017506_A_Fam228a
  gRNA
ccuucaccccguucucgcuc

SEQ ID NO: 17507 - RNA, 20 nt, Artificial Sequence
  MKO10017507_A_Fam228a
  gRNA
acucugcauaagccgagcag

SEQ ID NO: 17508 - RNA, 20 nt, Artificial Sequence
  MKO10017508_A_Fam228a
  gRNA
ggauacauauuuacagcauc

SEQ ID NO: 17509 - RNA, 20 nt, Artificial Sequence
  MKO10017509_A_Fam228b
  gRNA
uuucaucauccuggucauau

SEQ ID NO: 17510 - RNA, 20 nt, Artificial Sequence
  MKO10017510_A_Fam228b
  gRNA
acccuucugcagugugagac

SEQ ID NO: 17511 - RNA, 20 nt, Artificial Sequence
  MKO10017511_A_Fam228b
  gRNA
uccucuuugcucauauaaaa

SEQ ID NO: 17512 - RNA, 20 nt, Artificial Sequence
  MKO10017512_A_Fam229a
  gRNA
uggaccggagcguccucccg

SEQ ID NO: 17513 - RNA, 20 nt, Artificial Sequence
  MKO10017513_A_Fam229a
  gRNA
cagcccgggcagcgucggag

SEQ ID NO: 17514 - RNA, 20 nt, Artificial Sequence
  MKO10017514_A_Fam229a
  gRNA
acgggaggacgcuccggucc

SEQ ID NO: 17515 - RNA, 20 nt, Artificial Sequence
  MKO10017515_A_Fam229b
  gRNA
ggcugggucccaaaccgaaa

SEQ ID NO: 17516 - RNA, 20 nt, Artificial Sequence
  MKO10017516_A_Fam229b
  gRNA
ucuucaauugagcuagaauc

SEQ ID NO: 17517 - RNA, 20 nt, Artificial Sequence
  MKO10017517_A_Fam229b
  gRNA
auuuccuugcugcuuugcgc

SEQ ID NO: 17518 - RNA, 20 nt, Artificial Sequence
  MKO10017518_A_Fam24a
  gRNA
augcuacagucgucacaaca

SEQ ID NO: 17519 - RNA, 20 nt, Artificial Sequence
  MKO10017519_A_Fam24a
  gRNA
ugugaaagauguucgacuug

SEQ ID NO: 17520 - RNA, 20 nt, Artificial Sequence
  MKO10017520_A_Fam24a
  gRNA
ggcccggaugaucuucucau

SEQ ID NO: 17521 - RNA, 20 nt, Artificial Sequence
  MKO10017521_A_Fam25c
  gRNA
uuucuuuagggcgucauuaa

SEQ ID NO: 17522 - RNA, 20 nt, Artificial Sequence
  MKO10017522_A_Fam25c
  gRNA
gaagcuggcggccgagggcc

SEQ ID NO: 17523 - RNA, 20 nt, Artificial Sequence
  MKO10017523_A_Fam25c
  gRNA
ccauacgaugcugggaggcc

SEQ ID NO: 17524 - RNA, 20 nt, Artificial Sequence
  MKO10017524_A_Fam26d
  gRNA
cauuagcaaacaucggguau

SEQ ID NO: 17525 - RNA, 20 nt, Artificial Sequence
  MKO10017525_A_Fam26d
  gRNA
uauucguaucccuucguguc

SEQ ID NO: 17526 - RNA, 20 nt, Artificial Sequence
  MKO10017526_A_Fam26d
  gRNA
gucaccgucaaccaugucag

SEQ ID NO: 17527 - RNA, 20 nt, Artificial Sequence
  MKO10017527_A_Fam26e
  gRNA
gaagagacguucgcuaccca

SEQ ID NO: 17528 - RNA, 20 nt, Artificial Sequence
  MKO10017528_A_Fam26e
  gRNA
uauggaacaaaccccgcaag

SEQ ID NO: 17529 - RNA, 20 nt, Artificial Sequence
  MKO10017529_A_Fam26e
  gRNA
ggaaggacgccgaacaaauc

SEQ ID NO: 17530 - RNA, 20 nt, Artificial Sequence
  MKO10017530_A_Fam26f
  gRNA
ccgaacugaaucgcgcgcuc

SEQ ID NO: 17531 - RNA, 20 nt, Artificial Sequence
  MKO10017531_A_Fam26f
  gRNA
ucgcggcccuugcacaggua

SEQ ID NO: 17532 - RNA, 20 nt, Artificial Sequence
  MKO10017532_A_Fam26f
  gRNA
cuuugagugcucgaagccga

SEQ ID NO: 17533 - RNA, 20 nt, Artificial Sequence
  MKO10017533_A_Fam32a
  gRNA
gcccuucuggacuugcucgu

SEQ ID NO: 17534 - RNA, 20 nt, Artificial Sequence
  MKO10017534_A_Fam32a
  gRNA
ggccuacgagcaaguccaga

SEQ ID NO: 17535 - RNA, 20 nt, Artificial Sequence
  MKO10017535_A_Fam32a
  gRNA
cugccuggacaagcgcacgc

SEQ ID NO: 17536 - RNA, 20 nt, Artificial Sequence
  MKO10017536_A_Fam35a
  gRNA
agacuuagcgacucaccuag

SEQ ID NO: 17537 - RNA, 20 nt, Artificial Sequence
  MKO10017537_A_Fam35a
  gRNA
ccuuugaagcugaguauacc

SEQ ID NO: 17538 - RNA, 20 nt, Artificial Sequence
  MKO10017538_A_Fam35a
  gRNA
acaagucaguuacuaaaucu

SEQ ID NO: 17539 - RNA, 20 nt, Artificial Sequence
  MKO10017539_A_Fam3a
  gRNA
ugcaggcccccugcgcaucg

SEQ ID NO: 17540 - RNA, 20 nt, Artificial Sequence
  MKO10017540_A_Fam3a
  gRNA
cgcugacuauucgaaagcuc

SEQ ID NO: 17541 - RNA, 20 nt, Artificial Sequence
  MKO10017541_A_Fam3a
  gRNA
ccguggccugaacaucgccc

SEQ ID NO: 17542 - RNA, 20 nt, Artificial Sequence
  MKO10017542_A_Fam3b
  gRNA
cucuacaacauccgaagcau

SEQ ID NO: 17543 - RNA, 20 nt, Artificial Sequence
  MKO10017543_A_Fam3b
  gRNA
ucggauguuguagagagugc

SEQ ID NO: 17544 - RNA, 20 nt, Artificial Sequence
  MKO10017544_A_Fam3b
  gRNA
cuccugacaccuaugccuac

SEQ ID NO: 17545 - RNA, 20 nt, Artificial Sequence
  MKO10017545_A_Fam3c
  gRNA
cuccuuagcucgauccgcgc

SEQ ID NO: 17546 - RNA, 20 nt, Artificial Sequence
  MKO10017546_A_Fam3c
  gRNA
acgaauggcugaguccagcg

SEQ ID NO: 17547 - RNA, 20 nt, Artificial Sequence
  MKO10017547_A_Fam3c
  gRNA
gaucuugggucccacgacau

SEQ ID NO: 17548 - RNA, 20 nt, Artificial Sequence
  MKO10017548_A_Fam43a
  gRNA
ugcaaccguccccgcgcgcc

SEQ ID NO: 17549 - RNA, 20 nt, Artificial Sequence
  MKO10017549_A_Fam43a
  gRNA
ggacgguugcacugaccuag

SEQ ID NO: 17550 - RNA, 20 nt, Artificial Sequence
  MKO10017550_A_Fam43a
  gRNA
ucacccuuaaaucggucucc

SEQ ID NO: 17551 - RNA, 20 nt, Artificial Sequence
  MKO10017551_A_Fam43b
  gRNA
gcgcccauccgccgcgcagu

SEQ ID NO: 17552 - RNA, 20 nt, Artificial Sequence
  MKO10017552_A_Fam43b
  gRNA
cccgcgccagcaacacagcg

SEQ ID NO: 17553 - RNA, 20 nt, Artificial Sequence
  MKO10017553_A_Fam43b
  gRNA
ucaacgccaagugcgcuuac

SEQ ID NO: 17554 - RNA, 20 nt, Artificial Sequence
  MKO10017554_A_Fam45a
  gRNA
ccuacacaauauccuaguga

SEQ ID NO: 17555 - RNA, 20 nt, Artificial Sequence
  MKO10017555_A_Fam45a
  gRNA
cuguacugaccaaagacgaa

SEQ ID NO: 17556 - RNA, 20 nt, Artificial Sequence
  MKO10017556_A_Fam45a
  gRNA
agaaauaugccgccuucacu

SEQ ID NO: 17557 - RNA, 20 nt, Artificial Sequence
  MKO10017557_A_Fam46a
  gRNA
guccgcgacgugcgccucaa

SEQ ID NO: 17558 - RNA, 20 nt, Artificial Sequence
  MKO10017558_A_Fam46a
  gRNA
cagcacauugcagugcgccg

SEQ ID NO: 17559 - RNA, 20 nt, Artificial Sequence
  MKO10017559_A_Fam46a
  gRNA
ucucugaacacucguaaaag

SEQ ID NO: 17560 - RNA, 20 nt, Artificial Sequence
  MKO10017560_A_Fam46b
  gRNA
uuggccggaagccccguacc

SEQ ID NO: 17561 - RNA, 20 nt, Artificial Sequence
  MKO10017561_A_Fam46b
  gRNA
gccgacucuggugccguccc

SEQ ID NO: 17562 - RNA, 20 nt, Artificial Sequence
  MKO10017562_A_Fam46b
  gRNA
ggucaaagugugcaccgacc

SEQ ID NO: 17563 - RNA, 20 nt, Artificial Sequence
  MKO10017563_A_Fam46c
  gRNA
ucagguuagccggcugcacg

SEQ ID NO: 17564 - RNA, 20 nt, Artificial Sequence
  MKO10017564_A_Fam46c
  gRNA
uugagcuuauucacgcccuc

SEQ ID NO: 17565 - RNA, 20 nt, Artificial Sequence
  MKO10017565_A_Fam46c
  gRNA
uuggaaaguugccucgcccg

SEQ ID NO: 17566 - RNA, 20 nt, Artificial Sequence
  MKO10017566_A_Fam46d
  gRNA
uuugcaauaaccaugaucgc

SEQ ID NO: 17567 - RNA, 20 nt, Artificial Sequence
  MKO10017567_A_Fam46d
  gRNA
uacauacucgcaagccauaa

SEQ ID NO: 17568 - RNA, 20 nt, Artificial Sequence
  MKO10017568_A_Fam46d
  gRNA
agaugagacuccagcgauca

SEQ ID NO: 17569 - RNA, 20 nt, Artificial Sequence
  MKO10017569_A_Fam47c
  gRNA
gccauggaaucgcccccggc

SEQ ID NO: 17570 - RNA, 20 nt, Artificial Sequence
  MKO10017570_A_Fam47c
  gRNA
cuacaguaugccggccaucc

SEQ ID NO: 17571 - RNA, 20 nt, Artificial Sequence
  MKO10017571_A_Fam47c
  gRNA
ucuaagagcucaauaucgcu

SEQ ID NO: 17572 - RNA, 20 nt, Artificial Sequence
  MKO10017572_A_Fam47e
  gRNA
ugaaccucuggucgacccca

SEQ ID NO: 17573 - RNA, 20 nt, Artificial Sequence
  MKO10017573_A_Fam47e
  gRNA
uuacaagguccucggcccag

SEQ ID NO: 17574 - RNA, 20 nt, Artificial Sequence
  MKO10017574_A_Fam47e
  gRNA
cuccucuguguacgucauca

SEQ ID NO: 17575 - RNA, 20 nt, Artificial Sequence
  MKO10017575_A_Fam49a
  gRNA
ccuucagcucaucgaaucga

SEQ ID NO: 17576 - RNA, 20 nt, Artificial Sequence
  MKO10017576_A_Fam49a
  gRNA
ccuucgauucgaugagcuga

SEQ ID NO: 17577 - RNA, 20 nt, Artificial Sequence
  MKO10017577_A_Fam49a
  gRNA
ggacuuacaucucggaucuc

SEQ ID NO: 17578 - RNA, 20 nt, Artificial Sequence
  MKO10017578_A_Fam49b
  gRNA
agcuggccacgaaauacgag

SEQ ID NO: 17579 - RNA, 20 nt, Artificial Sequence
  MKO10017579_A_Fam49b
  gRNA
acuuuaccucucguauuucg

SEQ ID NO: 17580 - RNA, 20 nt, Artificial Sequence
  MKO10017580_A_Fam49b
  gRNA
ggugcagucgugccacuagu

SEQ ID NO: 17581 - RNA, 20 nt, Artificial Sequence
  MKO10017581_A_Fam50a
  gRNA
caggcuggagaucuuccgcu

SEQ ID NO: 17582 - RNA, 20 nt, Artificial Sequence
  MKO10017582_A_Fam50a
  gRNA
ggaagagauggcuauguacg

SEQ ID NO: 17583 - RNA, 20 nt, Artificial Sequence
  MKO10017583_A_Fam50a
  gRNA
agagcucaaguccaguacug

SEQ ID NO: 17584 - RNA, 20 nt, Artificial Sequence
  MKO10017584_A_Fam50b
  gRNA
ucgacgugcacgacgaugug

SEQ ID NO: 17585 - RNA, 20 nt, Artificial Sequence
  MKO10017585_A_Fam50b
  gRNA
cucggcacacuacgacgccg

SEQ ID NO: 17586 - RNA, 20 nt, Artificial Sequence
  MKO10017586_A_Fam50b
  gRNA
ggagcaacgccggauacagc

SEQ ID NO: 17587 - RNA, 20 nt, Artificial Sequence
  MKO10017587_A_Fam53a
  gRNA
ccucccgucuucgcuugcgc

SEQ ID NO: 17588 - RNA, 20 nt, Artificial Sequence
  MKO10017588_A_Fam53a
  gRNA
cggcaucgagcuagcuccuc

SEQ ID NO: 17589 - RNA, 20 nt, Artificial Sequence
  MKO10017589_A_Fam53a
  gRNA
guccuccccguguaacucac

SEQ ID NO: 17590 - RNA, 20 nt, Artificial Sequence
  MKO10017590_A_Fam53b
  gRNA
ucgagccugcaccaccgcuu

SEQ ID NO: 17591 - RNA, 20 nt, Artificial Sequence
  MKO10017591_A_Fam53b
  gRNA
ccgccaugacguccggcaac

SEQ ID NO: 17592 - RNA, 20 nt, Artificial Sequence
  MKO10017592_A_Fam53b
  gRNA
ucgucagcaguacccgaucc

SEQ ID NO: 17593 - RNA, 20 nt, Artificial Sequence
  MKO10017593_A_Fam53c
  gRNA
cacgcgcuucagcgucaguc

SEQ ID NO: 17594 - RNA, 20 nt, Artificial Sequence
  MKO10017594_A_Fam53c
  gRNA
cuugggggaguuuccccgac

SEQ ID NO: 17595 - RNA, 20 nt, Artificial Sequence
  MKO10017595_A_Fam53c
  gRNA
cccgcaaaacuggugucaag

SEQ ID NO: 17596 - RNA, 20 nt, Artificial Sequence
  MKO10017596_A_Fam57a
  gRNA
gaguacuccguuugugucgc

SEQ ID NO: 17597 - RNA, 20 nt, Artificial Sequence
  MKO10017597_A_Fam57a
  gRNA
ccugauugaaaaccgccuua

SEQ ID NO: 17598 - RNA, 20 nt, Artificial Sequence
  MKO10017598_A_Fam57a
  gRNA
ccgugugaugugugaccaua

SEQ ID NO: 17599 - RNA, 20 nt, Artificial Sequence
  MKO10017599_A_Fam57b
  gRNA
acaccaguaccauggccgcg

SEQ ID NO: 17600 - RNA, 20 nt, Artificial Sequence
  MKO10017600_A_Fam57b
  gRNA
ugcaaacuguguauaggccg

SEQ ID NO: 17601 - RNA, 20 nt, Artificial Sequence
  MKO10017601_A_Fam57b
  gRNA
gacgugggccgggauggcca

SEQ ID NO: 17602 - RNA, 20 nt, Artificial Sequence
  MKO10017602_A_Fam58b
  gRNA
agcggaggcauagccccccg

SEQ ID NO: 17603 - RNA, 20 nt, Artificial Sequence
  MKO10017603_A_Fam58b
  gRNA
ggcccgcuuucgcagcuguc

SEQ ID NO: 17604 - RNA, 20 nt, Artificial Sequence
  MKO10017604_A_Fam58b
  gRNA
acaucaucaacgugucgcac

SEQ ID NO: 17605 - RNA, 20 nt, Artificial Sequence
  MKO10017605_A_Fam60a
  gRNA
uuuagacagaaaauauguug

SEQ ID NO: 17606 - RNA, 20 nt, Artificial Sequence
  MKO10017606_A_Fam60a
  gRNA
caggugguagaugcaagagc

SEQ ID NO: 17607 - RNA, 20 nt, Artificial Sequence
  MKO10017607_A_Fam60a
  gRNA
agguugcaugagacucgcuc

SEQ ID NO: 17608 - RNA, 20 nt, Artificial Sequence
  MKO10017608_A_Fam63a
  gRNA
cuccgacuuugaguauacgc

SEQ ID NO: 17609 - RNA, 20 nt, Artificial Sequence
  MKO10017609_A_Fam63a
  gRNA
cccgaaacuggccacagguc

SEQ ID NO: 17610 - RNA, 20 nt, Artificial Sequence
  MKO10017610_A_Fam63a
  gRNA
agcuugugggacgucaccua

SEQ ID NO: 17611 - RNA, 20 nt, Artificial Sequence
  MKO10017611_A_Fam63b
  gRNA
ugaaccugacauucacgucc

SEQ ID NO: 17612 - RNA, 20 nt, Artificial Sequence
  MKO10017612_A_Fam63b
  gRNA
ucaacguguaaauuaugaac

SEQ ID NO: 17613 - RNA, 20 nt, Artificial Sequence
  MKO10017613_A_Fam63b
  gRNA
accgaccuucacuaaccaac

SEQ ID NO: 17614 - RNA, 20 nt, Artificial Sequence
  MKO10017614_A_Fam64a
  gRNA
gcgcagacgaucacuccuaa

SEQ ID NO: 17615 - RNA, 20 nt, Artificial Sequence
  MKO10017615_A_Fam64a
  gRNA
aggggccguuaccgagguuc

SEQ ID NO: 17616 - RNA, 20 nt, Artificial Sequence
  MKO10017616_A_Fam64a
  gRNA
gccaaccgggaugcuagagu

SEQ ID NO: 17617 - RNA, 20 nt, Artificial Sequence
  MKO10017617_A_Fam65a
  gRNA
ugaacgcuuucuucgacgac

SEQ ID NO: 17618 - RNA, 20 nt, Artificial Sequence
  MKO10017618_A_Fam65a
  gRNA
ucgucgaagaaagcguucaa

SEQ ID NO: 17619 - RNA, 20 nt, Artificial Sequence
  MKO10017619_A_Fam65a
  gRNA
uagugcucucccgaguguca

SEQ ID NO: 17620 - RNA, 20 nt, Artificial Sequence
  MKO10017620_A_Fam65b
  gRNA
auccggagccaguccuucgc

SEQ ID NO: 17621 - RNA, 20 nt, Artificial Sequence
  MKO10017621_A_Fam65b
  gRNA
cuggcuccggaugaugccau

SEQ ID NO: 17622 - RNA, 20 nt, Artificial Sequence
  MKO10017622_A_Fam65b
  gRNA
ucaauuuguccagcuccguc

SEQ ID NO: 17623 - RNA, 20 nt, Artificial Sequence
  MKO10017623_A_Fam65c
  gRNA
gcgcaaggguucgcuaugcc

SEQ ID NO: 17624 - RNA, 20 nt, Artificial Sequence
  MKO10017624_A_Fam65c
  gRNA
uguccguguggcguccacac

SEQ ID NO: 17625 - RNA, 20 nt, Artificial Sequence
  MKO10017625_A_Fam65c
  gRNA
cuaccuguguggacgccaca

SEQ ID NO: 17626 - RNA, 20 nt, Artificial Sequence
  MKO10017626_A_Fam69a
  gRNA
aagauacuucacccgcaugu

SEQ ID NO: 17627 - RNA, 20 nt, Artificial Sequence
  MKO10017627_A_Fam69a
  gRNA
auaaccuaaaaacguuauug

SEQ ID NO: 17628 - RNA, 20 nt, Artificial Sequence
  MKO10017628_A_Fam69a
  gRNA
cuguaccguagacacagucc

SEQ ID NO: 17629 - RNA, 20 nt, Artificial Sequence
  MKO10017629_A_Fam69b
  gRNA
cgcaccugcaccacgcugag

SEQ ID NO: 17630 - RNA, 20 nt, Artificial Sequence
  MKO10017630_A_Fam69b
  gRNA
agcuaccuacgacuucaaga

SEQ ID NO: 17631 - RNA, 20 nt, Artificial Sequence
  MKO10017631_A_Fam69b
  gRNA
cuccucagugcgaccaguac

SEQ ID NO: 17632 - RNA, 20 nt, Artificial Sequence
  MKO10017632_A_Fam69c
  gRNA
gcagguugcuguugacacgc

SEQ ID NO: 17633 - RNA, 20 nt, Artificial Sequence
  MKO10017633_A_Fam69c
  gRNA
gguagcuauugacguagaca

SEQ ID NO: 17634 - RNA, 20 nt, Artificial Sequence
  MKO10017634_A_Fam69c
  gRNA
cacugcauaaaagugaccgc

SEQ ID NO: 17635 - RNA, 20 nt, Artificial Sequence
  MKO10017635_A_Fam71a
  gRNA
cgugcacaaucguguccgaa

SEQ ID NO: 17636 - RNA, 20 nt, Artificial Sequence
  MKO10017636_A_Fam71a
  gRNA
auuagagacaaccgacguaa

SEQ ID NO: 17637 - RNA, 20 nt, Artificial Sequence
  MKO10017637_A_Fam71a
  gRNA
augaagucgcucucgaauau

SEQ ID NO: 17638 - RNA, 20 nt, Artificial Sequence
  MKO10017638_A_Fam71b
  gRNA
uguucacaaccgcguccgaa

SEQ ID NO: 17639 - RNA, 20 nt, Artificial Sequence
  MKO10017639_A_Fam71b
  gRNA
cagacgagcccgauucauca

SEQ ID NO: 17640 - RNA, 20 nt, Artificial Sequence
  MKO10017640_A_Fam71b
  gRNA
gugucaaccuugcagagcga

SEQ ID NO: 17641 - RNA, 20 nt, Artificial Sequence
  MKO10017641_A_Fam71d
  gRNA
accugcauaaccgagcaaac

SEQ ID NO: 17642 - RNA, 20 nt, Artificial Sequence
  MKO10017642_A_Fam71d
  gRNA
cccaguuugcucgguuaugc

SEQ ID NO: 17643 - RNA, 20 nt, Artificial Sequence
  MKO10017643_A_Fam71d
  gRNA
cacugaugucaccgauaugc

SEQ ID NO: 17644 - RNA, 20 nt, Artificial Sequence
  MKO10017644_A_Fam71e1
  gRNA
aacucgcagucgcgggucuc

SEQ ID NO: 17645 - RNA, 20 nt, Artificial Sequence
  MKO10017645_A_Fam71e1
  gRNA
gcuggucgaacucgccgcuc

SEQ ID NO: 17646 - RNA, 20 nt, Artificial Sequence
  MKO10017646_A_Fam71e1
  gRNA
gagacccgcgacugcgaguu

SEQ ID NO: 17647 - RNA, 20 nt, Artificial Sequence
  MKO10017647_A_Fam71e2
  gRNA
cagacgcaguuucagucgcc

SEQ ID NO: 17648 - RNA, 20 nt, Artificial Sequence
  MKO10017648_A_Fam71e2
  gRNA
uggccuuucuguuugaccgc

SEQ ID NO: 17649 - RNA, 20 nt, Artificial Sequence
  MKO10017649_A_Fam71e2
  gRNA
uaacgcaggagucccauugu

SEQ ID NO: 17650 - RNA, 20 nt, Artificial Sequence
  MKO10017650_A_Fam71f1
  gRNA
guacggaggaggucacccca

SEQ ID NO: 17651 - RNA, 20 nt, Artificial Sequence
  MKO10017651_A_Fam71f1
  gRNA
ucaaccgcaggacgcguucc

SEQ ID NO: 17652 - RNA, 20 nt, Artificial Sequence
  MKO10017652_A_Fam71f1
  gRNA
ccauaaggaggauguucgga

SEQ ID NO: 17653 - RNA, 20 nt, Artificial Sequence
  MKO10017653_A_Fam71f2
  gRNA
cgcagcgcauccuccgcguu

SEQ ID NO: 17654 - RNA, 20 nt, Artificial Sequence
  MKO10017654_A_Fam71f2
  gRNA
cggagaagaucuacuaccug

SEQ ID NO: 17655 - RNA, 20 nt, Artificial Sequence
  MKO10017655_A_Fam71f2
  gRNA
caacugcaagucaaccccac

SEQ ID NO: 17656 - RNA, 20 nt, Artificial Sequence
  MKO10017656_A_Fam72a
  gRNA
aacuacauggaacaauuacg

SEQ ID NO: 17657 - RNA, 20 nt, Artificial Sequence
  MKO10017657_A_Fam72a
  gRNA
guuuacagaauuugcaacac

SEQ ID NO: 17658 - RNA, 20 nt, Artificial Sequence
  MKO10017658_A_Fam72a
  gRNA
gucagacuuacuugguagga

SEQ ID NO: 17659 - RNA, 20 nt, Artificial Sequence
  MKO10017659_A_Fam73a
  gRNA
ucuaacugcguacgucuuca

SEQ ID NO: 17660 - RNA, 20 nt, Artificial Sequence
  MKO10017660_A_Fam73a
  gRNA
ggucagauucugccgacugc

SEQ ID NO: 17661 - RNA, 20 nt, Artificial Sequence
  MKO10017661_A_Fam73a
  gRNA
caguguugcaacuacccgaa

SEQ ID NO: 17662 - RNA, 20 nt, Artificial Sequence
  MKO10017662_A_Fam73b
  gRNA
aguccgcguucucccagcug

SEQ ID NO: 17663 - RNA, 20 nt, Artificial Sequence
  MKO10017663_A_Fam73b
  gRNA
caaccgcagcugggagaacg

SEQ ID NO: 17664 - RNA, 20 nt, Artificial Sequence
  MKO10017664_A_Fam73b
  gRNA
gccgagagccucuaugugca

SEQ ID NO: 17665 - RNA, 20 nt, Artificial Sequence
  MKO10017665_A_Fam76a
  gRNA
ccccugagacagcgccucga

SEQ ID NO: 17666 - RNA, 20 nt, Artificial Sequence
  MKO10017666_A_Fam76a
  gRNA
gagaacuguaccucuccugc

SEQ ID NO: 17667 - RNA, 20 nt, Artificial Sequence
  MKO10017667_A_Fam76a
  gRNA
uugugaaguguaccuacugu

SEQ ID NO: 17668 - RNA, 20 nt, Artificial Sequence
  MKO10017668_A_Fam76b
  gRNA
auuuguacaacgcugacacu

SEQ ID NO: 17669 - RNA, 20 nt, Artificial Sequence
  MKO10017669_A_Fam76b
  gRNA
ggugguguuuagaauggugc

SEQ ID NO: 17670 - RNA, 20 nt, Artificial Sequence
  MKO10017670_A_Fam76b
  gRNA
gcucaaaaugucaagcaauu

SEQ ID NO: 17671 - RNA, 20 nt, Artificial Sequence
  MKO10017671_A_Fam78a
  gRNA
ccgauagcgcaauaccacgc

SEQ ID NO: 17672 - RNA, 20 nt, Artificial Sequence
  MKO10017672_A_Fam78a
  gRNA
cuccgugguauugccguacc

SEQ ID NO: 17673 - RNA, 20 nt, Artificial Sequence
  MKO10017673_A_Fam78a
  gRNA
caucgacgaguccuccagcg

SEQ ID NO: 17674 - RNA, 20 nt, Artificial Sequence
  MKO10017674_A_Fam78b
  gRNA
gauccggcgcgagaacaucg

SEQ ID NO: 17675 - RNA, 20 nt, Artificial Sequence
  MKO10017675_A_Fam78b
  gRNA
cgaggucuccucgaugcgcg

SEQ ID NO: 17676 - RNA, 20 nt, Artificial Sequence
  MKO10017676_A_Fam78b
  gRNA
uugggcuucacuagugcguu

SEQ ID NO: 17677 - RNA, 20 nt, Artificial Sequence
  MKO10017677_A_Fam81a
  gRNA
cucguaggucgacuuaugcu

SEQ ID NO: 17678 - RNA, 20 nt, Artificial Sequence
  MKO10017678_A_Fam81a
  gRNA
cgagcauaagucgaccuacg

SEQ ID NO: 17679 - RNA, 20 nt, Artificial Sequence
  MKO10017679_A_Fam81a
  gRNA
uccaggagcagauccgugcc

SEQ ID NO: 17680 - RNA, 20 nt, Artificial Sequence
  MKO10017680_A_Fam83a
  gRNA
gacgaauaccccgcgcuugu

SEQ ID NO: 17681 - RNA, 20 nt, Artificial Sequence
  MKO10017681_A_Fam83a
  gRNA
uuacuggcgcgcccucaguc

SEQ ID NO: 17682 - RNA, 20 nt, Artificial Sequence
  MKO10017682_A_Fam83a
  gRNA
gggcaagauccggaaacguc

SEQ ID NO: 17683 - RNA, 20 nt, Artificial Sequence
  MKO10017683_A_Fam83b
  gRNA
auagcgguuagcgccucucc

SEQ ID NO: 17684 - RNA, 20 nt, Artificial Sequence
  MKO10017684_A_Fam83b
  gRNA
cuaugucgagccgcacuaca

SEQ ID NO: 17685 - RNA, 20 nt, Artificial Sequence
  MKO10017685_A_Fam83b
  gRNA
ugguugucgaauccgauuuc

SEQ ID NO: 17686 - RNA, 20 nt, Artificial Sequence
  MKO10017686_A_Fam83c
  gRNA
uuuagccgaauagcacccgc

SEQ ID NO: 17687 - RNA, 20 nt, Artificial Sequence
  MKO10017687_A_Fam83c
  gRNA
aggucgccgauucaccggcc

SEQ ID NO: 17688 - RNA, 20 nt, Artificial Sequence
  MKO10017688_A_Fam83c
  gRNA
ugaucauguaguccacgucc

SEQ ID NO: 17689 - RNA, 20 nt, Artificial Sequence
  MKO10017689_A_Fam83d
  gRNA
cagccgcucacgccguaaga

SEQ ID NO: 17690 - RNA, 20 nt, Artificial Sequence
  MKO10017690_A_Fam83d
  gRNA
gaaccgccggcguuggagcu

SEQ ID NO: 17691 - RNA, 20 nt, Artificial Sequence
  MKO10017691_A_Fam83d
  gRNA
ccggugacccuucuuuggac

SEQ ID NO: 17692 - RNA, 20 nt, Artificial Sequence
  MKO10017692_A_Fam83e
  gRNA
gcacgaacuucucccgcaca

SEQ ID NO: 17693 - RNA, 20 nt, Artificial Sequence
  MKO10017693_A_Fam83e
  gRNA
ucuccuguuugucccgcucg

SEQ ID NO: 17694 - RNA, 20 nt, Artificial Sequence
  MKO10017694_A_Fam83e
  gRNA
cgcucaccugccgucgccug

SEQ ID NO: 17695 - RNA, 20 nt, Artificial Sequence
  MKO10017695_A_Fam83f
  gRNA
gauaagcuuucgagcuaccg

SEQ ID NO: 17696 - RNA, 20 nt, Artificial Sequence
  MKO10017696_A_Fam83f
  gRNA
uaucaaccccaaguacgcau

SEQ ID NO: 17697 - RNA, 20 nt, Artificial Sequence
  MKO10017697_A_Fam83f
  gRNA
agcuugcagacuuccgcauu

SEQ ID NO: 17698 - RNA, 20 nt, Artificial Sequence
  MKO10017698_A_Fam83g
  gRNA
gucucaaucgaagcaccuaa

SEQ ID NO: 17699 - RNA, 20 nt, Artificial Sequence
  MKO10017699_A_Fam83g
  gRNA
gugcuucgauugagacaauu

SEQ ID NO: 17700 - RNA, 20 nt, Artificial Sequence
  MKO10017700_A_Fam83g
  gRNA
aagcacagccagcgaaagcg

SEQ ID NO: 17701 - RNA, 20 nt, Artificial Sequence
  MKO10017701_A_Fam83h
  gRNA
gguacgccacggcucggauc

SEQ ID NO: 17702 - RNA, 20 nt, Artificial Sequence
  MKO10017702_A_Fam83h
  gRNA
gcggaacucuucgucgaagc

SEQ ID NO: 17703 - RNA, 20 nt, Artificial Sequence
  MKO10017703_A_Fam83h
  gRNA
ucgcgucaaccugcaucaug

SEQ ID NO: 17704 - RNA, 20 nt, Artificial Sequence
  MKO10017704_A_Fam84a
  gRNA
ucgccuggcucgcagaucgc

SEQ ID NO: 17705 - RNA, 20 nt, Artificial Sequence
  MKO10017705_A_Fam84a
  gRNA
cugguaccgcuaccgcccgc

SEQ ID NO: 17706 - RNA, 20 nt, Artificial Sequence
  MKO10017706_A_Fam84a
  gRNA
cgucuaugcgacgcuucucg

SEQ ID NO: 17707 - RNA, 20 nt, Artificial Sequence
  MKO10017707_A_Fam84b
  gRNA
gcguugcgcacuacagcgcu

SEQ ID NO: 17708 - RNA, 20 nt, Artificial Sequence
  MKO10017708_A_Fam84b
  gRNA
caacgaccagaucggacgcg

SEQ ID NO: 17709 - RNA, 20 nt, Artificial Sequence
  MKO10017709_A_Fam84b
  gRNA
agggcgacagcgacgcgacu

SEQ ID NO: 17710 - RNA, 20 nt, Artificial Sequence
  MKO10017710_A_Fam86
  gRNA
cucggguucugagcuguugc

SEQ ID NO: 17711 - RNA, 20 nt, Artificial Sequence
  MKO10017711_A_Fam86
  gRNA
uucauaccagcaaauagcuc

SEQ ID NO: 17712 - RNA, 20 nt, Artificial Sequence
  MKO10017712_A_Fam86
  gRNA
gccucauacagugcauccaa

SEQ ID NO: 17713 - RNA, 20 nt, Artificial Sequence
  MKO10017713_A_Fam89a
  gRNA
cccaacgagaugagcggaac

SEQ ID NO: 17714 - RNA, 20 nt, Artificial Sequence
  MKO10017714_A_Fam89a
  gRNA
caaggucggccuccgacagc

SEQ ID NO: 17715 - RNA, 20 nt, Artificial Sequence
  MKO10017715_A_Fam89a
  gRNA
cgagcugaaccgagggggcg

SEQ ID NO: 17716 - RNA, 20 nt, Artificial Sequence
  MKO10017716_A_Fam89b
  gRNA
cggcacgacucaguucgucg

SEQ ID NO: 17717 - RNA, 20 nt, Artificial Sequence
  MKO10017717_A_Fam89b
  gRNA
agcggccuucuuaacgcuag

SEQ ID NO: 17718 - RNA, 20 nt, Artificial Sequence
  MKO10017718_A_Fam89b
  gRNA
gggccuguacgagucgaucc

SEQ ID NO: 17719 - RNA, 20 nt, Artificial Sequence
  MKO10017719_A_Fam92a
  gRNA
gucggcuuugucucgaagcc

SEQ ID NO: 17720 - RNA, 20 nt, Artificial Sequence
  MKO10017720_A_Fam92a
  gRNA
acaauuacaugucgaucaga

SEQ ID NO: 17721 - RNA, 20 nt, Artificial Sequence
  MKO10017721_A_Fam92a
  gRNA
caaacuucaagauuaucgcc

SEQ ID NO: 17722 - RNA, 20 nt, Artificial Sequence
  MKO10017722_A_Fam92b
  gRNA
guccucggcgaagucucgaa

SEQ ID NO: 17723 - RNA, 20 nt, Artificial Sequence
  MKO10017723_A_Fam92b
  gRNA
caccauucgagacuucgccg

SEQ ID NO: 17724 - RNA, 20 nt, Artificial Sequence
  MKO10017724_A_Fam92b
  gRNA
uacgaucauuugucgaucug

SEQ ID NO: 17725 - RNA, 20 nt, Artificial Sequence
  MKO10017725_A_Fam96a
  gRNA
accgcugaagcuuuacucuu

SEQ ID NO: 17726 - RNA, 20 nt, Artificial Sequence
  MKO10017726_A_Fam96a
  gRNA
ggaacagugcguccucgagc

SEQ ID NO: 17727 - RNA, 20 nt, Artificial Sequence
  MKO10017727_A_Fam96a
  gRNA
ggaggggucaguccggcucg

SEQ ID NO: 17728 - RNA, 20 nt, Artificial Sequence
  MKO10017728_A_Fam96b
  gRNA
uccaacugaccuugaaccgc

SEQ ID NO: 17729 - RNA, 20 nt, Artificial Sequence
  MKO10017729_A_Fam96b
  gRNA
aagccaggcucacgagcggg

SEQ ID NO: 17730 - RNA, 20 nt, Artificial Sequence
  MKO10017730_A_Fam96b
  gRNA
acccacgccuccgagcaugc

SEQ ID NO: 17731 - RNA, 20 nt, Artificial Sequence
  MKO10017731_A_Fam98a
  gRNA
gccguuacugaagaagccga

SEQ ID NO: 17732 - RNA, 20 nt, Artificial Sequence
  MKO10017732_A_Fam98a
  gRNA
agugcaccaucguccaacaa

SEQ ID NO: 17733 - RNA, 20 nt, Artificial Sequence
  MKO10017733_A_Fam98a
  gRNA
cuguugcaggcagucuccgc

SEQ ID NO: 17734 - RNA, 20 nt, Artificial Sequence
  MKO10017734_A_Fam98b
  gRNA
guauaaggggccacuguuag

SEQ ID NO: 17735 - RNA, 20 nt, Artificial Sequence
  MKO10017735_A_Fam98b
  gRNA
ccugagacgaguaccgagua

SEQ ID NO: 17736 - RNA, 20 nt, Artificial Sequence
  MKO10017736_A_Fam98b
  gRNA
augauaccuuugacuccacu

SEQ ID NO: 17737 - RNA, 20 nt, Artificial Sequence
  MKO10017737_A_Fam98c
  gRNA
gccccuccuuaacucgcagc

SEQ ID NO: 17738 - RNA, 20 nt, Artificial Sequence
  MKO10017738_A_Fam98c
  gRNA
gucccgcgugugcagacuuc

SEQ ID NO: 17739 - RNA, 20 nt, Artificial Sequence
  MKO10017739_A_Fam98c
  gRNA
ccgcagguacgaugcccucc

SEQ ID NO: 17740 - RNA, 20 nt, Artificial Sequence
  MKO10017740_A_Fan1
  gRNA
cggucgcuucgagucuguaa

SEQ ID NO: 17741 - RNA, 20 nt, Artificial Sequence
  MKO10017741_A_Fan1
  gRNA
cuuuacagacucgaagcgac

SEQ ID NO: 17742 - RNA, 20 nt, Artificial Sequence
  MKO10017742_A_Fan1
  gRNA
ugccuccgacuuaaccccug

SEQ ID NO: 17743 - RNA, 20 nt, Artificial Sequence
  MKO10017743_A_Fanca
  gRNA
gugcugacgcuuccuccgac

SEQ ID NO: 17744 - RNA, 20 nt, Artificial Sequence
  MKO10017744_A_Fanca
  gRNA
guuugcucgcagugugcagc

SEQ ID NO: 17745 - RNA, 20 nt, Artificial Sequence
  MKO10017745_A_Fanca
  gRNA
aggaagcgucagcacugucg

SEQ ID NO: 17746 - RNA, 20 nt, Artificial Sequence
  MKO10017746_A_Fancb
  gRNA
cugucauuagaccaaaccac

SEQ ID NO: 17747 - RNA, 20 nt, Artificial Sequence
  MKO10017747_A_Fancb
  gRNA
guacuggugaaugacuuugc

SEQ ID NO: 17748 - RNA, 20 nt, Artificial Sequence
  MKO10017748_A_Fancb
  gRNA
cgcaaaagucacaucuuuga

SEQ ID NO: 17749 - RNA, 20 nt, Artificial Sequence
  MKO10017749_A_Fancc
  gRNA
cagagucaggacuuaacucg

SEQ ID NO: 17750 - RNA, 20 nt, Artificial Sequence
  MKO10017750_A_Fancc
  gRNA
ugccaacaguugaccaauug

SEQ ID NO: 17751 - RNA, 20 nt, Artificial Sequence
  MKO10017751_A_Fancc
  gRNA
ccccacaauuggucaacugu

SEQ ID NO: 17752 - RNA, 20 nt, Artificial Sequence
  MKO10017752_A_Fancd2os
  gRNA
guguagugugccgcagccau

SEQ ID NO: 17753 - RNA, 20 nt, Artificial Sequence
  MKO10017753_A_Fancd2os
  gRNA
ccgcagccaguccgccucag

SEQ ID NO: 17754 - RNA, 20 nt, Artificial Sequence
  MKO10017754_A_Fancd2os
  gRNA
cgagccgugaguaacaagaa

SEQ ID NO: 17755 - RNA, 20 nt, Artificial Sequence
  MKO10017755_A_Fancd2
  gRNA
gagucugaucaagcuacuuc

SEQ ID NO: 17756 - RNA, 20 nt, Artificial Sequence
  MKO10017756_A_Fancd2
  gRNA
gagcuuuaccuagcugauuu

SEQ ID NO: 17757 - RNA, 20 nt, Artificial Sequence
  MKO10017757_A_Fancd2
  gRNA
ggacuuacuuugggauaagc

SEQ ID NO: 17758 - RNA, 20 nt, Artificial Sequence
  MKO10017758_A_Fance
  gRNA
cuagggguucugcgcgcccu

SEQ ID NO: 17759 - RNA, 20 nt, Artificial Sequence
  MKO10017759_A_Fance
  gRNA
gccgcgcggagcacuucccu

SEQ ID NO: 17760 - RNA, 20 nt, Artificial Sequence
  MKO10017760_A_Fance
  gRNA
ggcaacacgccuccugcauc

SEQ ID NO: 17761 - RNA, 20 nt, Artificial Sequence
  MKO10017761_A_Fancf
  gRNA
cgacgugccgcagucgcgcc

SEQ ID NO: 17762 - RNA, 20 nt, Artificial Sequence
  MKO10017762_A_Fancf
  gRNA
cgcgcguccacaacgugucc

SEQ ID NO: 17763 - RNA, 20 nt, Artificial Sequence
  MKO10017763_A_Fancf
  gRNA
gcgacugcggcacgucgucu

SEQ ID NO: 17764 - RNA, 20 nt, Artificial Sequence
  MKO10017764_A_Fancg
  gRNA
uugcuguuacaaacccuaaa

SEQ ID NO: 17765 - RNA, 20 nt, Artificial Sequence
  MKO10017765_A_Fancg
  gRNA
acugcauuugccugccgcca

SEQ ID NO: 17766 - RNA, 20 nt, Artificial Sequence
  MKO10017766_A_Fancg
  gRNA
cgaggccccuuugaagaucc

SEQ ID NO: 17767 - RNA, 20 nt, Artificial Sequence
  MKO10017767_A_Fanci
  gRNA
cgagaggaccgccuagugaa

SEQ ID NO: 17768 - RNA, 20 nt, Artificial Sequence
  MKO10017768_A_Fanci
  gRNA
gaugucgcaucagagaucau

SEQ ID NO: 17769 - RNA, 20 nt, Artificial Sequence
  MKO10017769_A_Fanci
  gRNA
aaucucccgauucaaccaac

SEQ ID NO: 17770 - RNA, 20 nt, Artificial Sequence
  MKO10017770_A_Fancl
  gRNA
guaccaucaaguaguccaac

SEQ ID NO: 17771 - RNA, 20 nt, Artificial Sequence
  MKO10017771_A_Fancl
  gRNA
ccuuaggcagcacuauucug

SEQ ID NO: 17772 - RNA, 20 nt, Artificial Sequence
  MKO10017772_A_Fancl
  gRNA
uuaccuguuggacuacuuga

SEQ ID NO: 17773 - RNA, 20 nt, Artificial Sequence
  MKO10017773_A_Fancm
  gRNA
cacccacguaaagugucuug

SEQ ID NO: 17774 - RNA, 20 nt, Artificial Sequence
  MKO10017774_A_Fancm
  gRNA
uuaccaugaccugcgguguc

SEQ ID NO: 17775 - RNA, 20 nt, Artificial Sequence
  MKO10017775_A_Fancm
  gRNA
cauucaaaagacguauaucc

SEQ ID NO: 17776 - RNA, 20 nt, Artificial Sequence
  MKO10017776_A_Fank1
  gRNA
gucguagccaccgagacgac

SEQ ID NO: 17777 - RNA, 20 nt, Artificial Sequence
  MKO10017777_A_Fank1
  gRNA
augaaaguguucgcuacuua

SEQ ID NO: 17778 - RNA, 20 nt, Artificial Sequence
  MKO10017778_A_Fank1
  gRNA
acuauacaaauuucgacuga

SEQ ID NO: 17779 - RNA, 20 nt, Artificial Sequence
  MKO10017779_A_Fap
  gRNA
auugucuuacgucccucaag

SEQ ID NO: 17780 - RNA, 20 nt, Artificial Sequence
  MKO10017780_A_Fap
  gRNA
agauacacaaauugccgauc

SEQ ID NO: 17781 - RNA, 20 nt, Artificial Sequence
  MKO10017781_A_Fap
  gRNA
ccacuaaagcaagcgcagcc

SEQ ID NO: 17782 - RNA, 20 nt, Artificial Sequence
  MKO10017782_A_Far1
  gRNA
cgucgaucgucggcgccagu

SEQ ID NO: 17783 - RNA, 20 nt, Artificial Sequence
  MKO10017783_A_Far1
  gRNA
gacgaucgacggccuuacaa

SEQ ID NO: 17784 - RNA, 20 nt, Artificial Sequence
  MKO10017784_A_Far1
  gRNA
aucuuacaguagccgcacag

SEQ ID NO: 17785 - RNA, 20 nt, Artificial Sequence
  MKO10017785_A_Far2
  gRNA
uaccgcaauaaugaguccgc

SEQ ID NO: 17786 - RNA, 20 nt, Artificial Sequence
  MKO10017786_A_Far2
  gRNA
augugcaucaaagcgcacug

SEQ ID NO: 17787 - RNA, 20 nt, Artificial Sequence
  MKO10017787_A_Far2
  gRNA
acccagcggacucauuauug

SEQ ID NO: 17788 - RNA, 20 nt, Artificial Sequence
  MKO10017788_A_Farp1
  gRNA
uguccgcagcaacgagcgcc

SEQ ID NO: 17789 - RNA, 20 nt, Artificial Sequence
  MKO10017789_A_Farp1
  gRNA
cgaaguagucgcccuccaca

SEQ ID NO: 17790 - RNA, 20 nt, Artificial Sequence
  MKO10017790_A_Farp1
  gRNA
aauuuaacaacgacgugcuu

SEQ ID NO: 17791 - RNA, 20 nt, Artificial Sequence
  MKO10017791_A_Farp2
  gRNA
ugcaggucaggcguuccucc

SEQ ID NO: 17792 - RNA, 20 nt, Artificial Sequence
  MKO10017792_A_Farp2
  gRNA
aagaccugcccgucacacuu

SEQ ID NO: 17793 - RNA, 20 nt, Artificial Sequence
  MKO10017793_A_Farp2
  gRNA
ucccugcagccgaaguguga

SEQ ID NO: 17794 - RNA, 20 nt, Artificial Sequence
  MKO10017794_A_Fars2
  gRNA
ggaugucaggaaugucguag

SEQ ID NO: 17795 - RNA, 20 nt, Artificial Sequence
  MKO10017795_A_Fars2
  gRNA
uaugacaucguccgaacagu

SEQ ID NO: 17796 - RNA, 20 nt, Artificial Sequence
  MKO10017796_A_Fars2
  gRNA
aaucggcugggcguuuggcc

SEQ ID NO: 17797 - RNA, 20 nt, Artificial Sequence
  MKO10017797_A_Farsa
  gRNA
guggacaagagugccgccga

SEQ ID NO: 17798 - RNA, 20 nt, Artificial Sequence
  MKO10017798_A_Farsa
  gRNA
cagcacaagcgugucuaagc

SEQ ID NO: 17799 - RNA, 20 nt, Artificial Sequence
  MKO10017799_A_Farsa
  gRNA
gacucaccacucggaacacc

SEQ ID NO: 17800 - RNA, 20 nt, Artificial Sequence
  MKO10017800_A_Farsb
  gRNA
ggcaucacucgcuuauauac

SEQ ID NO: 17801 - RNA, 20 nt, Artificial Sequence
  MKO10017801_A_Farsb
  gRNA
ugacgaaccugcagauauuc

SEQ ID NO: 17802 - RNA, 20 nt, Artificial Sequence
  MKO10017802_A_Farsb
  gRNA
aacuacaccagaauaucugc

SEQ ID NO: 17803 - RNA, 20 nt, Artificial Sequence
  MKO10017803_A_Fasl
  gRNA
ggccuugugaucaacgaaac

SEQ ID NO: 17804 - RNA, 20 nt, Artificial Sequence
  MKO10017804_A_Fasl
  gRNA
acccaguuucguugaucaca

SEQ ID NO: 17805 - RNA, 20 nt, Artificial Sequence
  MKO10017805_A_Fasl
  gRNA
caacacaaaucuguggcuac

SEQ ID NO: 17806 - RNA, 20 nt, Artificial Sequence
  MKO10017806_A_Fasn
  gRNA
uggcauagacccgccgagcc

SEQ ID NO: 17807 - RNA, 20 nt, Artificial Sequence
  MKO10017807_A_Fasn
  gRNA
ggaaugccccgcggcccuug

SEQ ID NO: 17808 - RNA, 20 nt, Artificial Sequence
  MKO10017808_A_Fasn
  gRNA
aacgaacacuggcgucuggg

SEQ ID NO: 17809 - RNA, 20 nt, Artificial Sequence
  MKO10017809_A_Fastkd1
  gRNA
ccagcaagcgcugaucgugu

SEQ ID NO: 17810 - RNA, 20 nt, Artificial Sequence
  MKO10017810_A_Fastkd1
  gRNA
ccaacacgaucagcgcuugc

SEQ ID NO: 17811 - RNA, 20 nt, Artificial Sequence
  MKO10017811_A_Fastkd1
  gRNA
uucugaucaccagucguucc

SEQ ID NO: 17812 - RNA, 20 nt, Artificial Sequence
  MKO10017812_A_Fastkd2
  gRNA
aaugugaaugcgcuucgagc

SEQ ID NO: 17813 - RNA, 20 nt, Artificial Sequence
  MKO10017813_A_Fastkd2
  gRNA
gucaaccgcuuuagugucaa

SEQ ID NO: 17814 - RNA, 20 nt, Artificial Sequence
  MKO10017814_A_Fastkd2
  gRNA
uccaaacuugcugaucaacu

SEQ ID NO: 17815 - RNA, 20 nt, Artificial Sequence
  MKO10017815_A_Fastkd3
  gRNA
acgcccuauuacuacacuau

SEQ ID NO: 17816 - RNA, 20 nt, Artificial Sequence
  MKO10017816_A_Fastkd3
  gRNA
gguacuauaccugaacaacc

SEQ ID NO: 17817 - RNA, 20 nt, Artificial Sequence
  MKO10017817_A_Fastkd3
  gRNA
aggguggcgcuguguauuga

SEQ ID NO: 17818 - RNA, 20 nt, Artificial Sequence
  MKO10017818_A_Fastkd5
  gRNA
aguucaaauuggguaccgug

SEQ ID NO: 17819 - RNA, 20 nt, Artificial Sequence
  MKO10017819_A_Fastkd5
  gRNA
uuaccgugcagcccaaagcg

SEQ ID NO: 17820 - RNA, 20 nt, Artificial Sequence
  MKO10017820_A_Fastkd5
  gRNA
cugcucagccuuacgcaucc

SEQ ID NO: 17821 - RNA, 20 nt, Artificial Sequence
  MKO10017821_A_Fastk
  gRNA
ccuguuccagaagccguuga

SEQ ID NO: 17822 - RNA, 20 nt, Artificial Sequence
  MKO10017822_A_Fastk
  gRNA
auggauggugugaacgucaa

SEQ ID NO: 17823 - RNA, 20 nt, Artificial Sequence
  MKO10017823_A_Fastk
  gRNA
gccagaagcaccauuacgug

SEQ ID NO: 17824 - RNA, 20 nt, Artificial Sequence
  MKO10017824_A_Fas
  gRNA
accugcgccccaugcacaga

SEQ ID NO: 17825 - RNA, 20 nt, Artificial Sequence
  MKO10017825_A_Fas
  gRNA
ucuccgagaguuuaaagcug

SEQ ID NO: 17826 - RNA, 20 nt, Artificial Sequence
  MKO10017826_A_Fas
  gRNA
acacucugcgaugaagagca

SEQ ID NO: 17827 - RNA, 20 nt, Artificial Sequence
  MKO10017827_A_Fau1
  gRNA
gggccccucguccuuauccg

SEQ ID NO: 17828 - RNA, 20 nt, Artificial Sequence
  MKO10017828_A_Fau1
  gRNA
ccucuaccgcgucauagccg

SEQ ID NO: 17829 - RNA, 20 nt, Artificial Sequence
  MKO10017829_A_Fau1
  gRNA
gccgauuucguuugaggaau

SEQ ID NO: 17830 - RNA, 20 nt, Artificial Sequence
  MKO10017830_A_Fau2
  gRNA
aucaguguagagggacgacc

SEQ ID NO: 17831 - RNA, 20 nt, Artificial Sequence
  MKO10017831_A_Fau2
  gRNA
uaacaccgucaaccaguagu

SEQ ID NO: 17832 - RNA, 20 nt, Artificial Sequence
  MKO10017832_A_Fau2
  gRNA
gaagauacaacucccgugac

SEQ ID NO: 17833 - RNA, 20 nt, Artificial Sequence
  MKO10017833_A_Fau3
  gRNA
cugcccgccuccacaucgaa

SEQ ID NO: 17834 - RNA, 20 nt, Artificial Sequence
  MKO10017834_A_Fau3
  gRNA
gucugauuaccacgacuuca

SEQ ID NO: 17835 - RNA, 20 nt, Artificial Sequence
  MKO10017835_A_Fau3
  gRNA
aauagagagggaccacgccc

SEQ ID NO: 17836 - RNA, 20 nt, Artificial Sequence
  MKO10017836_A_Fau4
  gRNA
gccguagcgaaccuguccgu

SEQ ID NO: 17837 - RNA, 20 nt, Artificial Sequence
  MKO10017837_A_Fau4
  gRNA
guggucauucacgucgcuga

SEQ ID NO: 17838 - RNA, 20 nt, Artificial Sequence
  MKO10017838_A_Fau4
  gRNA
agcauacgugaccagagcgu

SEQ ID NO: 17839 - RNA, 20 nt, Artificial Sequence
  MKO10017839_A_Fau
  gRNA
cuuuccucagguggccaaac

SEQ ID NO: 17840 - RNA, 20 nt, Artificial Sequence
  MKO10017840_A_Fau
  gRNA
ccuaacacagguaaaguuca

SEQ ID NO: 17841 - RNA, 20 nt, Artificial Sequence
  MKO10017841_A_Fau
  gRNA
uaaggaucauguggccuccc

SEQ ID NO: 17842 - RNA, 20 nt, Artificial Sequence
  MKO10017842_A_Faxc
  gRNA
agaccggagcggcuaaucaa

SEQ ID NO: 17843 - RNA, 20 nt, Artificial Sequence
  MKO10017843_A_Faxc
  gRNA
aauggcugaccuacccuauc

SEQ ID NO: 17844 - RNA, 20 nt, Artificial Sequence
  MKO10017844_A_Faxc
  gRNA
caggcgauguggaccuuacc

SEQ ID NO: 17845 - RNA, 20 nt, Artificial Sequence
  MKO10017845_A_Fbf1
  gRNA
cucccaaaagacagcguuga

SEQ ID NO: 17846 - RNA, 20 nt, Artificial Sequence
  MKO10017846_A_Fbf1
  gRNA
agcucgcugugucuuuggca

SEQ ID NO: 17847 - RNA, 20 nt, Artificial Sequence
  MKO10017847_A_Fbf1
  gRNA
aguccuucaacgcugucuuu

SEQ ID NO: 17848 - RNA, 20 nt, Artificial Sequence
  MKO10017848_A_Fblim1
  gRNA
ucguaccugccgccgccagu

SEQ ID NO: 17849 - RNA, 20 nt, Artificial Sequence
  MKO10017849_A_Fblim1
  gRNA
cagcgacgagagcuuugcgc

SEQ ID NO: 17850 - RNA, 20 nt, Artificial Sequence
  MKO10017850_A_Fblim1
  gRNA
acagggggcgcccauccuuc

SEQ ID NO: 17851 - RNA, 20 nt, Artificial Sequence
  MKO10017851_A_Fbll1
  gRNA
ccgauagaccccgacgacga

SEQ ID NO: 17852 - RNA, 20 nt, Artificial Sequence
  MKO10017852_A_Fbll1
  gRNA
ucgccguacaccgagacucc

SEQ ID NO: 17853 - RNA, 20 nt, Artificial Sequence
  MKO10017853_A_Fbll1
  gRNA
gccagaucagucgcgcaucg

SEQ ID NO: 17854 - RNA, 20 nt, Artificial Sequence
  MKO10017854_A_Fbln1
  gRNA
uaccugaaugaccgcugucg

SEQ ID NO: 17855 - RNA, 20 nt, Artificial Sequence
  MKO10017855_A_Fbln1
  gRNA
caccucgacagcggucauuc

SEQ ID NO: 17856 - RNA, 20 nt, Artificial Sequence
  MKO10017856_A_Fbln1
  gRNA
cugugccacgggcaucaacc

SEQ ID NO: 17857 - RNA, 20 nt, Artificial Sequence
  MKO10017857_A_Fbln2
  gRNA
caguacuacgacugcguaca

SEQ ID NO: 17858 - RNA, 20 nt, Artificial Sequence
  MKO10017858_A_Fbln2
  gRNA
cuuguacgcagucguaguac

SEQ ID NO: 17859 - RNA, 20 nt, Artificial Sequence
  MKO10017859_A_Fbln2
  gRNA
cuuguagagugagacgccgc

SEQ ID NO: 17860 - RNA, 20 nt, Artificial Sequence
  MKO10017860_A_Fbln5
  gRNA
uuugaccuggaccgccaguc

SEQ ID NO: 17861 - RNA, 20 nt, Artificial Sequence
  MKO10017861_A_Fbln5
  gRNA
cgauacacuggguugguucg

SEQ ID NO: 17862 - RNA, 20 nt, Artificial Sequence
  MKO10017862_A_Fbln5
  gRNA
accaucccugaggcuugucg

SEQ ID NO: 17863 - RNA, 20 nt, Artificial Sequence
  MKO10017863_A_Fbln7
  gRNA
ccuccggauggcaagaaguu

SEQ ID NO: 17864 - RNA, 20 nt, Artificial Sequence
  MKO10017864_A_Fbln7
  gRNA
cccgcuccaccugcgcgcag

SEQ ID NO: 17865 - RNA, 20 nt, Artificial Sequence
  MKO10017865_A_Fbln7
  gRNA
cuucauguuucggaugccuu

SEQ ID NO: 17866 - RNA, 20 nt, Artificial Sequence
  MKO10017866_A_Fbl
  gRNA
gcuacagguuucagcccccg

SEQ ID NO: 17867 - RNA, 20 nt, Artificial Sequence
  MKO10017867_A_Fbl
  gRNA
cacucaccuucaugacgaug

SEQ ID NO: 17868 - RNA, 20 nt, Artificial Sequence
  MKO10017868_A_Fbl
  gRNA
acaggugggggcuuccaguc

SEQ ID NO: 17869 - RNA, 20 nt, Artificial Sequence
  MKO10017869_A_Fbn1
  gRNA
uacgugcaagcacaccgauu

SEQ ID NO: 17870 - RNA, 20 nt, Artificial Sequence
  MKO10017870_A_Fbn1
  gRNA
aaucggugugcuugcacgua

SEQ ID NO: 17871 - RNA, 20 nt, Artificial Sequence
  MKO10017871_A_Fbn1
  gRNA
gagugccgauguacccuuuc

SEQ ID NO: 17872 - RNA, 20 nt, Artificial Sequence
  MKO10017872_A_Fbn2
  gRNA
cgauacaacgccccccguuc

SEQ ID NO: 17873 - RNA, 20 nt, Artificial Sequence
  MKO10017873_A_Fbn2
  gRNA
cagaacggggggcguuguau

SEQ ID NO: 17874 - RNA, 20 nt, Artificial Sequence
  MKO10017874_A_Fbn2
  gRNA
gaaucuagaaccgcacacgu

SEQ ID NO: 17875 - RNA, 20 nt, Artificial Sequence
  MKO10017875_A_Fbp1
  gRNA
gcagccggguaugcgcucua

SEQ ID NO: 17876 - RNA, 20 nt, Artificial Sequence
  MKO10017876_A_Fbp1
  gRNA
cccucuagcuaugguaucgc

SEQ ID NO: 17877 - RNA, 20 nt, Artificial Sequence
  MKO10017877_A_Fbp1
  gRNA
ucauaaucgaaccugagaag

SEQ ID NO: 17878 - RNA, 20 nt, Artificial Sequence
  MKO10017878_A_Fbp2
  gRNA
aacccgcagccacgauguug

SEQ ID NO: 17879 - RNA, 20 nt, Artificial Sequence
  MKO10017879_A_Fbp2
  gRNA
gcagccuggccgcaacaucg

SEQ ID NO: 17880 - RNA, 20 nt, Artificial Sequence
  MKO10017880_A_Fbp2
  gRNA
aauagcaaauauaguuccga

SEQ ID NO: 17881 - RNA, 20 nt, Artificial Sequence
  MKO10017881_A_Fbrsl1
  gRNA
agagcugaacacgcgguuuc

SEQ ID NO: 17882 - RNA, 20 nt, Artificial Sequence
  MKO10017882_A_Fbrsl1
  gRNA
uaccuaccggcggggugucc

SEQ ID NO: 17883 - RNA, 20 nt, Artificial Sequence
  MKO10017883_A_Fbrsl1
  gRNA
uuguagaucacgaacugcuc

SEQ ID NO: 17884 - RNA, 20 nt, Artificial Sequence
  MKO10017884_A_Fbrs
  gRNA
cacucacauuaugucggaaa

SEQ ID NO: 17885 - RNA, 20 nt, Artificial Sequence
  MKO10017885_A_Fbrs
  gRNA
cccuaguuugagaaauaccc

SEQ ID NO: 17886 - RNA, 20 nt, Artificial Sequence
  MKO10017886_A_Fbrs
  gRNA
cucagcacuggccccagucg

SEQ ID NO: 17887 - RNA, 20 nt, Artificial Sequence
  MKO10017887_A_Fbxl12
  gRNA
acgccauguaccggcgcagg

SEQ ID NO: 17888 - RNA, 20 nt, Artificial Sequence
  MKO10017888_A_Fbxl12
  gRNA
ugcgccgguacauggcgucc

SEQ ID NO: 17889 - RNA, 20 nt, Artificial Sequence
  MKO10017889_A_Fbxl12
  gRNA
cgucgaccugacgcucuaca

SEQ ID NO: 17890 - RNA, 20 nt, Artificial Sequence
  MKO10017890_A_Fbxl13
  gRNA
cuuuaccaggcgcuguuaug

SEQ ID NO: 17891 - RNA, 20 nt, Artificial Sequence
  MKO10017891_A_Fbxl13
  gRNA
aauaccucgugcaaaucaag

SEQ ID NO: 17892 - RNA, 20 nt, Artificial Sequence
  MKO10017892_A_Fbxl13
  gRNA
uucucuacucauaaccgugu

SEQ ID NO: 17893 - RNA, 20 nt, Artificial Sequence
  MKO10017893_A_Fbxl14
  gRNA
cgaucuccugcacgaacgcg

SEQ ID NO: 17894 - RNA, 20 nt, Artificial Sequence
  MKO10017894_A_Fbxl14
  gRNA
ucgcgcggcgcaggugugca

SEQ ID NO: 17895 - RNA, 20 nt, Artificial Sequence
  MKO10017895_A_Fbxl14
  gRNA
ucccugaagcacaucucgcg

SEQ ID NO: 17896 - RNA, 20 nt, Artificial Sequence
  MKO10017896_A_Fbxl15
  gRNA
cgcgacugacgcgcugcagc

SEQ ID NO: 17897 - RNA, 20 nt, Artificial Sequence
  MKO10017897_A_Fbxl15
  gRNA
gcgccgcuucgacgccgcuc

SEQ ID NO: 17898 - RNA, 20 nt, Artificial Sequence
  MKO10017898_A_Fbxl15
  gRNA
cggcacuagcccggcuacug

SEQ ID NO: 17899 - RNA, 20 nt, Artificial Sequence
  MKO10017899_A_Fbxl16
  gRNA
caaggcugcgcaauuugcgc

SEQ ID NO: 17900 - RNA, 20 nt, Artificial Sequence
  MKO10017900_A_Fbxl16
  gRNA
ucggaucaccgauauggcac

SEQ ID NO: 17901 - RNA, 20 nt, Artificial Sequence
  MKO10017901_A_Fbxl16
  gRNA
gccugcgcuauucaaugacg

SEQ ID NO: 17902 - RNA, 20 nt, Artificial Sequence
  MKO10017902_A_Fbxl17
  gRNA
gcguucguucagggacaaau

SEQ ID NO: 17903 - RNA, 20 nt, Artificial Sequence
  MKO10017903_A_Fbxl17
  gRNA
ggaccuuaguagucgucagc

SEQ ID NO: 17904 - RNA, 20 nt, Artificial Sequence
  MKO10017904_A_Fbxl17
  gRNA
agacgcgaccgcaaugauug

SEQ ID NO: 17905 - RNA, 20 nt, Artificial Sequence
  MKO10017905_A_Fbxl18
  gRNA
aauuggacccgaucaguucc

SEQ ID NO: 17906 - RNA, 20 nt, Artificial Sequence
  MKO10017906_A_Fbxl18
  gRNA
acacucuucacgccguccua

SEQ ID NO: 17907 - RNA, 20 nt, Artificial Sequence
  MKO10017907_A_Fbxl18
  gRNA
gaagaugacgacguucaacg

SEQ ID NO: 17908 - RNA, 20 nt, Artificial Sequence
  MKO10017908_A_Fbxl19
  gRNA
auuccgagauacccaacugc

SEQ ID NO: 17909 - RNA, 20 nt, Artificial Sequence
  MKO10017909_A_Fbxl19
  gRNA
gggcgccgcagggcugacaa

SEQ ID NO: 17910 - RNA, 20 nt, Artificial Sequence
  MKO10017910_A_Fbxl19
  gRNA
ccuaccccugacgaugugcc

SEQ ID NO: 17911 - RNA, 20 nt, Artificial Sequence
  MKO10017911_A_Fbxl20
  gRNA
uuacgaaaguuaagucuucg

SEQ ID NO: 17912 - RNA, 20 nt, Artificial Sequence
  MKO10017912_A_Fbxl20
  gRNA
cucuucauagggccggguag

SEQ ID NO: 17913 - RNA, 20 nt, Artificial Sequence
  MKO10017913_A_Fbxl20
  gRNA
gacauaccucaaugucccuc

SEQ ID NO: 17914 - RNA, 20 nt, Artificial Sequence
  MKO10017914_A_Fbxl21
  gRNA
gcccgggcucgaucuauuaa

SEQ ID NO: 17915 - RNA, 20 nt, Artificial Sequence
  MKO10017915_A_Fbxl21
  gRNA
aguuaagaccuauccggccc

SEQ ID NO: 17916 - RNA, 20 nt, Artificial Sequence
  MKO10017916_A_Fbxl21
  gRNA
uuacugaacguccgaaauaa

SEQ ID NO: 17917 - RNA, 20 nt, Artificial Sequence
  MKO10017917_A_Fbxl22
  gRNA
ugccgcaacgugagcgccgc

SEQ ID NO: 17918 - RNA, 20 nt, Artificial Sequence
  MKO10017918_A_Fbxl22
  gRNA
uaacgcgcgcgcaguucucg

SEQ ID NO: 17919 - RNA, 20 nt, Artificial Sequence
  MKO10017919_A_Fbxl22
  gRNA
cauuaaccaggcucucgugc

SEQ ID NO: 17920 - RNA, 20 nt, Artificial Sequence
  MKO10017920_A_Fbxl2
  gRNA
aacaucuccaagaggugcgg

SEQ ID NO: 17921 - RNA, 20 nt, Artificial Sequence
  MKO10017921_A_Fbxl2
  gRNA
cgacuccgaugcagccacgc

SEQ ID NO: 17922 - RNA, 20 nt, Artificial Sequence
  MKO10017922_A_Fbxl2
  gRNA
uggcagcaacuggcaacggg

SEQ ID NO: 17923 - RNA, 20 nt, Artificial Sequence
  MKO10017923_A_Fbxl3
  gRNA
gugucauggcuuacgagaac

SEQ ID NO: 17924 - RNA, 20 nt, Artificial Sequence
  MKO10017924_A_Fbxl3
  gRNA
gacugcccggccaagcuuua

SEQ ID NO: 17925 - RNA, 20 nt, Artificial Sequence
  MKO10017925_A_Fbxl3
  gRNA
ccaaaguaaagaugcguagc

SEQ ID NO: 17926 - RNA, 20 nt, Artificial Sequence
  MKO10017926_A_Fbxl4
  gRNA
ccggcuggacgacacgucac

SEQ ID NO: 17927 - RNA, 20 nt, Artificial Sequence
  MKO10017927_A_Fbxl4
  gRNA
cccuacaaaccucauacgac

SEQ ID NO: 17928 - RNA, 20 nt, Artificial Sequence
  MKO10017928_A_Fbxl4
  gRNA
uauugacuuccagucguaug

SEQ ID NO: 17929 - RNA, 20 nt, Artificial Sequence
  MKO10017929_A_Fbxl5
  gRNA
ggugaagacguccacuucau

SEQ ID NO: 17930 - RNA, 20 nt, Artificial Sequence
  MKO10017930_A_Fbxl5
  gRNA
gguggggcgcuacugcgaca

SEQ ID NO: 17931 - RNA, 20 nt, Artificial Sequence
  MKO10017931_A_Fbxl5
  gRNA
gauaucuuuaagcuccucgu

SEQ ID NO: 17932 - RNA, 20 nt, Artificial Sequence
  MKO10017932_A_Fbxl6
  gRNA
cugcacgcguuugccgucac

SEQ ID NO: 17933 - RNA, 20 nt, Artificial Sequence
  MKO10017933_A_Fbxl6
  gRNA
gauuggguacgagccacucc

SEQ ID NO: 17934 - RNA, 20 nt, Artificial Sequence
  MKO10017934_A_Fbxl6
  gRNA
ucagccacaguuuacgcauu

SEQ ID NO: 17935 - RNA, 20 nt, Artificial Sequence
  MKO10017935_A_Fbxl7
  gRNA
aauuacgcuaccucaaugcg

SEQ ID NO: 17936 - RNA, 20 nt, Artificial Sequence
  MKO10017936_A_Fbxl7
  gRNA
ccaguuuagcaaucucccgc

SEQ ID NO: 17937 - RNA, 20 nt, Artificial Sequence
  MKO10017937_A_Fbxl7
  gRNA
cccugaaaguacugacccgc

SEQ ID NO: 17938 - RNA, 20 nt, Artificial Sequence
  MKO10017938_A_Fbxl8
  gRNA
uguccucacuugcgcgcccu

SEQ ID NO: 17939 - RNA, 20 nt, Artificial Sequence
  MKO10017939_A_Fbxl8
  gRNA
uaguaugucgcgcgccgcgc

SEQ ID NO: 17940 - RNA, 20 nt, Artificial Sequence
  MKO10017940_A_Fbxl8
  gRNA
cugccgccaacagcaccgug

SEQ ID NO: 17941 - RNA, 20 nt, Artificial Sequence
  MKO10017941_A_Fbxo10
  gRNA
uacaccgcaccgcguaaguc

SEQ ID NO: 17942 - RNA, 20 nt, Artificial Sequence
  MKO10017942_A_Fbxo10
  gRNA
acccgucggcggauaagaac

SEQ ID NO: 17943 - RNA, 20 nt, Artificial Sequence
  MKO10017943_A_Fbxo10
  gRNA
caaugccagaucgaagaccg

SEQ ID NO: 17944 - RNA, 20 nt, Artificial Sequence
  MKO10017944_A_Fbxo11
  gRNA
uucaggaugcaucaucggcc

SEQ ID NO: 17945 - RNA, 20 nt, Artificial Sequence
  MKO10017945_A_Fbxo11
  gRNA
acuucgacuacagaaaacuu

SEQ ID NO: 17946 - RNA, 20 nt, Artificial Sequence
  MKO10017946_A_Fbxo11
  gRNA
ccgaugaugcauccugaacc

SEQ ID NO: 17947 - RNA, 20 nt, Artificial Sequence
  MKO10017947_A_Fbxo15
  gRNA
uguagacacguuguccaccc

SEQ ID NO: 17948 - RNA, 20 nt, Artificial Sequence
  MKO10017948_A_Fbxo15
  gRNA
cagaaugccaucggaaaucu

SEQ ID NO: 17949 - RNA, 20 nt, Artificial Sequence
  MKO10017949_A_Fbxo15
  gRNA
uuagaucaaaaagaucacgu

SEQ ID NO: 17950 - RNA, 20 nt, Artificial Sequence
  MKO10017950_A_Fbxo16
  gRNA
ugcuuaucugacgaucgcca

SEQ ID NO: 17951 - RNA, 20 nt, Artificial Sequence
  MKO10017951_A_Fbxo16
  gRNA
ucaagugccugcgcuucaac

SEQ ID NO: 17952 - RNA, 20 nt, Artificial Sequence
  MKO10017952_A_Fbxo16
  gRNA
gagucuuugccguugugcac

SEQ ID NO: 17953 - RNA, 20 nt, Artificial Sequence
  MKO10017953_A_Fbxo17
  gRNA
ccggcuucgaguucgccuac

SEQ ID NO: 17954 - RNA, 20 nt, Artificial Sequence
  MKO10017954_A_Fbxo17
  gRNA
cguggaaaagaauuugacgc

SEQ ID NO: 17955 - RNA, 20 nt, Artificial Sequence
  MKO10017955_A_Fbxo17
  gRNA
cagcuaugcagaucucaauc

SEQ ID NO: 17956 - RNA, 20 nt, Artificial Sequence
  MKO10017956_A_Fbxo18
  gRNA
gauggcauucucucgagcca

SEQ ID NO: 17957 - RNA, 20 nt, Artificial Sequence
  MKO10017957_A_Fbxo18
  gRNA
ggaaauaaucaaugacccgc

SEQ ID NO: 17958 - RNA, 20 nt, Artificial Sequence
  MKO10017958_A_Fbxo18
  gRNA
ucccuaagccuugaacacga

SEQ ID NO: 17959 - RNA, 20 nt, Artificial Sequence
  MKO10017959_A_Fbxo21
  gRNA
cucuaaccaauugacguagu

SEQ ID NO: 17960 - RNA, 20 nt, Artificial Sequence
  MKO10017960_A_Fbxo21
  gRNA
gauuacgaguccuaucucga

SEQ ID NO: 17961 - RNA, 20 nt, Artificial Sequence
  MKO10017961_A_Fbxo21
  gRNA
cguaaucgucgggcugcugc

SEQ ID NO: 17962 - RNA, 20 nt, Artificial Sequence
  MKO10017962_A_Fbxo22
  gRNA
agauccaggucacgcugcga

SEQ ID NO: 17963 - RNA, 20 nt, Artificial Sequence
  MKO10017963_A_Fbxo22
  gRNA
gggacauugcuuggugcgcg

SEQ ID NO: 17964 - RNA, 20 nt, Artificial Sequence
  MKO10017964_A_Fbxo22
  gRNA
gagugucguggccauaaaag

SEQ ID NO: 17965 - RNA, 20 nt, Artificial Sequence
  MKO10017965_A_Fbxo24
  gRNA
cucgacacaacaccacguag

SEQ ID NO: 17966 - RNA, 20 nt, Artificial Sequence
  MKO10017966_A_Fbxo24
  gRNA
cgcuacgugguguugugucg

SEQ ID NO: 17967 - RNA, 20 nt, Artificial Sequence
  MKO10017967_A_Fbxo24
  gRNA
cgaccaagucuuugacuggg

SEQ ID NO: 17968 - RNA, 20 nt, Artificial Sequence
  MKO10017968_A_Fbxo25
  gRNA
ugagaagucuagccgguuga

SEQ ID NO: 17969 - RNA, 20 nt, Artificial Sequence
  MKO10017969_A_Fbxo25
  gRNA
caucaggagguucacuuacg

SEQ ID NO: 17970 - RNA, 20 nt, Artificial Sequence
  MKO10017970_A_Fbxo25
  gRNA
gugaauacgcagccaaaaag

SEQ ID NO: 17971 - RNA, 20 nt, Artificial Sequence
  MKO10017971_A_Fbxo27
  gRNA
cagggcgugucuucgugggc

SEQ ID NO: 17972 - RNA, 20 nt, Artificial Sequence
  MKO10017972_A_Fbxo27
  gRNA
gccgcaccauccauuugcgc

SEQ ID NO: 17973 - RNA, 20 nt, Artificial Sequence
  MKO10017973_A_Fbxo27
  gRNA
cugaugagguugcguccuag

SEQ ID NO: 17974 - RNA, 20 nt, Artificial Sequence
  MKO10017974_A_Fbxo28
  gRNA
cguucuguucgccuaugauc

SEQ ID NO: 17975 - RNA, 20 nt, Artificial Sequence
  MKO10017975_A_Fbxo28
  gRNA
guugccuuccgucguuuccg

SEQ ID NO: 17976 - RNA, 20 nt, Artificial Sequence
  MKO10017976_A_Fbxo28
  gRNA
guuacgggauaucuccucca

SEQ ID NO: 17977 - RNA, 20 nt, Artificial Sequence
  MKO10017977_A_Fbxo2
  gRNA
cagguggugucgcaaagcgc

SEQ ID NO: 17978 - RNA, 20 nt, Artificial Sequence
  MKO10017978_A_Fbxo2
  gRNA
cgagcugccagcuacggagc

SEQ ID NO: 17979 - RNA, 20 nt, Artificial Sequence
  MKO10017979_A_Fbxo2
  gRNA
guacucgggucgcacugaug

SEQ ID NO: 17980 - RNA, 20 nt, Artificial Sequence
  MKO10017980_A_Fbxo30
  gRNA
guacuauggaauggaaucga

SEQ ID NO: 17981 - RNA, 20 nt, Artificial Sequence
  MKO10017981_A_Fbxo30
  gRNA
aauaccacguacuaacgggu

SEQ ID NO: 17982 - RNA, 20 nt, Artificial Sequence
  MKO10017982_A_Fbxo30
  gRNA
aaguuacagccuuaaagcac

SEQ ID NO: 17983 - RNA, 20 nt, Artificial Sequence
  MKO10017983_A_Fbxo31
  gRNA
acguucagcaauccuccgua

SEQ ID NO: 17984 - RNA, 20 nt, Artificial Sequence
  MKO10017984_A_Fbxo31
  gRNA
cggaggauugcugaacgucg

SEQ ID NO: 17985 - RNA, 20 nt, Artificial Sequence
  MKO10017985_A_Fbxo31
  gRNA
gccaccucaugacccccacg

SEQ ID NO: 17986 - RNA, 20 nt, Artificial Sequence
  MKO10017986_A_Fbxo32
  gRNA
uacuacguaguugaaucuuc

SEQ ID NO: 17987 - RNA, 20 nt, Artificial Sequence
  MKO10017987_A_Fbxo32
  gRNA
gaagauucaacuacguagua

SEQ ID NO: 17988 - RNA, 20 nt, Artificial Sequence
  MKO10017988_A_Fbxo32
  gRNA
uguucacaaaggaaguacga

SEQ ID NO: 17989 - RNA, 20 nt, Artificial Sequence
  MKO10017989_A_Fbxo33
  gRNA
gccgcggagaauuaucugag

SEQ ID NO: 17990 - RNA, 20 nt, Artificial Sequence
  MKO10017990_A_Fbxo33
  gRNA
gaacccgagccggggccgcc

SEQ ID NO: 17991 - RNA, 20 nt, Artificial Sequence
  MKO10017991_A_Fbxo33
  gRNA
gucuuuaagguuacaccgug

SEQ ID NO: 17992 - RNA, 20 nt, Artificial Sequence
  MKO10017992_A_Fbxo34
  gRNA
ggguucgagacccacgcuau

SEQ ID NO: 17993 - RNA, 20 nt, Artificial Sequence
  MKO10017993_A_Fbxo34
  gRNA
gccaguccguguccuugaca

SEQ ID NO: 17994 - RNA, 20 nt, Artificial Sequence
  MKO10017994_A_Fbxo34
  gRNA
ucagugucggggagcgaguc

SEQ ID NO: 17995 - RNA, 20 nt, Artificial Sequence
  MKO10017995_A_Fbxo36
  gRNA
guucaagucgccguaguauu

SEQ ID NO: 17996 - RNA, 20 nt, Artificial Sequence
  MKO10017996_A_Fbxo36
  gRNA
uaauagucuuugcucggcgc

SEQ ID NO: 17997 - RNA, 20 nt, Artificial Sequence
  MKO10017997_A_Fbxo36
  gRNA
agucaaauuuaccuucgcac

SEQ ID NO: 17998 - RNA, 20 nt, Artificial Sequence
  MKO10017998_A_Fbxo38
  gRNA
uaugccgcauguucauauuu

SEQ ID NO: 17999 - RNA, 20 nt, Artificial Sequence
  MKO10017999_A_Fbxo38
  gRNA
cccucacucuucgccucucg

SEQ ID NO: 18000 - RNA, 20 nt, Artificial Sequence
  MKO10018000_A_Fbxo38
  gRNA
uucacccuagauaccucgag

SEQ ID NO: 18001 - RNA, 20 nt, Artificial Sequence
  MKO10018001_A_Fbxo39
  gRNA
cccggcguuguucucgcuca

SEQ ID NO: 18002 - RNA, 20 nt, Artificial Sequence
  MKO10018002_A_Fbxo39
  gRNA
accuugagcgagaacaacgc

SEQ ID NO: 18003 - RNA, 20 nt, Artificial Sequence
  MKO10018003_A_Fbxo39
  gRNA
gaaguaaaacagcuuccgac

SEQ ID NO: 18004 - RNA, 20 nt, Artificial Sequence
  MKO10018004_A_Fbxo3
  gRNA
auuugcagagggcgcacgug

SEQ ID NO: 18005 - RNA, 20 nt, Artificial Sequence
  MKO10018005_A_Fbxo3
  gRNA
gcgugaccucaagaaguacu

SEQ ID NO: 18006 - RNA, 20 nt, Artificial Sequence
  MKO10018006_A_Fbxo3
  gRNA
uaggucccuguaguccacga

SEQ ID NO: 18007 - RNA, 20 nt, Artificial Sequence
  MKO10018007_A_Fbxo40
  gRNA
ucgcuucccgcaguagcuca

SEQ ID NO: 18008 - RNA, 20 nt, Artificial Sequence
  MKO10018008_A_Fbxo40
  gRNA
gacauccagucgagucucga

SEQ ID NO: 18009 - RNA, 20 nt, Artificial Sequence
  MKO10018009_A_Fbxo40
  gRNA
agguggacacuaagcucucc

SEQ ID NO: 18010 - RNA, 20 nt, Artificial Sequence
  MKO10018010_A_Fbxo41
  gRNA
gaggucggcguugccaguuc

SEQ ID NO: 18011 - RNA, 20 nt, Artificial Sequence
  MKO10018011_A_Fbxo41
  gRNA
caagcacauacgccguauca

SEQ ID NO: 18012 - RNA, 20 nt, Artificial Sequence
  MKO10018012_A_Fbxo41
  gRNA
cugucgggacuggcgcuuug

SEQ ID NO: 18013 - RNA, 20 nt, Artificial Sequence
  MKO10018013_A_Fbxo42
  gRNA
cguacucgccgucuaaaaac

SEQ ID NO: 18014 - RNA, 20 nt, Artificial Sequence
  MKO10018014_A_Fbxo42
  gRNA
gagccggacuuacccuuauc

SEQ ID NO: 18015 - RNA, 20 nt, Artificial Sequence
  MKO10018015_A_Fbxo42
  gRNA
uuacaucugccgggauccua

SEQ ID NO: 18016 - RNA, 20 nt, Artificial Sequence
  MKO10018016_A_Fbxo43
  gRNA
ggccgcuguguuacguguuc

SEQ ID NO: 18017 - RNA, 20 nt, Artificial Sequence
  MKO10018017_A_Fbxo43
  gRNA
ugcgagaacacgcugcaguc

SEQ ID NO: 18018 - RNA, 20 nt, Artificial Sequence
  MKO10018018_A_Fbxo43
  gRNA
agacugcagcguguucucgc

SEQ ID NO: 18019 - RNA, 20 nt, Artificial Sequence
  MKO10018019_A_Fbxo44
  gRNA
gucgucagcccacgcaccac

SEQ ID NO: 18020 - RNA, 20 nt, Artificial Sequence
  MKO10018020_A_Fbxo44
  gRNA
caucgccuccguucacgucc

SEQ ID NO: 18021 - RNA, 20 nt, Artificial Sequence
  MKO10018021_A_Fbxo44
  gRNA
acgugaacggaggcgaugaa

SEQ ID NO: 18022 - RNA, 20 nt, Artificial Sequence
  MKO10018022_A_Fbxo45
  gRNA
ccucgcuguucucgucgccg

SEQ ID NO: 18023 - RNA, 20 nt, Artificial Sequence
  MKO10018023_A_Fbxo45
  gRNA
ugauugggauugcuacgaaa

SEQ ID NO: 18024 - RNA, 20 nt, Artificial Sequence
  MKO10018024_A_Fbxo45
  gRNA
ccacggcgacgagaacagcg

SEQ ID NO: 18025 - RNA, 20 nt, Artificial Sequence
  MKO10018025_A_Fbxo46
  gRNA
aucuugacgagcacgugcuc

SEQ ID NO: 18026 - RNA, 20 nt, Artificial Sequence
  MKO10018026_A_Fbxo46
  gRNA
gaaagcuauacgcaccucgc

SEQ ID NO: 18027 - RNA, 20 nt, Artificial Sequence
  MKO10018027_A_Fbxo46
  gRNA
gugccgcaagagauacgaga

SEQ ID NO: 18028 - RNA, 20 nt, Artificial Sequence
  MKO10018028_A_Fbxo47
  gRNA
auaagaaguuauacacacga

SEQ ID NO: 18029 - RNA, 20 nt, Artificial Sequence
  MKO10018029_A_Fbxo47
  gRNA
uuucuucagaccuuaacagc

SEQ ID NO: 18030 - RNA, 20 nt, Artificial Sequence
  MKO10018030_A_Fbxo47
  gRNA
gauaauccuaaacacugcaa

SEQ ID NO: 18031 - RNA, 20 nt, Artificial Sequence
  MKO10018031_A_Fbxo48
  gRNA
gccccauggaugcagauacg

SEQ ID NO: 18032 - RNA, 20 nt, Artificial Sequence
  MKO10018032_A_Fbxo48
  gRNA
cuuuguugaacuacugcccu

SEQ ID NO: 18033 - RNA, 20 nt, Artificial Sequence
  MKO10018033_A_Fbxo48
  gRNA
ugaauuccgcggaugcugaa

SEQ ID NO: 18034 - RNA, 20 nt, Artificial Sequence
  MKO10018034_A_Fbxo4
  gRNA
uucaaggcucuucgcguaua

SEQ ID NO: 18035 - RNA, 20 nt, Artificial Sequence
  MKO10018035_A_Fbxo4
  gRNA
ugauauuauacucgacuacc

SEQ ID NO: 18036 - RNA, 20 nt, Artificial Sequence
  MKO10018036_A_Fbxo4
  gRNA
ugguagucgaguauaauauc

SEQ ID NO: 18037 - RNA, 20 nt, Artificial Sequence
  MKO10018037_A_Fbxo5
  gRNA
guguucaaaagucaucgacc

SEQ ID NO: 18038 - RNA, 20 nt, Artificial Sequence
  MKO10018038_A_Fbxo5
  gRNA
ccuccacgaacucauugugc

SEQ ID NO: 18039 - RNA, 20 nt, Artificial Sequence
  MKO10018039_A_Fbxo5
  gRNA
acuuacaaugacucgcugca

SEQ ID NO: 18040 - RNA, 20 nt, Artificial Sequence
  MKO10018040_A_Fbxo6
  gRNA
cuuccagcgauccccuccgu

SEQ ID NO: 18041 - RNA, 20 nt, Artificial Sequence
  MKO10018041_A_Fbxo6
  gRNA
acuccaacggaggggaucgc

SEQ ID NO: 18042 - RNA, 20 nt, Artificial Sequence
  MKO10018042_A_Fbxo6
  gRNA
cagcuguacccggaguugau

SEQ ID NO: 18043 - RNA, 20 nt, Artificial Sequence
  MKO10018043_A_Fbxo7
  gRNA
gcaaagccgcccucgcagag

SEQ ID NO: 18044 - RNA, 20 nt, Artificial Sequence
  MKO10018044_A_Fbxo7
  gRNA
cagugaugccuugauagugc

SEQ ID NO: 18045 - RNA, 20 nt, Artificial Sequence
  MKO10018045_A_Fbxo7
  gRNA
gaaucagucccuuguucauc

SEQ ID NO: 18046 - RNA, 20 nt, Artificial Sequence
  MKO10018046_A_Fbxo8
  gRNA
agguacuccccacgcucuuc

SEQ ID NO: 18047 - RNA, 20 nt, Artificial Sequence
  MKO10018047_A_Fbxo8
  gRNA
ccugaccucaugcgagaacu

SEQ ID NO: 18048 - RNA, 20 nt, Artificial Sequence
  MKO10018048_A_Fbxo8
  gRNA
uauccuagaugauucgccaa

SEQ ID NO: 18049 - RNA, 20 nt, Artificial Sequence
  MKO10018049_A_Fbxo9
  gRNA
ucuccagacggcgacggcgu

SEQ ID NO: 18050 - RNA, 20 nt, Artificial Sequence
  MKO10018050_A_Fbxo9
  gRNA
uagccaucaaguucuaccgu

SEQ ID NO: 18051 - RNA, 20 nt, Artificial Sequence
  MKO10018051_A_Fbxo9
  gRNA
ggcucgagaacucuuccugc

SEQ ID NO: 18052 - RNA, 20 nt, Artificial Sequence
  MKO10018052_A_Fbxw10
  gRNA
ccacauagggguccuacaca

SEQ ID NO: 18053 - RNA, 20 nt, Artificial Sequence
  MKO10018053_A_Fbxw10
  gRNA
uggauaagcacagucugaac

SEQ ID NO: 18054 - RNA, 20 nt, Artificial Sequence
  MKO10018054_A_Fbxw10
  gRNA
agcugcccaagagacauaug

SEQ ID NO: 18055 - RNA, 20 nt, Artificial Sequence
  MKO10018055_A_Fbxw11
  gRNA
gauaaagucccgcugcaaca

SEQ ID NO: 18056 - RNA, 20 nt, Artificial Sequence
  MKO10018056_A_Fbxw11
  gRNA
guggcuaggcugcgccaacc

SEQ ID NO: 18057 - RNA, 20 nt, Artificial Sequence
  MKO10018057_A_Fbxw11
  gRNA
cggaugugucauuaucagca

SEQ ID NO: 18058 - RNA, 20 nt, Artificial Sequence
  MKO10018058_A_Fbxw13
  gRNA
uugauaccgacuugcuguac

SEQ ID NO: 18059 - RNA, 20 nt, Artificial Sequence
  MKO10018059_A_Fbxw13
  gRNA
gaagucaccauacagacgac

SEQ ID NO: 18060 - RNA, 20 nt, Artificial Sequence
  MKO10018060_A_Fbxw13
  gRNA
guaagcccaguacagcaagu

SEQ ID NO: 18061 - RNA, 20 nt, Artificial Sequence
  MKO10018061_A_Fbxw14
  gRNA
uucagauugcaguaauuuac

SEQ ID NO: 18062 - RNA, 20 nt, Artificial Sequence
  MKO10018062_A_Fbxw14
  gRNA
aagcucauaccaaacuccau

SEQ ID NO: 18063 - RNA, 20 nt, Artificial Sequence
  MKO10018063_A_Fbxw14
  gRNA
aguucuucuuuaacaaaaca

SEQ ID NO: 18064 - RNA, 20 nt, Artificial Sequence
  MKO10018064_A_Fbxw15
  gRNA
acgugccaaguuccgugcaa

SEQ ID NO: 18065 - RNA, 20 nt, Artificial Sequence
  MKO10018065_A_Fbxw15
  gRNA
aguucuucauugaucgaaua

SEQ ID NO: 18066 - RNA, 20 nt, Artificial Sequence
  MKO10018066_A_Fbxw15
  gRNA
ccaagaauacaauuuccacc

SEQ ID NO: 18067 - RNA, 20 nt, Artificial Sequence
  MKO10018067_A_Fbxw16
  gRNA
gguagucaucaguucaauau

SEQ ID NO: 18068 - RNA, 20 nt, Artificial Sequence
  MKO10018068_A_Fbxw16
  gRNA
cacagcuuucaguauuugac

SEQ ID NO: 18069 - RNA, 20 nt, Artificial Sequence
  MKO10018069_A_Fbxw16
  gRNA
guauggugacuuccacgaac

SEQ ID NO: 18070 - RNA, 20 nt, Artificial Sequence
  MKO10018070_A_Fbxw17
  gRNA
guuugcgugcccacgaccac

SEQ ID NO: 18071 - RNA, 20 nt, Artificial Sequence
  MKO10018071_A_Fbxw17
  gRNA
cuagaguuccguauggaauc

SEQ ID NO: 18072 - RNA, 20 nt, Artificial Sequence
  MKO10018072_A_Fbxw17
  gRNA
gccggcauccuguucuucaa

SEQ ID NO: 18073 - RNA, 20 nt, Artificial Sequence
  MKO10018073_A_Fbxw18
  gRNA
cucugcgcaaauuucuuugu

SEQ ID NO: 18074 - RNA, 20 nt, Artificial Sequence
  MKO10018074_A_Fbxw18
  gRNA
aaagaaauuugcgcagagac

SEQ ID NO: 18075 - RNA, 20 nt, Artificial Sequence
  MKO10018075_A_Fbxw18
  gRNA
uucaacagcuugauaguagu

SEQ ID NO: 18076 - RNA, 20 nt, Artificial Sequence
  MKO10018076_A_Fbxw19
  gRNA
gguagucauccgugugauau

SEQ ID NO: 18077 - RNA, 20 nt, Artificial Sequence
  MKO10018077_A_Fbxw19
  gRNA
ucgccaaaacuuuccuguug

SEQ ID NO: 18078 - RNA, 20 nt, Artificial Sequence
  MKO10018078_A_Fbxw19
  gRNA
aagacuauaccaaaugccac

SEQ ID NO: 18079 - RNA, 20 nt, Artificial Sequence
  MKO10018079_A_Fbxw20
  gRNA
uaacaagaaacguacaagac

SEQ ID NO: 18080 - RNA, 20 nt, Artificial Sequence
  MKO10018080_A_Fbxw20
  gRNA
ccaugaccaaguuguccacc

SEQ ID NO: 18081 - RNA, 20 nt, Artificial Sequence
  MKO10018081_A_Fbxw20
  gRNA
uucuccagggcauuaugacc

SEQ ID NO: 18082 - RNA, 20 nt, Artificial Sequence
  MKO10018082_A_Fbxw21
  gRNA
cauugcagucacuguagaua

SEQ ID NO: 18083 - RNA, 20 nt, Artificial Sequence
  MKO10018083_A_Fbxw21
  gRNA
aagcccauaccauacucugc

SEQ ID NO: 18084 - RNA, 20 nt, Artificial Sequence
  MKO10018084_A_Fbxw21
  gRNA
gacagcuuucagugacugac

SEQ ID NO: 18085 - RNA, 20 nt, Artificial Sequence
  MKO10018085_A_Fbxw22
  gRNA
gguagucaucugcaugauau

SEQ ID NO: 18086 - RNA, 20 nt, Artificial Sequence
  MKO10018086_A_Fbxw22
  gRNA
auuucuuguuaagccaugcc

SEQ ID NO: 18087 - RNA, 20 nt, Artificial Sequence
  MKO10018087_A_Fbxw22
  gRNA
uucagcuugcaguaauugac

SEQ ID NO: 18088 - RNA, 20 nt, Artificial Sequence
  MKO10018088_A_Fbxw24
  gRNA
gccuuguccguuucuuguua

SEQ ID NO: 18089 - RNA, 20 nt, Artificial Sequence
  MKO10018089_A_Fbxw24
  gRNA
guauugcaggaaguuguguc

SEQ ID NO: 18090 - RNA, 20 nt, Artificial Sequence
  MKO10018090_A_Fbxw24
  gRNA
gcagguguucggggauaugc

SEQ ID NO: 18091 - RNA, 20 nt, Artificial Sequence
  MKO10018091_A_Fbxw26
  gRNA
agcucuagcaacuaagcgca

SEQ ID NO: 18092 - RNA, 20 nt, Artificial Sequence
  MKO10018092_A_Fbxw26
  gRNA
ggucuuggcauguucuugcc

SEQ ID NO: 18093 - RNA, 20 nt, Artificial Sequence
  MKO10018093_A_Fbxw26
  gRNA
gacagcuuucaguaauugac

SEQ ID NO: 18094 - RNA, 20 nt, Artificial Sequence
  MKO10018094_A_Fbxw28
  gRNA
aguucuucuuugacaaaaca

SEQ ID NO: 18095 - RNA, 20 nt, Artificial Sequence
  MKO10018095_A_Fbxw28
  gRNA
uucuaccugggauauucaug

SEQ ID NO: 18096 - RNA, 20 nt, Artificial Sequence
  MKO10018096_A_Fbxw28
  gRNA
uuuaccuagugugccgauga

SEQ ID NO: 18097 - RNA, 20 nt, Artificial Sequence
  MKO10018097_A_Fbxw2
  gRNA
uuugagaccucuucguuaau

SEQ ID NO: 18098 - RNA, 20 nt, Artificial Sequence
  MKO10018098_A_Fbxw2
  gRNA
acuauguccaauuaacgaag

SEQ ID NO: 18099 - RNA, 20 nt, Artificial Sequence
  MKO10018099_A_Fbxw2
  gRNA
cggacuucgcugugaaagua

SEQ ID NO: 18100 - RNA, 20 nt, Artificial Sequence
  MKO10018100_A_Fbxw4
  gRNA
aguuucacgcgcuccuuuac

SEQ ID NO: 18101 - RNA, 20 nt, Artificial Sequence
  MKO10018101_A_Fbxw4
  gRNA
uccagaccgaagaccgaguc

SEQ ID NO: 18102 - RNA, 20 nt, Artificial Sequence
  MKO10018102_A_Fbxw4
  gRNA
cgguucaagcuugcaccauc

SEQ ID NO: 18103 - RNA, 20 nt, Artificial Sequence
  MKO10018103_A_Fbxw5
  gRNA
gccguaaaccuuucuugacg

SEQ ID NO: 18104 - RNA, 20 nt, Artificial Sequence
  MKO10018104_A_Fbxw5
  gRNA
uguuucgcacacgggacagc

SEQ ID NO: 18105 - RNA, 20 nt, Artificial Sequence
  MKO10018105_A_Fbxw5
  gRNA
gcguguguuugauagcgucu

SEQ ID NO: 18106 - RNA, 20 nt, Artificial Sequence
  MKO10018106_A_Fbxw7
  gRNA
aagucugagccgcuugcagc

SEQ ID NO: 18107 - RNA, 20 nt, Artificial Sequence
  MKO10018107_A_Fbxw7
  gRNA
cucagguccccaaaaguugu

SEQ ID NO: 18108 - RNA, 20 nt, Artificial Sequence
  MKO10018108_A_Fbxw7
  gRNA
ccgcugcugcccuugcccau

SEQ ID NO: 18109 - RNA, 20 nt, Artificial Sequence
  MKO10018109_A_Fbxw8
  gRNA
auauugauggccaguucgua

SEQ ID NO: 18110 - RNA, 20 nt, Artificial Sequence
  MKO10018110_A_Fbxw8
  gRNA
gauucuccgauuacaccugc

SEQ ID NO: 18111 - RNA, 20 nt, Artificial Sequence
  MKO10018111_A_Fbxw8
  gRNA
ugugacgugcguucucacga

SEQ ID NO: 18112 - RNA, 20 nt, Artificial Sequence
  MKO10018112_A_Fbxw9
  gRNA
gcgaaccgaguacuucugcc

SEQ ID NO: 18113 - RNA, 20 nt, Artificial Sequence
  MKO10018113_A_Fbxw9
  gRNA
acagguugacauuccgaucc

SEQ ID NO: 18114 - RNA, 20 nt, Artificial Sequence
  MKO10018114_A_Fbxw9
  gRNA
gaaggaucccagccgaguuc

SEQ ID NO: 18115 - RNA, 20 nt, Artificial Sequence
  MKO10018115_A_Fcamr
  gRNA
guauuucccaucucguucuc

SEQ ID NO: 18116 - RNA, 20 nt, Artificial Sequence
  MKO10018116_A_Fcamr
  gRNA
cagugagagccgcgcgccca

SEQ ID NO: 18117 - RNA, 20 nt, Artificial Sequence
  MKO10018117_A_Fcamr
  gRNA
guguucccagucaccagucg

SEQ ID NO: 18118 - RNA, 20 nt, Artificial Sequence
  MKO10018118_A_Fcer1a
  gRNA
guguacuugaauguaacgca

SEQ ID NO: 18119 - RNA, 20 nt, Artificial Sequence
  MKO10018119_A_Fcer1a
  gRNA
gccuaagauagcccuugcag

SEQ ID NO: 18120 - RNA, 20 nt, Artificial Sequence
  MKO10018120_A_Fcer1a
  gRNA
gaagaacuggaauguccgca

SEQ ID NO: 18121 - RNA, 20 nt, Artificial Sequence
  MKO10018121_A_Fcer1g
  gRNA
ccuugagucgacaguagagu

SEQ ID NO: 18122 - RNA, 20 nt, Artificial Sequence
  MKO10018122_A_Fcer1g
  gRNA
ccuacucuacugucgacuca

SEQ ID NO: 18123 - RNA, 20 nt, Artificial Sequence
  MKO10018123_A_Fcer1g
  gRNA
acuccagauccagguccgaa

SEQ ID NO: 18124 - RNA, 20 nt, Artificial Sequence
  MKO10018124_A_Fcer2a
  gRNA
gcacagcagcaacgcuuucu

SEQ ID NO: 18125 - RNA, 20 nt, Artificial Sequence
  MKO10018125_A_Fcer2a
  gRNA
cguugcugcugugcaagacg

SEQ ID NO: 18126 - RNA, 20 nt, Artificial Sequence
  MKO10018126_A_Fcer2a
  gRNA
cccagucucucauguuacca

SEQ ID NO: 18127 - RNA, 20 nt, Artificial Sequence
  MKO10018127_A_Fcf1
  gRNA
auugggacagaaguuucgug

SEQ ID NO: 18128 - RNA, 20 nt, Artificial Sequence
  MKO10018128_A_Fcf1
  gRNA
uuguauaacugauuguguaa

SEQ ID NO: 18129 - RNA, 20 nt, Artificial Sequence
  MKO10018129_A_Fcf1
  gRNA
ucgacaaggaugugguaagg

SEQ ID NO: 18130 - RNA, 20 nt, Artificial Sequence
  MKO10018130_A_Fcgbp
  gRNA
ccgcacuaugugagcuucga

SEQ ID NO: 18131 - RNA, 20 nt, Artificial Sequence
  MKO10018131_A_Fcgbp
  gRNA
uggaauccuugcugaucccg

SEQ ID NO: 18132 - RNA, 20 nt, Artificial Sequence
  MKO10018132_A_Fcgbp
  gRNA
gggcauaggcgcuaaggcuc

SEQ ID NO: 18133 - RNA, 20 nt, Artificial Sequence
  MKO10018133_A_Fcgr1
  gRNA
cucuuuccgcccuugcuaua

SEQ ID NO: 18134 - RNA, 20 nt, Artificial Sequence
  MKO10018134_A_Fcgr1
  gRNA
uucaggacaguggcgaauac

SEQ ID NO: 18135 - RNA, 20 nt, Artificial Sequence
  MKO10018135_A_Fcgr1
  gRNA
ucucuugcaguuccagucgg

SEQ ID NO: 18136 - RNA, 20 nt, Artificial Sequence
  MKO10018136_A_Fcgr2b
  gRNA
uccggauggaccucccauug

SEQ ID NO: 18137 - RNA, 20 nt, Artificial Sequence
  MKO10018137_A_Fcgr2b
  gRNA
gccguuccuacugaucccca

SEQ ID NO: 18138 - RNA, 20 nt, Artificial Sequence
  MKO10018138_A_Fcgr2b
  gRNA
uggucaaacucgagcccccg

SEQ ID NO: 18139 - RNA, 20 nt, Artificial Sequence
  MKO10018139_A_Fcgr3
  gRNA
uucaaaccccgagggauuac

SEQ ID NO: 18140 - RNA, 20 nt, Artificial Sequence
  MKO10018140_A_Fcgr3
  gRNA
gacuuccuccaguaaucccu

SEQ ID NO: 18141 - RNA, 20 nt, Artificial Sequence
  MKO10018141_A_Fcgr3
  gRNA
ccuuaaacguguagcuggau

SEQ ID NO: 18142 - RNA, 20 nt, Artificial Sequence
  MKO10018142_A_Fcgr4
  gRNA
accgccuaggcuuauacgaa

SEQ ID NO: 18143 - RNA, 20 nt, Artificial Sequence
  MKO10018143_A_Fcgr4
  gRNA
gugggaugaggcuuucguua

SEQ ID NO: 18144 - RNA, 20 nt, Artificial Sequence
  MKO10018144_A_Fcgr4
  gRNA
ccgaggacaauucuaucaag

SEQ ID NO: 18145 - RNA, 20 nt, Artificial Sequence
  MKO10018145_A_Fcgrt
  gRNA
gccgccgucuaugcgccuga

SEQ ID NO: 18146 - RNA, 20 nt, Artificial Sequence
  MKO10018146_A_Fcgrt
  gRNA
ccaguccaauugccgauucu

SEQ ID NO: 18147 - RNA, 20 nt, Artificial Sequence
  MKO10018147_A_Fcgrt
  gRNA
uuagcaacgauuuccgucuc

SEQ ID NO: 18148 - RNA, 20 nt, Artificial Sequence
  MKO10018148_A_Fcho1
  gRNA
ccccaugggggucccguugc

SEQ ID NO: 18149 - RNA, 20 nt, Artificial Sequence
  MKO10018149_A_Fcho1
  gRNA
gaauuacuugagccgcugua

SEQ ID NO: 18150 - RNA, 20 nt, Artificial Sequence
  MKO10018150_A_Fcho1
  gRNA
ccaggaccuuugccccgcuc

SEQ ID NO: 18151 - RNA, 20 nt, Artificial Sequence
  MKO10018151_A_Fcho2
  gRNA
cagacuaaagaagaagucgc

SEQ ID NO: 18152 - RNA, 20 nt, Artificial Sequence
  MKO10018152_A_Fcho2
  gRNA
cacugccaaauguguagaac

SEQ ID NO: 18153 - RNA, 20 nt, Artificial Sequence
  MKO10018153_A_Fcho2
  gRNA
uuagaacauuugcaccaaug

SEQ ID NO: 18154 - RNA, 20 nt, Artificial Sequence
  MKO10018154_A_Fchsd1
  gRNA
cgcgauaucggucagacgcc

SEQ ID NO: 18155 - RNA, 20 nt, Artificial Sequence
  MKO10018155_A_Fchsd1
  gRNA
gaccgauaucgcgaccuagc

SEQ ID NO: 18156 - RNA, 20 nt, Artificial Sequence
  MKO10018156_A_Fchsd1
  gRNA
cuggccauacucccguucaa

SEQ ID NO: 18157 - RNA, 20 nt, Artificial Sequence
  MKO10018157_A_Fchsd2
  gRNA
gcaucaugcagccgccgccg

SEQ ID NO: 18158 - RNA, 20 nt, Artificial Sequence
  MKO10018158_A_Fchsd2
  gRNA
gguauugacuagccaacuuc

SEQ ID NO: 18159 - RNA, 20 nt, Artificial Sequence
  MKO10018159_A_Fchsd2
  gRNA
ugcgcccuuaccuuccucgg

SEQ ID NO: 18160 - RNA, 20 nt, Artificial Sequence
  MKO10018160_A_Fcna
  gRNA
uaugcagauguuaaggucgu

SEQ ID NO: 18161 - RNA, 20 nt, Artificial Sequence
  MKO10018161_A_Fcna
  gRNA
agauugcuaccucuuccagc

SEQ ID NO: 18162 - RNA, 20 nt, Artificial Sequence
  MKO10018162_A_Fcna
  gRNA
ccaggggagaaaggcgauac

SEQ ID NO: 18163 - RNA, 20 nt, Artificial Sequence
  MKO10018163_A_Fcnb
  gRNA
accuguagcacaugacugag

SEQ ID NO: 18164 - RNA, 20 nt, Artificial Sequence
  MKO10018164_A_Fcnb
  gRNA
aagcagcucaccauccuuca

SEQ ID NO: 18165 - RNA, 20 nt, Artificial Sequence
  MKO10018165_A_Fcnb
  gRNA
uuguuaccuuuggguccagu

SEQ ID NO: 18166 - RNA, 20 nt, Artificial Sequence
  MKO10018166_A_Fcrl1
  gRNA
gagccaccaccucacuucgu

SEQ ID NO: 18167 - RNA, 20 nt, Artificial Sequence
  MKO10018167_A_Fcrl1
  gRNA
ucucgcccuguccuuacguu

SEQ ID NO: 18168 - RNA, 20 nt, Artificial Sequence
  MKO10018168_A_Fcrl1
  gRNA
cucuaucaaccgagcagaug

SEQ ID NO: 18169 - RNA, 20 nt, Artificial Sequence
  MKO10018169_A_Fcrl5
  gRNA
gacuugaacuacgaccguau

SEQ ID NO: 18170 - RNA, 20 nt, Artificial Sequence
  MKO10018170_A_Fcrl5
  gRNA
gaaugugaaacuccgaggag

SEQ ID NO: 18171 - RNA, 20 nt, Artificial Sequence
  MKO10018171_A_Fcrl5
  gRNA
gucugacacgucagggucac

SEQ ID NO: 18172 - RNA, 20 nt, Artificial Sequence
  MKO10018172_A_Fcrl6
  gRNA
auucaccaauucagagacga

SEQ ID NO: 18173 - RNA, 20 nt, Artificial Sequence
  MKO10018173_A_Fcrl6
  gRNA
auucuugggguccaccuuua

SEQ ID NO: 18174 - RNA, 20 nt, Artificial Sequence
  MKO10018174_A_Fcrl6
  gRNA
cucccuccucgccucaguaa

SEQ ID NO: 18175 - RNA, 20 nt, Artificial Sequence
  MKO10018175_A_Fcrla
  gRNA
ucagguuaucuucuaccgag

SEQ ID NO: 18176 - RNA, 20 nt, Artificial Sequence
  MKO10018176_A_Fcrla
  gRNA
ugguucugcacugccgcgcc

SEQ ID NO: 18177 - RNA, 20 nt, Artificial Sequence
  MKO10018177_A_Fcrla
  gRNA
augacccaauccagugaagc

SEQ ID NO: 18178 - RNA, 20 nt, Artificial Sequence
  MKO10018178_A_Fcrlb
  gRNA
cgauucgagcuccucgaccu

SEQ ID NO: 18179 - RNA, 20 nt, Artificial Sequence
  MKO10018179_A_Fcrlb
  gRNA
ucgaggagcucgaaucguac

SEQ ID NO: 18180 - RNA, 20 nt, Artificial Sequence
  MKO10018180_A_Fcrlb
  gRNA
cgacuuugucguaccagcca

SEQ ID NO: 18181 - RNA, 20 nt, Artificial Sequence
  MKO10018181_A_Fcrls
  gRNA
ucaccggacuggacuccgac

SEQ ID NO: 18182 - RNA, 20 nt, Artificial Sequence
  MKO10018182_A_Fcrls
  gRNA
accgcgucuugcauuccuaa

SEQ ID NO: 18183 - RNA, 20 nt, Artificial Sequence
  MKO10018183_A_Fcrls
  gRNA
agcuggagaucccuacuauc

SEQ ID NO: 18184 - RNA, 20 nt, Artificial Sequence
  MKO10018184_A_Fdft1
  gRNA
caguacugccacuacguugc

SEQ ID NO: 18185 - RNA, 20 nt, Artificial Sequence
  MKO10018185_A_Fdft1
  gRNA
ccaccagcccagcaacguag

SEQ ID NO: 18186 - RNA, 20 nt, Artificial Sequence
  MKO10018186_A_Fdft1
  gRNA
agugcuggaggacuucccca

SEQ ID NO: 18187 - RNA, 20 nt, Artificial Sequence
  MKO10018187_A_Fdps
  gRNA
agugggcugguguguagaac

SEQ ID NO: 18188 - RNA, 20 nt, Artificial Sequence
  MKO10018188_A_Fdps
  gRNA
cuaacagccaggcauaggcu

SEQ ID NO: 18189 - RNA, 20 nt, Artificial Sequence
  MKO10018189_A_Fdps
  gRNA
cugcccgaucucugucugau

SEQ ID NO: 18190 - RNA, 20 nt, Artificial Sequence
  MKO10018190_A_Fdx1l
  gRNA
uuuccaggcgagcggcgugc

SEQ ID NO: 18191 - RNA, 20 nt, Artificial Sequence
  MKO10018191_A_Fdx1l
  gRNA
ccgcucuggcaagcggaucc

SEQ ID NO: 18192 - RNA, 20 nt, Artificial Sequence
  MKO10018192_A_Fdx1l
  gRNA
ucccagggaggacgacaugu

SEQ ID NO: 18193 - RNA, 20 nt, Artificial Sequence
  MKO10018193_A_Fdx1
  gRNA
ucguuagcgucucgccaucu

SEQ ID NO: 18194 - RNA, 20 nt, Artificial Sequence
  MKO10018194_A_Fdx1
  gRNA
aaggccgcggaaagggacgg

SEQ ID NO: 18195 - RNA, 20 nt, Artificial Sequence
  MKO10018195_A_Fdx1
  gRNA
caggguuauggcggccgcuc

SEQ ID NO: 18196 - RNA, 20 nt, Artificial Sequence
  MKO10018196_A_Fdxacb1
  gRNA
augccuugccagccgacgau

SEQ ID NO: 18197 - RNA, 20 nt, Artificial Sequence
  MKO10018197_A_Fdxacb1
  gRNA
ucgaucaaaaucccuaucgu

SEQ ID NO: 18198 - RNA, 20 nt, Artificial Sequence
  MKO10018198_A_Fdxacb1
  gRNA
gcuacauguuucaccucgau

SEQ ID NO: 18199 - RNA, 20 nt, Artificial Sequence
  MKO10018199_A_Fdxr
  gRNA
gugccacaccaaagcgcacc

SEQ ID NO: 18200 - RNA, 20 nt, Artificial Sequence
  MKO10018200_A_Fdxr
  gRNA
acuccaggcagcuccucgcc

SEQ ID NO: 18201 - RNA, 20 nt, Artificial Sequence
  MKO10018201_A_Fdxr
  gRNA
cacagcccaacacuuguuaa

SEQ ID NO: 18202 - RNA, 20 nt, Artificial Sequence
  MKO10018202_A_Fech
  gRNA
guucggcguuuggcgaugaa

SEQ ID NO: 18203 - RNA, 20 nt, Artificial Sequence
  MKO10018203_A_Fech
  gRNA
cugccaccgcagcacccgac

SEQ ID NO: 18204 - RNA, 20 nt, Artificial Sequence
  MKO10018204_A_Fech
  gRNA
ggcaugauguaccuucuccg

SEQ ID NO: 18205 - RNA, 20 nt, Artificial Sequence
  MKO10018205_A_Fem1a
  gRNA
ccuggacgugguacgcuacc

SEQ ID NO: 18206 - RNA, 20 nt, Artificial Sequence
  MKO10018206_A_Fem1a
  gRNA
ugggcuaggcucaaugcaac

SEQ ID NO: 18207 - RNA, 20 nt, Artificial Sequence
  MKO10018207_A_Fem1a
  gRNA
gggcgucuucccaucgcugc

SEQ ID NO: 18208 - RNA, 20 nt, Artificial Sequence
  MKO10018208_A_Fem1b
  gRNA
agcggauaucgcucucugac

SEQ ID NO: 18209 - RNA, 20 nt, Artificial Sequence
  MKO10018209_A_Fem1b
  gRNA
gagcgauauccgcuaccugc

SEQ ID NO: 18210 - RNA, 20 nt, Artificial Sequence
  MKO10018210_A_Fem1b
  gRNA
ccgcuagacaaaaguacaac

SEQ ID NO: 18211 - RNA, 20 nt, Artificial Sequence
  MKO10018211_A_Fem1c
  gRNA
uauucagagccgcgauaugu

SEQ ID NO: 18212 - RNA, 20 nt, Artificial Sequence
  MKO10018212_A_Fem1c
  gRNA
cuucgagccgcgugcuucga

SEQ ID NO: 18213 - RNA, 20 nt, Artificial Sequence
  MKO10018213_A_Fem1c
  gRNA
uguagaacacaaagccgauu

SEQ ID NO: 18214 - RNA, 20 nt, Artificial Sequence
  MKO10018214_A_Fen1
  gRNA
acgccucgaugauuucuuca

SEQ ID NO: 18215 - RNA, 20 nt, Artificial Sequence
  MKO10018215_A_Fen1
  gRNA
aguaccccguuccagagaac

SEQ ID NO: 18216 - RNA, 20 nt, Artificial Sequence
  MKO10018216_A_Fen1
  gRNA
gggagcggggaaguuccgaa

SEQ ID NO: 18217 - RNA, 20 nt, Artificial Sequence
  MKO10018217_A_Fer1l4
  gRNA
agacgauuaccugucucgaa

SEQ ID NO: 18218 - RNA, 20 nt, Artificial Sequence
  MKO10018218_A_Fer1l4
  gRNA
guagccgcguguucagcccc

SEQ ID NO: 18219 - RNA, 20 nt, Artificial Sequence
  MKO10018219_A_Fer1l4
  gRNA
uugggacacccauucgagac

SEQ ID NO: 18220 - RNA, 20 nt, Artificial Sequence
  MKO10018220_A_Fer1l5
  gRNA
cacuguaccgcucaagcggc

SEQ ID NO: 18221 - RNA, 20 nt, Artificial Sequence
  MKO10018221_A_Fer1l5
  gRNA
cguauauuugggccacaugu

SEQ ID NO: 18222 - RNA, 20 nt, Artificial Sequence
  MKO10018222_A_Fer1l5
  gRNA
gccccucacagacccuaauc

SEQ ID NO: 18223 - RNA, 20 nt, Artificial Sequence
  MKO10018223_A_Ferd3l
  gRNA
uauuacuuaugcccagcgcc

SEQ ID NO: 18224 - RNA, 20 nt, Artificial Sequence
  MKO10018224_A_Ferd3l
  gRNA
uggguaccuuucugcgcagc

SEQ ID NO: 18225 - RNA, 20 nt, Artificial Sequence
  MKO10018225_A_Ferd3l
  gRNA
ccucuuccucucgcgaaugu

SEQ ID NO: 18226 - RNA, 20 nt, Artificial Sequence
  MKO10018226_A_Fermt1
  gRNA
cagccgaaaagcugacgcgc

SEQ ID NO: 18227 - RNA, 20 nt, Artificial Sequence
  MKO10018227_A_Fermt1
  gRNA
ggauuccucacgaucccuua

SEQ ID NO: 18228 - RNA, 20 nt, Artificial Sequence
  MKO10018228_A_Fermt1
  gRNA
gcacggucuuggcauugggc

SEQ ID NO: 18229 - RNA, 20 nt, Artificial Sequence
  MKO10018229_A_Fermt2
  gRNA
ccaucaugagcgucguaagu

SEQ ID NO: 18230 - RNA, 20 nt, Artificial Sequence
  MKO10018230_A_Fermt2
  gRNA
ccuacuuacgacgcucauga

SEQ ID NO: 18231 - RNA, 20 nt, Artificial Sequence
  MKO10018231_A_Fermt2
  gRNA
caagcgcuucgucuucagac

SEQ ID NO: 18232 - RNA, 20 nt, Artificial Sequence
  MKO10018232_A_Fermt3
  gRNA
gcgcuguccgagaagugugc

SEQ ID NO: 18233 - RNA, 20 nt, Artificial Sequence
  MKO10018233_A_Fermt3
  gRNA
gguccucacagaucgcaagc

SEQ ID NO: 18234 - RNA, 20 nt, Artificial Sequence
  MKO10018234_A_Fermt3
  gRNA
gcuggacaaguacgggauuc

SEQ ID NO: 18235 - RNA, 20 nt, Artificial Sequence
  MKO10018235_A_Fert2
  gRNA
ccagaaucuguaucgauucg

SEQ ID NO: 18236 - RNA, 20 nt, Artificial Sequence
  MKO10018236_A_Fert2
  gRNA
gguaccagucaugcuccgcc

SEQ ID NO: 18237 - RNA, 20 nt, Artificial Sequence
  MKO10018237_A_Fert2
  gRNA
gaagauccgaguaccgacuu

SEQ ID NO: 18238 - RNA, 20 nt, Artificial Sequence
  MKO10018238_A_Fes
  gRNA
ccaccacaaccgcuacgucc

SEQ ID NO: 18239 - RNA, 20 nt, Artificial Sequence
  MKO10018239_A_Fes
  gRNA
gaaagacguacaacgagcag

SEQ ID NO: 18240 - RNA, 20 nt, Artificial Sequence
  MKO10018240_A_Fes
  gRNA
cagcucacccauauugucgc

SEQ ID NO: 18241 - RNA, 20 nt, Artificial Sequence
  MKO10018241_A_Fetub
  gRNA
gaacuuugcaagcgacuccg

SEQ ID NO: 18242 - RNA, 20 nt, Artificial Sequence
  MKO10018242_A_Fetub
  gRNA
uauaacuguacacuucgccc

SEQ ID NO: 18243 - RNA, 20 nt, Artificial Sequence
  MKO10018243_A_Fetub
  gRNA
cgaaguguacaguuauaagc

SEQ ID NO: 18244 - RNA, 20 nt, Artificial Sequence
  MKO10018244_A_Fev
  gRNA
gcccucccacgcgaugcaac

SEQ ID NO: 18245 - RNA, 20 nt, Artificial Sequence
  MKO10018245_A_Fev
  gRNA
ucggcgggcguugcgcccgc

SEQ ID NO: 18246 - RNA, 20 nt, Artificial Sequence
  MKO10018246_A_Fev
  gRNA
cugagccccgcgguacagaa

SEQ ID NO: 18247 - RNA, 20 nt, Artificial Sequence
  MKO10018247_A_Fez1
  gRNA
ccauucagagcuucaauguu

SEQ ID NO: 18248 - RNA, 20 nt, Artificial Sequence
  MKO10018248_A_Fez1
  gRNA
cucaaugagcaccgugauga

SEQ ID NO: 18249 - RNA, 20 nt, Artificial Sequence
  MKO10018249_A_Fez1
  gRNA
cuagggcugagacacauguc

SEQ ID NO: 18250 - RNA, 20 nt, Artificial Sequence
  MKO10018250_A_Fez2
  gRNA
cgaacucgaguucaucucgc

SEQ ID NO: 18251 - RNA, 20 nt, Artificial Sequence
  MKO10018251_A_Fez2
  gRNA
cggcuugcucuuugacgccu

SEQ ID NO: 18252 - RNA, 20 nt, Artificial Sequence
  MKO10018252_A_Fez2
  gRNA
gucucgucgucuucuggguc

SEQ ID NO: 18253 - RNA, 20 nt, Artificial Sequence
  MKO10018253_A_Fezf1
  gRNA
ugcgagcgugaacauccacc

SEQ ID NO: 18254 - RNA, 20 nt, Artificial Sequence
  MKO10018254_A_Fezf1
  gRNA
gcgcgccaugauucguucga

SEQ ID NO: 18255 - RNA, 20 nt, Artificial Sequence
  MKO10018255_A_Fezf1
  gRNA
uuuguagcccgcgugaauuc

SEQ ID NO: 18256 - RNA, 20 nt, Artificial Sequence
  MKO10018256_A_Fezf2
  gRNA
cccgagcgccuuucgagccc

SEQ ID NO: 18257 - RNA, 20 nt, Artificial Sequence
  MKO10018257_A_Fezf2
  gRNA
uuucucuaucgagcgcauca

SEQ ID NO: 18258 - RNA, 20 nt, Artificial Sequence
  MKO10018258_A_Fezf2
  gRNA
gcgcaaacuucaugacagcg

SEQ ID NO: 18259 - RNA, 20 nt, Artificial Sequence
  MKO10018259_A_Ffar1
  gRNA
uccggaggccccgcuauucc

SEQ ID NO: 18260 - RNA, 20 nt, Artificial Sequence
  MKO10018260_A_Ffar1
  gRNA
gcagaccggggagccauuca

SEQ ID NO: 18261 - RNA, 20 nt, Artificial Sequence
  MKO10018261_A_Ffar1
  gRNA
gcccuauaaugccuccaaug

SEQ ID NO: 18262 - RNA, 20 nt, Artificial Sequence
  MKO10018262_A_Ffar2
  gRNA
ugcaguacaaguuaucccgc

SEQ ID NO: 18263 - RNA, 20 nt, Artificial Sequence
  MKO10018263_A_Ffar2
  gRNA
ugugguacugcccguacgac

SEQ ID NO: 18264 - RNA, 20 nt, Artificial Sequence
  MKO10018264_A_Ffar2
  gRNA
aagaucgugugcgcgcugac

SEQ ID NO: 18265 - RNA, 20 nt, Artificial Sequence
  MKO10018265_A_Ffar3
  gRNA
cgccggcgcaagaggauaau

SEQ ID NO: 18266 - RNA, 20 nt, Artificial Sequence
  MKO10018266_A_Ffar3
  gRNA
caacucuuguaucgaccccc

SEQ ID NO: 18267 - RNA, 20 nt, Artificial Sequence
  MKO10018267_A_Ffar3
  gRNA
agccgacuuucaucaacucc

SEQ ID NO: 18268 - RNA, 20 nt, Artificial Sequence
  MKO10018268_A_Ffar4
  gRNA
cucuagugcucgucgugcgc

SEQ ID NO: 18269 - RNA, 20 nt, Artificial Sequence
  MKO10018269_A_Ffar4
  gRNA
cgucguggagaccaccguuc

SEQ ID NO: 18270 - RNA, 20 nt, Artificial Sequence
  MKO10018270_A_Ffar4
  gRNA
uguacaacaugucgcuguuc

SEQ ID NO: 18271 - RNA, 20 nt, Artificial Sequence
  MKO10018271_A_Fga
  gRNA
guugauugacgaagccaacc

SEQ ID NO: 18272 - RNA, 20 nt, Artificial Sequence
  MKO10018272_A_Fga
  gRNA
guugauagacaugaagcgcc

SEQ ID NO: 18273 - RNA, 20 nt, Artificial Sequence
  MKO10018273_A_Fga
  gRNA
aguacguggcccaagaguug

SEQ ID NO: 18274 - RNA, 20 nt, Artificial Sequence
  MKO10018274_A_Fgb
  gRNA
cuaucgagcccguccagcca

SEQ ID NO: 18275 - RNA, 20 nt, Artificial Sequence
  MKO10018275_A_Fgb
  gRNA
uguugcaauguacaucccgu

SEQ ID NO: 18276 - RNA, 20 nt, Artificial Sequence
  MKO10018276_A_Fgb
  gRNA
ccgauuccagacggauagcu

SEQ ID NO: 18277 - RNA, 20 nt, Artificial Sequence
  MKO10018277_A_Fgd1
  gRNA
caacggcuucgcucagaucc

SEQ ID NO: 18278 - RNA, 20 nt, Artificial Sequence
  MKO10018278_A_Fgd1
  gRNA
ugggggucggccaaagcuac

SEQ ID NO: 18279 - RNA, 20 nt, Artificial Sequence
  MKO10018279_A_Fgd1
  gRNA
cuggaucugagcgaagccgu

SEQ ID NO: 18280 - RNA, 20 nt, Artificial Sequence
  MKO10018280_A_Fgd2
  gRNA
cugggcguggaaacgauaga

SEQ ID NO: 18281 - RNA, 20 nt, Artificial Sequence
  MKO10018281_A_Fgd2
  gRNA
augagcuucaccacguccuc

SEQ ID NO: 18282 - RNA, 20 nt, Artificial Sequence
  MKO10018282_A_Fgd2
  gRNA
ccgcggaacugcuggccacg

SEQ ID NO: 18283 - RNA, 20 nt, Artificial Sequence
  MKO10018283_A_Fgd3
  gRNA
ccuuaaacugcggagaacgc

SEQ ID NO: 18284 - RNA, 20 nt, Artificial Sequence
  MKO10018284_A_Fgd3
  gRNA
ccagcguucuccgcaguuua

SEQ ID NO: 18285 - RNA, 20 nt, Artificial Sequence
  MKO10018285_A_Fgd3
  gRNA
cguaggcuuccuccgugugc

SEQ ID NO: 18286 - RNA, 20 nt, Artificial Sequence
  MKO10018286_A_Fgd4
  gRNA
guccaacguauccaauccca

SEQ ID NO: 18287 - RNA, 20 nt, Artificial Sequence
  MKO10018287_A_Fgd4
  gRNA
aaaacguuaccugaucuagg

SEQ ID NO: 18288 - RNA, 20 nt, Artificial Sequence
  MKO10018288_A_Fgd4
  gRNA
uugugcagccacuacaccau

SEQ ID NO: 18289 - RNA, 20 nt, Artificial Sequence
  MKO10018289_A_Fgd5
  gRNA
uagagcccuugucaucgcuc

SEQ ID NO: 18290 - RNA, 20 nt, Artificial Sequence
  MKO10018290_A_Fgd5
  gRNA
agauagcugggagcucccgc

SEQ ID NO: 18291 - RNA, 20 nt, Artificial Sequence
  MKO10018291_A_Fgd5
  gRNA
cgccuacacugagcccuaca

SEQ ID NO: 18292 - RNA, 20 nt, Artificial Sequence
  MKO10018292_A_Fgd6
  gRNA
uuggucuucuucguuaaccg

SEQ ID NO: 18293 - RNA, 20 nt, Artificial Sequence
  MKO10018293_A_Fgd6
  gRNA
acgcagcagcgaucaccuug

SEQ ID NO: 18294 - RNA, 20 nt, Artificial Sequence
  MKO10018294_A_Fgd6
  gRNA
uggcucgccuuuacuggacu

SEQ ID NO: 18295 - RNA, 20 nt, Artificial Sequence
  MKO10018295_A_Fgf10
  gRNA
cucaaucgugagaaaguacu

SEQ ID NO: 18296 - RNA, 20 nt, Artificial Sequence
  MKO10018296_A_Fgf10
  gRNA
cuucuauguuuggaucguca

SEQ ID NO: 18297 - RNA, 20 nt, Artificial Sequence
  MKO10018297_A_Fgf10
  gRNA
ccgcacaugccuucccgcac

SEQ ID NO: 18298 - RNA, 20 nt, Artificial Sequence
  MKO10018298_A_Fgf11
  gRNA
cucuaccgucagcgucguuc

SEQ ID NO: 18299 - RNA, 20 nt, Artificial Sequence
  MKO10018299_A_Fgf11
  gRNA
cccggccagaacgacgcuga

SEQ ID NO: 18300 - RNA, 20 nt, Artificial Sequence
  MKO10018300_A_Fgf11
  gRNA
uaccuccaggcgaaucccga

SEQ ID NO: 18301 - RNA, 20 nt, Artificial Sequence
  MKO10018301_A_Fgf12
  gRNA
cugauuccugcuggcgauac

SEQ ID NO: 18302 - RNA, 20 nt, Artificial Sequence
  MKO10018302_A_Fgf12
  gRNA
cucaacccuguaucgccagc

SEQ ID NO: 18303 - RNA, 20 nt, Artificial Sequence
  MKO10018303_A_Fgf12
  gRNA
gaaccaucacuacacgaaau

SEQ ID NO: 18304 - RNA, 20 nt, Artificial Sequence
  MKO10018304_A_Fgf13
  gRNA
cuggcuacguugauucguug

SEQ ID NO: 18305 - RNA, 20 nt, Artificial Sequence
  MKO10018305_A_Fgf13
  gRNA
cgagggauacuuguacaccu

SEQ ID NO: 18306 - RNA, 20 nt, Artificial Sequence
  MKO10018306_A_Fgf13
  gRNA
gccaucucugcacgaucuca

SEQ ID NO: 18307 - RNA, 20 nt, Artificial Sequence
  MKO10018307_A_Fgf14
  gRNA
uacuugcagaugcaccccga

SEQ ID NO: 18308 - RNA, 20 nt, Artificial Sequence
  MKO10018308_A_Fgf14
  gRNA
uuccaucgagagcuccaucg

SEQ ID NO: 18309 - RNA, 20 nt, Artificial Sequence
  MKO10018309_A_Fgf14
  gRNA
acugcgcguuguugccaucc

SEQ ID NO: 18310 - RNA, 20 nt, Artificial Sequence
  MKO10018310_A_Fgf15
  gRNA
ucgucuucagagcgaccgcg

SEQ ID NO: 18311 - RNA, 20 nt, Artificial Sequence
  MKO10018311_A_Fgf15
  gRNA
agauuuguuggaauuccgcg

SEQ ID NO: 18312 - RNA, 20 nt, Artificial Sequence
  MKO10018312_A_Fgf15
  gRNA
gauacucacuucguucguuu

SEQ ID NO: 18313 - RNA, 20 nt, Artificial Sequence
  MKO10018313_A_Fgf16
  gRNA
cgagcgccugggccagaucg

SEQ ID NO: 18314 - RNA, 20 nt, Artificial Sequence
  MKO10018314_A_Fgf16
  gRNA
ccagagaucucuuccgcuau

SEQ ID NO: 18315 - RNA, 20 nt, Artificial Sequence
  MKO10018315_A_Fgf16
  gRNA
cacagguccauuaccuauag

SEQ ID NO: 18316 - RNA, 20 nt, Artificial Sequence
  MKO10018316_A_Fgf17
  gRNA
agugcgcuugguccugcgag

SEQ ID NO: 18317 - RNA, 20 nt, Artificial Sequence
  MKO10018317_A_Fgf17
  gRNA
cguguucaccgagaucguac

SEQ ID NO: 18318 - RNA, 20 nt, Artificial Sequence
  MKO10018318_A_Fgf17
  gRNA
cuaugaccgaccagcugagc

SEQ ID NO: 18319 - RNA, 20 nt, Artificial Sequence
  MKO10018319_A_Fgf18
  gRNA
gcggauccgccgggaucgcu

SEQ ID NO: 18320 - RNA, 20 nt, Artificial Sequence
  MKO10018320_A_Fgf18
  gRNA
uaggaucagugcccguggcg

SEQ ID NO: 18321 - RNA, 20 nt, Artificial Sequence
  MKO10018321_A_Fgf18
  gRNA
caucaucucgagcccgcguc

SEQ ID NO: 18322 - RNA, 20 nt, Artificial Sequence
  MKO10018322_A_Fgf1
  gRNA
ccuucgcagcccugaccgag

SEQ ID NO: 18323 - RNA, 20 nt, Artificial Sequence
  MKO10018323_A_Fgf1
  gRNA
cgcgguccucggacucacua

SEQ ID NO: 18324 - RNA, 20 nt, Artificial Sequence
  MKO10018324_A_Fgf1
  gRNA
ugcgggcgaaguguauauaa

SEQ ID NO: 18325 - RNA, 20 nt, Artificial Sequence
  MKO10018325_A_Fgf20
  gRNA
ugcacggcauccugcgccgc

SEQ ID NO: 18326 - RNA, 20 nt, Artificial Sequence
  MKO10018326_A_Fgf20
  gRNA
gcccaagaaagccccgacuu

SEQ ID NO: 18327 - RNA, 20 nt, Artificial Sequence
  MKO10018327_A_Fgf20
  gRNA
ucguccaacauauauaaaca

SEQ ID NO: 18328 - RNA, 20 nt, Artificial Sequence
  MKO10018328_A_Fgf21
  gRNA
gccggacuugacccccaaac

SEQ ID NO: 18329 - RNA, 20 nt, Artificial Sequence
  MKO10018329_A_Fgf21
  gRNA
guaaaggcucuaccaugcuc

SEQ ID NO: 18330 - RNA, 20 nt, Artificial Sequence
  MKO10018330_A_Fgf21
  gRNA
gaagagucaggacgcauagc

SEQ ID NO: 18331 - RNA, 20 nt, Artificial Sequence
  MKO10018331_A_Fgf22
  gRNA
aucuggagggcgacgugcgc

SEQ ID NO: 18332 - RNA, 20 nt, Artificial Sequence
  MKO10018332_A_Fgf22
  gRNA
uagguuccgggagcgcaucg

SEQ ID NO: 18333 - RNA, 20 nt, Artificial Sequence
  MKO10018333_A_Fgf22
  gRNA
cgcacgucgcccuccagaug

SEQ ID NO: 18334 - RNA, 20 nt, Artificial Sequence
  MKO10018334_A_Fgf23
  gRNA
acguucagugggucgcgcuc

SEQ ID NO: 18335 - RNA, 20 nt, Artificial Sequence
  MKO10018335_A_Fgf23
  gRNA
cacugaacgugcucaagccg

SEQ ID NO: 18336 - RNA, 20 nt, Artificial Sequence
  MKO10018336_A_Fgf23
  gRNA
cguccucugauguaaucauc

SEQ ID NO: 18337 - RNA, 20 nt, Artificial Sequence
  MKO10018337_A_Fgf2
  gRNA
acgccauccacgcggccguc

SEQ ID NO: 18338 - RNA, 20 nt, Artificial Sequence
  MKO10018338_A_Fgf2
  gRNA
cgugugggucgcucuucucg

SEQ ID NO: 18339 - RNA, 20 nt, Artificial Sequence
  MKO10018339_A_Fgf2
  gRNA
guguuucuucuuugaacgac

SEQ ID NO: 18340 - RNA, 20 nt, Artificial Sequence
  MKO10018340_A_Fgf3
  gRNA
gacgcgacuacgacgcgaug

SEQ ID NO: 18341 - RNA, 20 nt, Artificial Sequence
  MKO10018341_A_Fgf3
  gRNA
gguggcguuuacgagcaccu

SEQ ID NO: 18342 - RNA, 20 nt, Artificial Sequence
  MKO10018342_A_Fgf3
  gRNA
ccauucaccgacacguacca

SEQ ID NO: 18343 - RNA, 20 nt, Artificial Sequence
  MKO10018343_A_Fgf4
  gRNA
uacgaauccuacgcguaccc

SEQ ID NO: 18344 - RNA, 20 nt, Artificial Sequence
  MKO10018344_A_Fgf4
  gRNA
cggcggucccucgguccgcc

SEQ ID NO: 18345 - RNA, 20 nt, Artificial Sequence
  MKO10018345_A_Fgf4
  gRNA
uucugcgugccgcgugccgu

SEQ ID NO: 18346 - RNA, 20 nt, Artificial Sequence
  MKO10018346_A_Fgf5
  gRNA
agcccuucggggcgccggac

SEQ ID NO: 18347 - RNA, 20 nt, Artificial Sequence
  MKO10018347_A_Fgf5
  gRNA
gacuucugcgaggcugcgac

SEQ ID NO: 18348 - RNA, 20 nt, Artificial Sequence
  MKO10018348_A_Fgf5
  gRNA
acccgcgccuccuaggaacc

SEQ ID NO: 18349 - RNA, 20 nt, Artificial Sequence
  MKO10018349_A_Fgf6
  gRNA
ccgcgccaacggcacgcuac

SEQ ID NO: 18350 - RNA, 20 nt, Artificial Sequence
  MKO10018350_A_Fgf6
  gRNA
cucggaacuugcauucgucg

SEQ ID NO: 18351 - RNA, 20 nt, Artificial Sequence
  MKO10018351_A_Fgf6
  gRNA
ccaguagcgugccguuggcg

SEQ ID NO: 18352 - RNA, 20 nt, Artificial Sequence
  MKO10018352_A_Fgf7
  gRNA
acacucguagccguuugcuc

SEQ ID NO: 18353 - RNA, 20 nt, Artificial Sequence
  MKO10018353_A_Fgf7
  gRNA
acuacacuauaaugcgcaaa

SEQ ID NO: 18354 - RNA, 20 nt, Artificial Sequence
  MKO10018354_A_Fgf7
  gRNA
guucguugccuuaaaucaaa

SEQ ID NO: 18355 - RNA, 20 nt, Artificial Sequence
  MKO10018355_A_Fgf8
  gRNA
cugucucugcgccgcgaacu

SEQ ID NO: 18356 - RNA, 20 nt, Artificial Sequence
  MKO10018356_A_Fgf8
  gRNA
caacaagcgcaucaacgcca

SEQ ID NO: 18357 - RNA, 20 nt, Artificial Sequence
  MKO10018357_A_Fgf8
  gRNA
cguugaugcgcuuguuggcc

SEQ ID NO: 18358 - RNA, 20 nt, Artificial Sequence
  MKO10018358_A_Fgf9
  gRNA
gguaccguucgggaacguac

SEQ ID NO: 18359 - RNA, 20 nt, Artificial Sequence
  MKO10018359_A_Fgf9
  gRNA
aacaccgguacguucccgaa

SEQ ID NO: 18360 - RNA, 20 nt, Artificial Sequence
  MKO10018360_A_Fgf9
  gRNA
ccuggucagcauucgcggug

SEQ ID NO: 18361 - RNA, 20 nt, Artificial Sequence
  MKO10018361_A_Fgfbp1
  gRNA
cuucguguuuccacgugcgu

SEQ ID NO: 18362 - RNA, 20 nt, Artificial Sequence
  MKO10018362_A_Fgfbp1
  gRNA
acgacaaagaccagaucuac

SEQ ID NO: 18363 - RNA, 20 nt, Artificial Sequence
  MKO10018363_A_Fgfbp1
  gRNA
augucgccuguaacauguug

SEQ ID NO: 18364 - RNA, 20 nt, Artificial Sequence
  MKO10018364_A_Fgfbp3
  gRNA
accgacugucgcgaccgagc

SEQ ID NO: 18365 - RNA, 20 nt, Artificial Sequence
  MKO10018365_A_Fgfbp3
  gRNA
agucugcauugcgccuaccg

SEQ ID NO: 18366 - RNA, 20 nt, Artificial Sequence
  MKO10018366_A_Fgfbp3
  gRNA
gucuccaguagugcgcgcgc

SEQ ID NO: 18367 - RNA, 20 nt, Artificial Sequence
  MKO10018367_A_Fgfr1op2
  gRNA
guacaucguaacagcugcga

SEQ ID NO: 18368 - RNA, 20 nt, Artificial Sequence
  MKO10018368_A_Fgfr1op2
  gRNA
ggaugugccgagaugcaucc

SEQ ID NO: 18369 - RNA, 20 nt, Artificial Sequence
  MKO10018369_A_Fgfr1op2
  gRNA
gauagaacugcggacauccc

SEQ ID NO: 18370 - RNA, 20 nt, Artificial Sequence
  MKO10018370_A_Fgfr1op
  gRNA
uuccuuacugugcuaguuuc

SEQ ID NO: 18371 - RNA, 20 nt, Artificial Sequence
  MKO10018371_A_Fgfr1op
  gRNA
uucaaguucucauugaccaa

SEQ ID NO: 18372 - RNA, 20 nt, Artificial Sequence
  MKO10018372_A_Fgfr1op
  gRNA
uuaacagaacaaaacuccau

SEQ ID NO: 18373 - RNA, 20 nt, Artificial Sequence
  MKO10018373_A_Fgfr1
  gRNA
aaguucaagugcccgucgag

SEQ ID NO: 18374 - RNA, 20 nt, Artificial Sequence
  MKO10018374_A_Fgfr1
  gRNA
cgacgacgaugacuccuccu

SEQ ID NO: 18375 - RNA, 20 nt, Artificial Sequence
  MKO10018375_A_Fgfr1
  gRNA
cucacgccuacgguuugguu

SEQ ID NO: 18376 - RNA, 20 nt, Artificial Sequence
  MKO10018376_A_Fgfr2
  gRNA
accuaccaccucgaugucgu

SEQ ID NO: 18377 - RNA, 20 nt, Artificial Sequence
  MKO10018377_A_Fgfr2
  gRNA
agaugggauuaccguccacg

SEQ ID NO: 18378 - RNA, 20 nt, Artificial Sequence
  MKO10018378_A_Fgfr2
  gRNA
gauuccccccagccggacag

SEQ ID NO: 18379 - RNA, 20 nt, Artificial Sequence
  MKO10018379_A_Fgfr3
  gRNA
agugugguacccuccgaucg

SEQ ID NO: 18380 - RNA, 20 nt, Artificial Sequence
  MKO10018380_A_Fgfr3
  gRNA
cacuucagugugcguguaac

SEQ ID NO: 18381 - RNA, 20 nt, Artificial Sequence
  MKO10018381_A_Fgfr3
  gRNA
cuccgcacaacucgcugcuc

SEQ ID NO: 18382 - RNA, 20 nt, Artificial Sequence
  MKO10018382_A_Fgfr4
  gRNA
guaccagugacgaccacgcu

SEQ ID NO: 18383 - RNA, 20 nt, Artificial Sequence
  MKO10018383_A_Fgfr4
  gRNA
caacguaagauuguguacga

SEQ ID NO: 18384 - RNA, 20 nt, Artificial Sequence
  MKO10018384_A_Fgfr4
  gRNA
cauucgcuacagcuaucucc

SEQ ID NO: 18385 - RNA, 20 nt, Artificial Sequence
  MKO10018385_A_Fgfrl1
  gRNA
cacgugccguguaucuaaca

SEQ ID NO: 18386 - RNA, 20 nt, Artificial Sequence
  MKO10018386_A_Fgfrl1
  gRNA
gcggguggaguacggcuccg

SEQ ID NO: 18387 - RNA, 20 nt, Artificial Sequence
  MKO10018387_A_Fgfrl1
  gRNA
ccucgcgccgccucagccga

SEQ ID NO: 18388 - RNA, 20 nt, Artificial Sequence
  MKO10018388_A_Fggy
  gRNA
augcccacauaguagcgacu

SEQ ID NO: 18389 - RNA, 20 nt, Artificial Sequence
  MKO10018389_A_Fggy
  gRNA
ccacaugauaacguuucgag

SEQ ID NO: 18390 - RNA, 20 nt, Artificial Sequence
  MKO10018390_A_Fggy
  gRNA
uaguguccgugcggcucuag

SEQ ID NO: 18391 - RNA, 20 nt, Artificial Sequence
  MKO10018391_A_Fgg
  gRNA
gaucauuguccacgucgguu

SEQ ID NO: 18392 - RNA, 20 nt, Artificial Sequence
  MKO10018392_A_Fgg
  gRNA
gucuucuuaccaaaccgacg

SEQ ID NO: 18393 - RNA, 20 nt, Artificial Sequence
  MKO10018393_A_Fgg
  gRNA
cauaccgaaugcuugucucg

SEQ ID NO: 18394 - RNA, 20 nt, Artificial Sequence
  MKO10018394_A_Fgl1
  gRNA
guuugacccgggucucaagc

SEQ ID NO: 18395 - RNA, 20 nt, Artificial Sequence
  MKO10018395_A_Fgl1
  gRNA
gccaguauucgccauuguuu

SEQ ID NO: 18396 - RNA, 20 nt, Artificial Sequence
  MKO10018396_A_Fgl1
  gRNA
gcaagcaguucucacucucg

SEQ ID NO: 18397 - RNA, 20 nt, Artificial Sequence
  MKO10018397_A_Fgl2
  gRNA
uguuccgaccacuacgugcu

SEQ ID NO: 18398 - RNA, 20 nt, Artificial Sequence
  MKO10018398_A_Fgl2
  gRNA
gcugacgaccaucgagaucc

SEQ ID NO: 18399 - RNA, 20 nt, Artificial Sequence
  MKO10018399_A_Fgl2
  gRNA
aguggcaaaucuaaccguug

SEQ ID NO: 18400 - RNA, 20 nt, Artificial Sequence
  MKO10018400_A_Fgr
  gRNA
uccuggccucauagucguac

SEQ ID NO: 18401 - RNA, 20 nt, Artificial Sequence
  MKO10018401_A_Fgr
  gRNA
gcauuauaagauccgaaagc

SEQ ID NO: 18402 - RNA, 20 nt, Artificial Sequence
  MKO10018402_A_Fgr
  gRNA
cucgcuuucccgaaugagaa

SEQ ID NO: 18403 - RNA, 20 nt, Artificial Sequence
  MKO10018403_A_Fh1
  gRNA
aauugggcgaacucacacgc

SEQ ID NO: 18404 - RNA, 20 nt, Artificial Sequence
  MKO10018404_A_Fh1
  gRNA
cguguagaguucgacaccuu

SEQ ID NO: 18405 - RNA, 20 nt, Artificial Sequence
  MKO10018405_A_Fh1
  gRNA
aaaauccaaagaguuugcgc

SEQ ID NO: 18406 - RNA, 20 nt, Artificial Sequence
  MKO10018406_A_Fhad1
  gRNA
ugcagggaugaccuacgagc

SEQ ID NO: 18407 - RNA, 20 nt, Artificial Sequence
  MKO10018407_A_Fhad1
  gRNA
gaucagagcgucuuuauauu

SEQ ID NO: 18408 - RNA, 20 nt, Artificial Sequence
  MKO10018408_A_Fhad1
  gRNA
cgcucugaucaugaaccugc

SEQ ID NO: 18409 - RNA, 20 nt, Artificial Sequence
  MKO10018409_A_Fhdc1
  gRNA
cgauguauccaagcucucgc

SEQ ID NO: 18410 - RNA, 20 nt, Artificial Sequence
  MKO10018410_A_Fhdc1
  gRNA
gucuccucaguccaucguag

SEQ ID NO: 18411 - RNA, 20 nt, Artificial Sequence
  MKO10018411_A_Fhdc1
  gRNA
uugauagauauccucuacga

SEQ ID NO: 18412 - RNA, 20 nt, Artificial Sequence
  MKO10018412_A_Fhit
  gRNA
aggucacggaagcgcucuac

SEQ ID NO: 18413 - RNA, 20 nt, Artificial Sequence
  MKO10018413_A_Fhit
  gRNA
aacaaaucggccacuucauc

SEQ ID NO: 18414 - RNA, 20 nt, Artificial Sequence
  MKO10018414_A_Fhit
  gRNA
caucauagauguugucauuc

SEQ ID NO: 18415 - RNA, 20 nt, Artificial Sequence
  MKO10018415_A_Fhl1
  gRNA
guucugcgccaacaccugcg

SEQ ID NO: 18416 - RNA, 20 nt, Artificial Sequence
  MKO10018416_A_Fhl1
  gRNA
guugcacuucacgcaauguu

SEQ ID NO: 18417 - RNA, 20 nt, Artificial Sequence
  MKO10018417_A_Fhl1
  gRNA
acagucgaacuucuccgaca

SEQ ID NO: 18418 - RNA, 20 nt, Artificial Sequence
  MKO10018418_A_Fhl2
  gRNA
gaccacagguacccgcaaga

SEQ ID NO: 18419 - RNA, 20 nt, Artificial Sequence
  MKO10018419_A_Fhl2
  gRNA
gcagugcgugcagugcaaaa

SEQ ID NO: 18420 - RNA, 20 nt, Artificial Sequence
  MKO10018420_A_Fhl2
  gRNA
ugaauacucguccaagugcc

SEQ ID NO: 18421 - RNA, 20 nt, Artificial Sequence
  MKO10018421_A_Fhl3
  gRNA
cccgaaggaacuguucuaug

SEQ ID NO: 18422 - RNA, 20 nt, Artificial Sequence
  MKO10018422_A_Fhl3
  gRNA
gcucaucggcaagggagcgc

SEQ ID NO: 18423 - RNA, 20 nt, Artificial Sequence
  MKO10018423_A_Fhl3
  gRNA
cauagaacuugaucuccguc

SEQ ID NO: 18424 - RNA, 20 nt, Artificial Sequence
  MKO10018424_A_Fhl4
  gRNA
aaucugcaccuaugggcuug

SEQ ID NO: 18425 - RNA, 20 nt, Artificial Sequence
  MKO10018425_A_Fhl4
  gRNA
uguguuauaaggagcaauuc

SEQ ID NO: 18426 - RNA, 20 nt, Artificial Sequence
  MKO10018426_A_Fhl4
  gRNA
gcccauaggugcagauucca

SEQ ID NO: 18427 - RNA, 20 nt, Artificial Sequence
  MKO10018427_A_Fhl5
  gRNA
ggguucagguucucggaaaa

SEQ ID NO: 18428 - RNA, 20 nt, Artificial Sequence
  MKO10018428_A_Fhl5
  gRNA
uuugcuacaaaaaccgucac

SEQ ID NO: 18429 - RNA, 20 nt, Artificial Sequence
  MKO10018429_A_Fhl5
  gRNA
uuaugccgcaaguguggcuc

SEQ ID NO: 18430 - RNA, 20 nt, Artificial Sequence
  MKO10018430_A_Fhod1
  gRNA
acccuccgagugcacgaauu

SEQ ID NO: 18431 - RNA, 20 nt, Artificial Sequence
  MKO10018431_A_Fhod1
  gRNA
ucugaguugccugauccgcg

SEQ ID NO: 18432 - RNA, 20 nt, Artificial Sequence
  MKO10018432_A_Fhod1
  gRNA
ggaagcccacguuaauccug

SEQ ID NO: 18433 - RNA, 20 nt, Artificial Sequence
  MKO10018433_A_Fhod3
  gRNA
gauccagguaggcgccauug

SEQ ID NO: 18434 - RNA, 20 nt, Artificial Sequence
  MKO10018434_A_Fhod3
  gRNA
aucccgcuguuccgccagcg

SEQ ID NO: 18435 - RNA, 20 nt, Artificial Sequence
  MKO10018435_A_Fhod3
  gRNA
cugauaguucugauccgccu

SEQ ID NO: 18436 - RNA, 20 nt, Artificial Sequence
  MKO10018436_A_Fibcd1
  gRNA
cucacucagugcccgaagga

SEQ ID NO: 18437 - RNA, 20 nt, Artificial Sequence
  MKO10018437_A_Fibcd1
  gRNA
uugucacaggcucucggccg

SEQ ID NO: 18438 - RNA, 20 nt, Artificial Sequence
  MKO10018438_A_Fibcd1
  gRNA
ggcaguccccgugcugacga

SEQ ID NO: 18439 - RNA, 20 nt, Artificial Sequence
  MKO10018439_A_Fibin
  gRNA
ucgacugaaaagcgacuauc

SEQ ID NO: 18440 - RNA, 20 nt, Artificial Sequence
  MKO10018440_A_Fibin
  gRNA
uggaguaggcauccccgauc

SEQ ID NO: 18441 - RNA, 20 nt, Artificial Sequence
  MKO10018441_A_Fibin
  gRNA
ggaggaugcuggacgcgucc

SEQ ID NO: 18442 - RNA, 20 nt, Artificial Sequence
  MKO10018442_A_Fibp
  gRNA
gcgaguacgcuccggaaucu

SEQ ID NO: 18443 - RNA, 20 nt, Artificial Sequence
  MKO10018443_A_Fibp
  gRNA
uuacucucaagagcugccgg

SEQ ID NO: 18444 - RNA, 20 nt, Artificial Sequence
  MKO10018444_A_Fibp
  gRNA
gccaacaaccgcuuugaaac

SEQ ID NO: 18445 - RNA, 20 nt, Artificial Sequence
  MKO10018445_A_Ficd
  gRNA
cucccguugccgucgaugaa

SEQ ID NO: 18446 - RNA, 20 nt, Artificial Sequence
  MKO10018446_A_Ficd
  gRNA
aucccgccugcaucaaaauc

SEQ ID NO: 18447 - RNA, 20 nt, Artificial Sequence
  MKO10018447_A_Ficd
  gRNA
gccccagacggagacccauu

SEQ ID NO: 18448 - RNA, 20 nt, Artificial Sequence
  MKO10018448_A_Fig4
  gRNA
cgguacauaccuagcuucgu

SEQ ID NO: 18449 - RNA, 20 nt, Artificial Sequence
  MKO10018449_A_Fig4
  gRNA
acuuggugguaaucgacgac

SEQ ID NO: 18450 - RNA, 20 nt, Artificial Sequence
  MKO10018450_A_Fig4
  gRNA
uuucucaccccgacgaagcu

SEQ ID NO: 18451 - RNA, 20 nt, Artificial Sequence
  MKO10018451_A_Figf
  gRNA
gauccgagcagcuucuaguu

SEQ ID NO: 18452 - RNA, 20 nt, Artificial Sequence
  MKO10018452_A_Figf
  gRNA
gcaagcacuuacaacccgua

SEQ ID NO: 18453 - RNA, 20 nt, Artificial Sequence
  MKO10018453_A_Figf
  gRNA
gcugcaaaucgcgcacucug

SEQ ID NO: 18454 - RNA, 20 nt, Artificial Sequence
  MKO10018454_A_Figla
  gRNA
cgugguggaguagccgccug

SEQ ID NO: 18455 - RNA, 20 nt, Artificial Sequence
  MKO10018455_A_Figla
  gRNA
ccaacgccaaagagcgugaa

SEQ ID NO: 18456 - RNA, 20 nt, Artificial Sequence
  MKO10018456_A_Figla
  gRNA
cuauggccagcauacgccca

SEQ ID NO: 18457 - RNA, 20 nt, Artificial Sequence
  MKO10018457_A_Fignl1
  gRNA
gcaauaucgucccaauguac

SEQ ID NO: 18458 - RNA, 20 nt, Artificial Sequence
  MKO10018458_A_Fignl1
  gRNA
gcagcgugcaaacugcgaau

SEQ ID NO: 18459 - RNA, 20 nt, Artificial Sequence
  MKO10018459_A_Fignl1
  gRNA
uagcucccaccacaagaauc

SEQ ID NO: 18460 - RNA, 20 nt, Artificial Sequence
  MKO10018460_A_Fignl2
  gRNA
gacgcgccgucgucccucgc

SEQ ID NO: 18461 - RNA, 20 nt, Artificial Sequence
  MKO10018461_A_Fignl2
  gRNA
cucgagcugcggcgcguagg

SEQ ID NO: 18462 - RNA, 20 nt, Artificial Sequence
  MKO10018462_A_Fignl2
  gRNA
guaguuguagagcggcgccg

SEQ ID NO: 18463 - RNA, 20 nt, Artificial Sequence
  MKO10018463_A_Fign
  gRNA
auacuugccgagacgucuac

SEQ ID NO: 18464 - RNA, 20 nt, Artificial Sequence
  MKO10018464_A_Fign
  gRNA
ccguccccguugcauaguuc

SEQ ID NO: 18465 - RNA, 20 nt, Artificial Sequence
  MKO10018465_A_Fign
  gRNA
aacugacauaccauaaacac

SEQ ID NO: 18466 - RNA, 20 nt, Artificial Sequence
  MKO10018466_A_Filip1l
  gRNA
ccaggaugacgacccuaaug

SEQ ID NO: 18467 - RNA, 20 nt, Artificial Sequence
  MKO10018467_A_Filip1l
  gRNA
acggacaaugucaccuauuc

SEQ ID NO: 18468 - RNA, 20 nt, Artificial Sequence
  MKO10018468_A_Filip1l
  gRNA
gcggugcuuaccucauucau

SEQ ID NO: 18469 - RNA, 20 nt, Artificial Sequence
  MKO10018469_A_Filip1
  gRNA
cgaggacgaauacgaccagu

SEQ ID NO: 18470 - RNA, 20 nt, Artificial Sequence
  MKO10018470_A_Filip1
  gRNA
ggagacauaccgccgcaugc

SEQ ID NO: 18471 - RNA, 20 nt, Artificial Sequence
  MKO10018471_A_Filip1
  gRNA
aucgcaaaggaucgaggaac

SEQ ID NO: 18472 - RNA, 20 nt, Artificial Sequence
  MKO10018472_A_Fip1l1
  gRNA
cuccaccucgccggccgaca

SEQ ID NO: 18473 - RNA, 20 nt, Artificial Sequence
  MKO10018473_A_Fip1l1
  gRNA
ggcggccaugucggccggcg

SEQ ID NO: 18474 - RNA, 20 nt, Artificial Sequence
  MKO10018474_A_Fip1l1
  gRNA
ugcagugcuaauccuccauc

SEQ ID NO: 18475 - RNA, 20 nt, Artificial Sequence
  MKO10018475_A_Fis1
  gRNA
cgugggcaacuaccggcuca

SEQ ID NO: 18476 - RNA, 20 nt, Artificial Sequence
  MKO10018476_A_Fis1
  gRNA
cuugagccgguaguugccca

SEQ ID NO: 18477 - RNA, 20 nt, Artificial Sequence
  MKO10018477_A_Fis1
  gRNA
gcuggaacgccugauugaua

SEQ ID NO: 18478 - RNA, 20 nt, Artificial Sequence
  MKO10018478_A_Fitm1
  gRNA
uacggcgccucuaccaugcu

SEQ ID NO: 18479 - RNA, 20 nt, Artificial Sequence
  MKO10018479_A_Fitm1
  gRNA
cugcuacacgucguguagcc

SEQ ID NO: 18480 - RNA, 20 nt, Artificial Sequence
  MKO10018480_A_Fitm1
  gRNA
cggcaguaggcacguuugcc

SEQ ID NO: 18481 - RNA, 20 nt, Artificial Sequence
  MKO10018481_A_Fitm2
  gRNA
cgcugcgcgugguuucuccg

SEQ ID NO: 18482 - RNA, 20 nt, Artificial Sequence
  MKO10018482_A_Fitm2
  gRNA
ggagggugcucaaccgccgc

SEQ ID NO: 18483 - RNA, 20 nt, Artificial Sequence
  MKO10018483_A_Fitm2
  gRNA
cgguugagcacccuccucgu

SEQ ID NO: 18484 - RNA, 20 nt, Artificial Sequence
  MKO10018484_A_Fiz1
  gRNA
agugcuaccucaagcgucac

SEQ ID NO: 18485 - RNA, 20 nt, Artificial Sequence
  MKO10018485_A_Fiz1
  gRNA
cccgaggcccaaaccugcgu

SEQ ID NO: 18486 - RNA, 20 nt, Artificial Sequence
  MKO10018486_A_Fiz1
  gRNA
uccguuaccgaucagaccug

SEQ ID NO: 18487 - RNA, 20 nt, Artificial Sequence
  MKO10018487_A_Fjx1
  gRNA
ggugcagguugcucguagcg

SEQ ID NO: 18488 - RNA, 20 nt, Artificial Sequence
  MKO10018488_A_Fjx1
  gRNA
cgccgcgggcgucccauacu

SEQ ID NO: 18489 - RNA, 20 nt, Artificial Sequence
  MKO10018489_A_Fjx1
  gRNA
cgcgccuagcaguccgcucu

SEQ ID NO: 18490 - RNA, 20 nt, Artificial Sequence
  MKO10018490_A_Fkbp10
  gRNA
gcggccuacgcccacaacga

SEQ ID NO: 18491 - RNA, 20 nt, Artificial Sequence
  MKO10018491_A_Fkbp10
  gRNA
caccgaugcugccguagccc

SEQ ID NO: 18492 - RNA, 20 nt, Artificial Sequence
  MKO10018492_A_Fkbp10
  gRNA
agggacugugauacccccgc

SEQ ID NO: 18493 - RNA, 20 nt, Artificial Sequence
  MKO10018493_A_Fkbp11
  gRNA
gcagcccccugaaucgugca

SEQ ID NO: 18494 - RNA, 20 nt, Artificial Sequence
  MKO10018494_A_Fkbp11
  gRNA
gcagauuccgugcacgauuc

SEQ ID NO: 18495 - RNA, 20 nt, Artificial Sequence
  MKO10018495_A_Fkbp11
  gRNA
ggguacccgccaucuauccc

SEQ ID NO: 18496 - RNA, 20 nt, Artificial Sequence
  MKO10018496_A_Fkbp14
  gRNA
ccauuucuugaaacgacucg

SEQ ID NO: 18497 - RNA, 20 nt, Artificial Sequence
  MKO10018497_A_Fkbp14
  gRNA
auaugugcacgacgaacugu

SEQ ID NO: 18498 - RNA, 20 nt, Artificial Sequence
  MKO10018498_A_Fkbp14
  gRNA
ccacgagucguuucaagaaa

SEQ ID NO: 18499 - RNA, 20 nt, Artificial Sequence
  MKO10018499_A_Fkbp15
  gRNA
gaucaagcaacuaugggcca

SEQ ID NO: 18500 - RNA, 20 nt, Artificial Sequence
  MKO10018500_A_Fkbp15
  gRNA
caaauuuggagcggcugucc

SEQ ID NO: 18501 - RNA, 20 nt, Artificial Sequence
  MKO10018501_A_Fkbp15
  gRNA
ugaauuguagcaacagucac

SEQ ID NO: 18502 - RNA, 20 nt, Artificial Sequence
  MKO10018502_A_Fkbp1a
  gRNA
acccguguagugcaccacgc

SEQ ID NO: 18503 - RNA, 20 nt, Artificial Sequence
  MKO10018503_A_Fkbp1a
  gRNA
gggcgcaccuucccaaagcg

SEQ ID NO: 18504 - RNA, 20 nt, Artificial Sequence
  MKO10018504_A_Fkbp1a
  gRNA
cuuacagggaugcuugaaga

SEQ ID NO: 18505 - RNA, 20 nt, Artificial Sequence
  MKO10018505_A_Fkbp1b
  gRNA
ccgcccgguaccgucuccug

SEQ ID NO: 18506 - RNA, 20 nt, Artificial Sequence
  MKO10018506_A_Fkbp1b
  gRNA
gcugaccugcaccccugaug

SEQ ID NO: 18507 - RNA, 20 nt, Artificial Sequence
  MKO10018507_A_Fkbp1b
  gRNA
aucccugcuagaugagcuug

SEQ ID NO: 18508 - RNA, 20 nt, Artificial Sequence
  MKO10018508_A_Fkbp2
  gRNA
guuggugaucccauccgagc

SEQ ID NO: 18509 - RNA, 20 nt, Artificial Sequence
  MKO10018509_A_Fkbp2
  gRNA
ggccucuuacccagcucgga

SEQ ID NO: 18510 - RNA, 20 nt, Artificial Sequence
  MKO10018510_A_Fkbp2
  gRNA
cuggccagguuaucaagggc

SEQ ID NO: 18511 - RNA, 20 nt, Artificial Sequence
  MKO10018511_A_Fkbp3
  gRNA
acuccgaccuuaaaacuuaa

SEQ ID NO: 18512 - RNA, 20 nt, Artificial Sequence
  MKO10018512_A_Fkbp3
  gRNA
ggaguaggcaagguuaucag

SEQ ID NO: 18513 - RNA, 20 nt, Artificial Sequence
  MKO10018513_A_Fkbp3
  gRNA
uguugccaagacugcuaaua

SEQ ID NO: 18514 - RNA, 20 nt, Artificial Sequence
  MKO10018514_A_Fkbp4
  gRNA
caccccgaguccguauucug

SEQ ID NO: 18515 - RNA, 20 nt, Artificial Sequence
  MKO10018515_A_Fkbp4
  gRNA
cguugggggggaucuucgga

SEQ ID NO: 18516 - RNA, 20 nt, Artificial Sequence
  MKO10018516_A_Fkbp4
  gRNA
ucauccgcagaauacggacu

SEQ ID NO: 18517 - RNA, 20 nt, Artificial Sequence
  MKO10018517_A_Fkbp5
  gRNA
cgaucccaaucggaaugucg

SEQ ID NO: 18518 - RNA, 20 nt, Artificial Sequence
  MKO10018518_A_Fkbp5
  gRNA
agugacgaggccccaauguu

SEQ ID NO: 18519 - RNA, 20 nt, Artificial Sequence
  MKO10018519_A_Fkbp5
  gRNA
gaagaccacgacauuccgau

SEQ ID NO: 18520 - RNA, 20 nt, Artificial Sequence
  MKO10018520_A_Fkbp6
  gRNA
gcguugacuuagucgcucau

SEQ ID NO: 18521 - RNA, 20 nt, Artificial Sequence
  MKO10018521_A_Fkbp6
  gRNA
ccccagggugccguaagcau

SEQ ID NO: 18522 - RNA, 20 nt, Artificial Sequence
  MKO10018522_A_Fkbp6
  gRNA
gcgacuaagucaacgcaugu

SEQ ID NO: 18523 - RNA, 20 nt, Artificial Sequence
  MKO10018523_A_Fkbp7
  gRNA
aaaugaagccgucuccauug

SEQ ID NO: 18524 - RNA, 20 nt, Artificial Sequence
  MKO10018524_A_Fkbp7
  gRNA
cauagccggacacaagauga

SEQ ID NO: 18525 - RNA, 20 nt, Artificial Sequence
  MKO10018525_A_Fkbp7
  gRNA
uagccaaguagccaucguaa

SEQ ID NO: 18526 - RNA, 20 nt, Artificial Sequence
  MKO10018526_A_Fkbp8
  gRNA
aucgcagucucccagcguga

SEQ ID NO: 18527 - RNA, 20 nt, Artificial Sequence
  MKO10018527_A_Fkbp8
  gRNA
auuggcggccagcacaaagu

SEQ ID NO: 18528 - RNA, 20 nt, Artificial Sequence
  MKO10018528_A_Fkbp8
  gRNA
ccagcgugccgacuuugugc

SEQ ID NO: 18529 - RNA, 20 nt, Artificial Sequence
  MKO10018529_A_Fkbp9
  gRNA
gaaaaccuaugacacguacg

SEQ ID NO: 18530 - RNA, 20 nt, Artificial Sequence
  MKO10018530_A_Fkbp9
  gRNA
aauccccacguacgugucau

SEQ ID NO: 18531 - RNA, 20 nt, Artificial Sequence
  MKO10018531_A_Fkbp9
  gRNA
ccaagaacguuccguuguag

SEQ ID NO: 18532 - RNA, 20 nt, Artificial Sequence
  MKO10018532_A_Fkbpl
  gRNA
gguacagaacuguuucgagc

SEQ ID NO: 18533 - RNA, 20 nt, Artificial Sequence
  MKO10018533_A_Fkbpl
  gRNA
caccuugacgcauagacucc

SEQ ID NO: 18534 - RNA, 20 nt, Artificial Sequence
  MKO10018534_A_Fkbpl
  gRNA
caaggggcugcccgaugcua

SEQ ID NO: 18535 - RNA, 20 nt, Artificial Sequence
  MKO10018535_A_Fkrp
  gRNA
cgccauccaaagcgucgcag

SEQ ID NO: 18536 - RNA, 20 nt, Artificial Sequence
  MKO10018536_A_Fkrp
  gRNA
ucgcauccccaacguucgcc

SEQ ID NO: 18537 - RNA, 20 nt, Artificial Sequence
  MKO10018537_A_Fkrp
  gRNA
gagcgcgcgcugcuucggua

SEQ ID NO: 18538 - RNA, 20 nt, Artificial Sequence
  MKO10018538_A_Fktn
  gRNA
agcuuacagacguagugcag

SEQ ID NO: 18539 - RNA, 20 nt, Artificial Sequence
  MKO10018539_A_Fktn
  gRNA
acuccagauuuaucgagugc

SEQ ID NO: 18540 - RNA, 20 nt, Artificial Sequence
  MKO10018540_A_Fktn
  gRNA
ggaagcucgggcguuccucc

SEQ ID NO: 18541 - RNA, 20 nt, Artificial Sequence
  MKO10018541_A_Flad1
  gRNA
guuguauguggccgcgucag

SEQ ID NO: 18542 - RNA, 20 nt, Artificial Sequence
  MKO10018542_A_Flad1
  gRNA
gaggaucuguaccguaaugc

SEQ ID NO: 18543 - RNA, 20 nt, Artificial Sequence
  MKO10018543_A_Flad1
  gRNA
caguccgucgagugcccauc

SEQ ID NO: 18544 - RNA, 20 nt, Artificial Sequence
  MKO10018544_A_Flcn
  gRNA
ggcugccggucacuugccgu

SEQ ID NO: 18545 - RNA, 20 nt, Artificial Sequence
  MKO10018545_A_Flcn
  gRNA
gugacugacguacuuaauag

SEQ ID NO: 18546 - RNA, 20 nt, Artificial Sequence
  MKO10018546_A_Flcn
  gRNA
aagguaugcccuggucguga

SEQ ID NO: 18547 - RNA, 20 nt, Artificial Sequence
  MKO10018547_A_Flg2
  gRNA
ugaucagcgugcaucugguu

SEQ ID NO: 18548 - RNA, 20 nt, Artificial Sequence
  MKO10018548_A_Flg2
  gRNA
ccauauccagaauaucuccg

SEQ ID NO: 18549 - RNA, 20 nt, Artificial Sequence
  MKO10018549_A_Flg2
  gRNA
acugagcaaggaugagcuaa

SEQ ID NO: 18550 - RNA, 20 nt, Artificial Sequence
  MKO10018550_A_Fli1
  gRNA
gcuucggggaguccugacua

SEQ ID NO: 18551 - RNA, 20 nt, Artificial Sequence
  MKO10018551_A_Fli1
  gRNA
cacaaugacucuccguucgu

SEQ ID NO: 18552 - RNA, 20 nt, Artificial Sequence
  MKO10018552_A_Fli1
  gRNA
cgcuugacauugacucucac

SEQ ID NO: 18553 - RNA, 20 nt, Artificial Sequence
  MKO10018553_A_Flii
  gRNA
cgaacacucacccgaagcga

SEQ ID NO: 18554 - RNA, 20 nt, Artificial Sequence
  MKO10018554_A_Flii
  gRNA
uggcuaaagcugaaucgcac

SEQ ID NO: 18555 - RNA, 20 nt, Artificial Sequence
  MKO10018555_A_Flii
  gRNA
cccaguacccguuguggcug

SEQ ID NO: 18556 - RNA, 20 nt, Artificial Sequence
  MKO10018556_A_Flna
  gRNA
cugccagucucgacugaagu

SEQ ID NO: 18557 - RNA, 20 nt, Artificial Sequence
  MKO10018557_A_Flna
  gRNA
uuaccaacuucagucgagac

SEQ ID NO: 18558 - RNA, 20 nt, Artificial Sequence
  MKO10018558_A_Flna
  gRNA
cugacaggcaucgagccuac

SEQ ID NO: 18559 - RNA, 20 nt, Artificial Sequence
  MKO10018559_A_Flnb
  gRNA
ugacuggcugggcgucccac

SEQ ID NO: 18560 - RNA, 20 nt, Artificial Sequence
  MKO10018560_A_Flnb
  gRNA
augacaggaaucgaaccuac

SEQ ID NO: 18561 - RNA, 20 nt, Artificial Sequence
  MKO10018561_A_Flnb
  gRNA
acagagugcucguccacguc

SEQ ID NO: 18562 - RNA, 20 nt, Artificial Sequence
  MKO10018562_A_Flnc
  gRNA
ucaccaacuuuaaccgagac

SEQ ID NO: 18563 - RNA, 20 nt, Artificial Sequence
  MKO10018563_A_Flnc
  gRNA
ggaggugcuggucuacauug

SEQ ID NO: 18564 - RNA, 20 nt, Artificial Sequence
  MKO10018564_A_Flnc
  gRNA
acacccaagcagcgacugcu

SEQ ID NO: 18565 - RNA, 20 nt, Artificial Sequence
  MKO10018565_A_Flot1
  gRNA
acggccgcaggugaaaaucc

SEQ ID NO: 18566 - RNA, 20 nt, Artificial Sequence
  MKO10018566_A_Flot1
  gRNA
uaggacaaacacucggccuc

SEQ ID NO: 18567 - RNA, 20 nt, Artificial Sequence
  MKO10018567_A_Flot1
  gRNA
cgcugauacccauguugacc

SEQ ID NO: 18568 - RNA, 20 nt, Artificial Sequence
  MKO10018568_A_Flot2
  gRNA
gaaguggcggcccccgaugu

SEQ ID NO: 18569 - RNA, 20 nt, Artificial Sequence
  MKO10018569_A_Flot2
  gRNA
uguccuguacguucuugccc

SEQ ID NO: 18570 - RNA, 20 nt, Artificial Sequence
  MKO10018570_A_Flot2
  gRNA
gaugcccaugcggccaacau

SEQ ID NO: 18571 - RNA, 20 nt, Artificial Sequence
  MKO10018571_A_Flrt1
  gRNA
ucacggagcugucgcuagua

SEQ ID NO: 18572 - RNA, 20 nt, Artificial Sequence
  MKO10018572_A_Flrt1
  gRNA
cgcuucccgguagccucgug

SEQ ID NO: 18573 - RNA, 20 nt, Artificial Sequence
  MKO10018573_A_Flrt1
  gRNA
cauccagaaccaggcgccgc

SEQ ID NO: 18574 - RNA, 20 nt, Artificial Sequence
  MKO10018574_A_Flrt2
  gRNA
uagaguacgguuacgcccuc

SEQ ID NO: 18575 - RNA, 20 nt, Artificial Sequence
  MKO10018575_A_Flrt2
  gRNA
ugucugauaugacggcaauu

SEQ ID NO: 18576 - RNA, 20 nt, Artificial Sequence
  MKO10018576_A_Flrt2
  gRNA
gaagauucccauccacgauc

SEQ ID NO: 18577 - RNA, 20 nt, Artificial Sequence
  MKO10018577_A_Flrt3
  gRNA
acuuucgaaaauuccguauc

SEQ ID NO: 18578 - RNA, 20 nt, Artificial Sequence
  MKO10018578_A_Flrt3
  gRNA
cauugcuuaucgguagcauc

SEQ ID NO: 18579 - RNA, 20 nt, Artificial Sequence
  MKO10018579_A_Flrt3
  gRNA
cguaauuccucaauaguccu

SEQ ID NO: 18580 - RNA, 20 nt, Artificial Sequence
  MKO10018580_A_Flt1
  gRNA
ucugcccacgaccgugagcc

SEQ ID NO: 18581 - RNA, 20 nt, Artificial Sequence
  MKO10018581_A_Flt1
  gRNA
cacggcgcaggccaaccaca

SEQ ID NO: 18582 - RNA, 20 nt, Artificial Sequence
  MKO10018582_A_Flt1
  gRNA
ccaacacuuacucugccgau

SEQ ID NO: 18583 - RNA, 20 nt, Artificial Sequence
  MKO10018583_A_Flt3l
  gRNA
cuggcaggccuucccgauac

SEQ ID NO: 18584 - RNA, 20 nt, Artificial Sequence
  MKO10018584_A_Flt3l
  gRNA
acucacguccugaagauuga

SEQ ID NO: 18585 - RNA, 20 nt, Artificial Sequence
  MKO10018585_A_Flt3l
  gRNA
ucaguugcucuauccagcgc

SEQ ID NO: 18586 - RNA, 20 nt, Artificial Sequence
  MKO10018586_A_Flt3
  gRNA
uuuaccauucgguacgauga

SEQ ID NO: 18587 - RNA, 20 nt, Artificial Sequence
  MKO10018587_A_Flt3
  gRNA
cauauaccgucccuucacuc

SEQ ID NO: 18588 - RNA, 20 nt, Artificial Sequence
  MKO10018588_A_Flt3
  gRNA
aaagccaucaucguaccgaa

SEQ ID NO: 18589 - RNA, 20 nt, Artificial Sequence
  MKO10018589_A_Flt4
  gRNA
gcaucgcgcaacaguugagu

SEQ ID NO: 18590 - RNA, 20 nt, Artificial Sequence
  MKO10018590_A_Flt4
  gRNA
ccguguuguuggcgugaguc

SEQ ID NO: 18591 - RNA, 20 nt, Artificial Sequence
  MKO10018591_A_Flt4
  gRNA
cucuucgucgugcacaucac

SEQ ID NO: 18592 - RNA, 20 nt, Artificial Sequence
  MKO10018592_A_Flywch1
  gRNA
ugcgcaucacugucacacgc

SEQ ID NO: 18593 - RNA, 20 nt, Artificial Sequence
  MKO10018593_A_Flywch1
  gRNA
agcgggugauggucaugcgc

SEQ ID NO: 18594 - RNA, 20 nt, Artificial Sequence
  MKO10018594_A_Flywch1
  gRNA
ugcgcaugaccaucacccgc

SEQ ID NO: 18595 - RNA, 20 nt, Artificial Sequence
  MKO10018595_A_Flywch2
  gRNA
ggccauugaagcgacucccc

SEQ ID NO: 18596 - RNA, 20 nt, Artificial Sequence
  MKO10018596_A_Flywch2
  gRNA
cuccaggggagucgcuucaa

SEQ ID NO: 18597 - RNA, 20 nt, Artificial Sequence
  MKO10018597_A_Flywch2
  gRNA
ccaagguuauggggaagugc

SEQ ID NO: 18598 - RNA, 20 nt, Artificial Sequence
  MKO10018598_A_Fmn1
  gRNA
uuacuaaugcgugcucaccc

SEQ ID NO: 18599 - RNA, 20 nt, Artificial Sequence
  MKO10018599_A_Fmn1
  gRNA
uggcugguuuacgaggauac

SEQ ID NO: 18600 - RNA, 20 nt, Artificial Sequence
  MKO10018600_A_Fmn1
  gRNA
aaagaccuucccaauaagga

SEQ ID NO: 18601 - RNA, 20 nt, Artificial Sequence
  MKO10018601_A_Fmn2
  gRNA
uagucaacccacacauucga

SEQ ID NO: 18602 - RNA, 20 nt, Artificial Sequence
  MKO10018602_A_Fmn2
  gRNA
gaaccguguaaucagaacgc

SEQ ID NO: 18603 - RNA, 20 nt, Artificial Sequence
  MKO10018603_A_Fmn2
  gRNA
gcuguaauccaucgaaugug

SEQ ID NO: 18604 - RNA, 20 nt, Artificial Sequence
  MKO10018604_A_Fmnl1
  gRNA
uggcugcuucgggggcgacg

SEQ ID NO: 18605 - RNA, 20 nt, Artificial Sequence
  MKO10018605_A_Fmnl1
  gRNA
uuaguuuaagaggcgaguuc

SEQ ID NO: 18606 - RNA, 20 nt, Artificial Sequence
  MKO10018606_A_Fmnl1
  gRNA
gcugccagccgcguugccca

SEQ ID NO: 18607 - RNA, 20 nt, Artificial Sequence
  MKO10018607_A_Fmnl2
  gRNA
gcauacuuacccaauguggu

SEQ ID NO: 18608 - RNA, 20 nt, Artificial Sequence
  MKO10018608_A_Fmnl2
  gRNA
uuuccugcaggagcgauucc

SEQ ID NO: 18609 - RNA, 20 nt, Artificial Sequence
  MKO10018609_A_Fmnl2
  gRNA
gucauacugccgcaguagcc

SEQ ID NO: 18610 - RNA, 20 nt, Artificial Sequence
  MKO10018610_A_Fmnl3
  gRNA
gguaauccaccagcacgucc

SEQ ID NO: 18611 - RNA, 20 nt, Artificial Sequence
  MKO10018611_A_Fmnl3
  gRNA
aggaguccacuaaaguccua

SEQ ID NO: 18612 - RNA, 20 nt, Artificial Sequence
  MKO10018612_A_Fmnl3
  gRNA
ccugacuuacccaaugugau

SEQ ID NO: 18613 - RNA, 20 nt, Artificial Sequence
  MKO10018613_A_Fmo1
  gRNA
uucuggcacagauauugccg

SEQ ID NO: 18614 - RNA, 20 nt, Artificial Sequence
  MKO10018614_A_Fmo1
  gRNA
gugcaguauaacaaaacgcc

SEQ ID NO: 18615 - RNA, 20 nt, Artificial Sequence
  MKO10018615_A_Fmo1
  gRNA
aucagccgagucuuugauuc

SEQ ID NO: 18616 - RNA, 20 nt, Artificial Sequence
  MKO10018616_A_Fmo2
  gRNA
ucauccacuugacgaccgug

SEQ ID NO: 18617 - RNA, 20 nt, Artificial Sequence
  MKO10018617_A_Fmo2
  gRNA
ccgcgaauacaagcacccag

SEQ ID NO: 18618 - RNA, 20 nt, Artificial Sequence
  MKO10018618_A_Fmo2
  gRNA
auucgcggcuauggaaauac

SEQ ID NO: 18619 - RNA, 20 nt, Artificial Sequence
  MKO10018619_A_Fmo3
  gRNA
cuugggugaugagucgaguc

SEQ ID NO: 18620 - RNA, 20 nt, Artificial Sequence
  MKO10018620_A_Fmo3
  gRNA
agauucaagcacgaaaacua

SEQ ID NO: 18621 - RNA, 20 nt, Artificial Sequence
  MKO10018621_A_Fmo3
  gRNA
cauuuauuuauacugguuac

SEQ ID NO: 18622 - RNA, 20 nt, Artificial Sequence
  MKO10018622_A_Fmo4
  gRNA
gcugagauauauucgguuua

SEQ ID NO: 18623 - RNA, 20 nt, Artificial Sequence
  MKO10018623_A_Fmo4
  gRNA
uaaaccgaauauaucucagc

SEQ ID NO: 18624 - RNA, 20 nt, Artificial Sequence
  MKO10018624_A_Fmo4
  gRNA
ggcaguauuugacgcuguua

SEQ ID NO: 18625 - RNA, 20 nt, Artificial Sequence
  MKO10018625_A_Fmo5
  gRNA
cagcagguagacgucuucga

SEQ ID NO: 18626 - RNA, 20 nt, Artificial Sequence
  MKO10018626_A_Fmo5
  gRNA
agguguugaugaccacggac

SEQ ID NO: 18627 - RNA, 20 nt, Artificial Sequence
  MKO10018627_A_Fmo5
  gRNA
ggccaguauuuaccaguccg

SEQ ID NO: 18628 - RNA, 20 nt, Artificial Sequence
  MKO10018628_A_Fmo6
  gRNA
ccaaacucgacucaugaucc

SEQ ID NO: 18629 - RNA, 20 nt, Artificial Sequence
  MKO10018629_A_Fmo6
  gRNA
cgaacgacgugauguauucc

SEQ ID NO: 18630 - RNA, 20 nt, Artificial Sequence
  MKO10018630_A_Fmo6
  gRNA
ccuggaucaugagucgaguu

SEQ ID NO: 18631 - RNA, 20 nt, Artificial Sequence
  MKO10018631_A_Fmo9
  gRNA
uaaaauccacgauccucguc

SEQ ID NO: 18632 - RNA, 20 nt, Artificial Sequence
  MKO10018632_A_Fmo9
  gRNA
gcuuggucguguagcaaaac

SEQ ID NO: 18633 - RNA, 20 nt, Artificial Sequence
  MKO10018633_A_Fmo9
  gRNA
gauagccguuauuccaaaca

SEQ ID NO: 18634 - RNA, 20 nt, Artificial Sequence
  MKO10018634_A_Fmod
  gRNA
gaccgucggguacccuccga

SEQ ID NO: 18635 - RNA, 20 nt, Artificial Sequence
  MKO10018635_A_Fmod
  gRNA
agggucauaggggucguagu

SEQ ID NO: 18636 - RNA, 20 nt, Artificial Sequence
  MKO10018636_A_Fmod
  gRNA
gaucaagcgcagcgcaaugc

SEQ ID NO: 18637 - RNA, 20 nt, Artificial Sequence
  MKO10018637_A_Fmr1nb
  gRNA
ccaacaugccuucggaucga

SEQ ID NO: 18638 - RNA, 20 nt, Artificial Sequence
  MKO10018638_A_Fmr1nb
  gRNA
aacacccguagcaccugugu

SEQ ID NO: 18639 - RNA, 20 nt, Artificial Sequence
  MKO10018639_A_Fmr1nb
  gRNA
cuagaaugcugaucgcagca

SEQ ID NO: 18640 - RNA, 20 nt, Artificial Sequence
  MKO10018640_A_Fmr1
  gRNA
uuagcuaaccaccaacagca

SEQ ID NO: 18641 - RNA, 20 nt, Artificial Sequence
  MKO10018641_A_Fmr1
  gRNA
gggaaucucacaucauggaa

SEQ ID NO: 18642 - RNA, 20 nt, Artificial Sequence
  MKO10018642_A_Fmr1
  gRNA
uacauuugucguaaaucuuc

SEQ ID NO: 18643 - RNA, 20 nt, Artificial Sequence
  MKO10018643_A_Fn1
  gRNA
ccaggucucccccacgacgu

SEQ ID NO: 18644 - RNA, 20 nt, Artificial Sequence
  MKO10018644_A_Fn1
  gRNA
gaccuaccuaggcaacgccc

SEQ ID NO: 18645 - RNA, 20 nt, Artificial Sequence
  MKO10018645_A_Fn1
  gRNA
ccuacaagauuggcgacaag

SEQ ID NO: 18646 - RNA, 20 nt, Artificial Sequence
  MKO10018646_A_Fn3krp
  gRNA
cggcaguauguggaccaguu

SEQ ID NO: 18647 - RNA, 20 nt, Artificial Sequence
  MKO10018647_A_Fn3krp
  gRNA
auugggucgaauucuaugcc

SEQ ID NO: 18648 - RNA, 20 nt, Artificial Sequence
  MKO10018648_A_Fn3krp
  gRNA
ucgacaaccuugaugggcuu

SEQ ID NO: 18649 - RNA, 20 nt, Artificial Sequence
  MKO10018649_A_Fn3k
  gRNA
cccaaaggcccgcaguguug

SEQ ID NO: 18650 - RNA, 20 nt, Artificial Sequence
  MKO10018650_A_Fn3k
  gRNA
gcggguuccuaagcccauga

SEQ ID NO: 18651 - RNA, 20 nt, Artificial Sequence
  MKO10018651_A_Fn3k
  gRNA
uguuugucaaggucaaucgc

SEQ ID NO: 18652 - RNA, 20 nt, Artificial Sequence
  MKO10018652_A_Fnbp1l
  gRNA
aaugaguuaaacgacuaugc

SEQ ID NO: 18653 - RNA, 20 nt, Artificial Sequence
  MKO10018653_A_Fnbp1l
  gRNA
agaacuaugcgaaacaauug

SEQ ID NO: 18654 - RNA, 20 nt, Artificial Sequence
  MKO10018654_A_Fnbp1l
  gRNA
gcuuagauaagcauacccaa

SEQ ID NO: 18655 - RNA, 20 nt, Artificial Sequence
  MKO10018655_A_Fnbp1
  gRNA
ggaccugaugcgcuacguuc

SEQ ID NO: 18656 - RNA, 20 nt, Artificial Sequence
  MKO10018656_A_Fnbp1
  gRNA
gcuccugaacguagcgcauc

SEQ ID NO: 18657 - RNA, 20 nt, Artificial Sequence
  MKO10018657_A_Fnbp1
  gRNA
cgcugacaucaacgugacca

SEQ ID NO: 18658 - RNA, 20 nt, Artificial Sequence
  MKO10018658_A_Fnbp4
  gRNA
caccagaccgacagccguca

SEQ ID NO: 18659 - RNA, 20 nt, Artificial Sequence
  MKO10018659_A_Fnbp4
  gRNA
aucacuaaccgcuaggaagu

SEQ ID NO: 18660 - RNA, 20 nt, Artificial Sequence
  MKO10018660_A_Fnbp4
  gRNA
cuuucucccaccgcaucaaa

SEQ ID NO: 18661 - RNA, 20 nt, Artificial Sequence
  MKO10018661_A_Fnd3c2
  gRNA
uucagaguaacaaccaugag

SEQ ID NO: 18662 - RNA, 20 nt, Artificial Sequence
  MKO10018662_A_Fnd3c2
  gRNA
ucuguguucugcaccucuca

SEQ ID NO: 18663 - RNA, 20 nt, Artificial Sequence
  MKO10018663_A_Fnd3c2
  gRNA
acaagaucuacaaccuagca

SEQ ID NO: 18664 - RNA, 20 nt, Artificial Sequence
  MKO10018664_A_Fndc1
  gRNA
cacugugcguuaccgcgaga

SEQ ID NO: 18665 - RNA, 20 nt, Artificial Sequence
  MKO10018665_A_Fndc1
  gRNA
ccguguaugaauucgcaguc

SEQ ID NO: 18666 - RNA, 20 nt, Artificial Sequence
  MKO10018666_A_Fndc1
  gRNA
uggaaggcgccacgccuguc

SEQ ID NO: 18667 - RNA, 20 nt, Artificial Sequence
  MKO10018667_A_Fndc3a
  gRNA
aucuucucuucuuaucguaa

SEQ ID NO: 18668 - RNA, 20 nt, Artificial Sequence
  MKO10018668_A_Fndc3a
  gRNA
uuauagguuaucgaagacaa

SEQ ID NO: 18669 - RNA, 20 nt, Artificial Sequence
  MKO10018669_A_Fndc3a
  gRNA
gaguacauauggcguggugg

SEQ ID NO: 18670 - RNA, 20 nt, Artificial Sequence
  MKO10018670_A_Fndc3b
  gRNA
cguagcucgacauuccauac

SEQ ID NO: 18671 - RNA, 20 nt, Artificial Sequence
  MKO10018671_A_Fndc3b
  gRNA
aguaggcggugugcgaguuc

SEQ ID NO: 18672 - RNA, 20 nt, Artificial Sequence
  MKO10018672_A_Fndc3b
  gRNA
agcugcgccacaguguacaa

SEQ ID NO: 18673 - RNA, 20 nt, Artificial Sequence
  MKO10018673_A_Fndc3c1
  gRNA
guaccucugauagcaccaac

SEQ ID NO: 18674 - RNA, 20 nt, Artificial Sequence
  MKO10018674_A_Fndc3c1
  gRNA
gagcaauggugcugcuacaa

SEQ ID NO: 18675 - RNA, 20 nt, Artificial Sequence
  MKO10018675_A_Fndc3c1
  gRNA
auugguggcaaauugccagu

SEQ ID NO: 18676 - RNA, 20 nt, Artificial Sequence
  MKO10018676_A_Fndc4
  gRNA
ugugcacuuccgcacgcuca

SEQ ID NO: 18677 - RNA, 20 nt, Artificial Sequence
  MKO10018677_A_Fndc4
  gRNA
ccagaaggcaacaucgucau

SEQ ID NO: 18678 - RNA, 20 nt, Artificial Sequence
  MKO10018678_A_Fndc4
  gRNA
ccaaugacgauguugccuuc

SEQ ID NO: 18679 - RNA, 20 nt, Artificial Sequence
  MKO10018679_A_Fndc5
  gRNA
gcucuucaagaccccacgcg

SEQ ID NO: 18680 - RNA, 20 nt, Artificial Sequence
  MKO10018680_A_Fndc5
  gRNA
ugccggacggucacguucac

SEQ ID NO: 18681 - RNA, 20 nt, Artificial Sequence
  MKO10018681_A_Fndc5
  gRNA
ugggggucuccuccgcagca

SEQ ID NO: 18682 - RNA, 20 nt, Artificial Sequence
  MKO10018682_A_Fndc7
  gRNA
gacgccguauacauggcgau

SEQ ID NO: 18683 - RNA, 20 nt, Artificial Sequence
  MKO10018683_A_Fndc7
  gRNA
gaauccgaucgccauguaua

SEQ ID NO: 18684 - RNA, 20 nt, Artificial Sequence
  MKO10018684_A_Fndc7
  gRNA
aauuccccagggacggugac

SEQ ID NO: 18685 - RNA, 20 nt, Artificial Sequence
  MKO10018685_A_Fndc8
  gRNA
auuuccuggacuuacgcugc

SEQ ID NO: 18686 - RNA, 20 nt, Artificial Sequence
  MKO10018686_A_Fndc8
  gRNA
gcucccgucaagacgcagcu

SEQ ID NO: 18687 - RNA, 20 nt, Artificial Sequence
  MKO10018687_A_Fndc8
  gRNA
agcugcgucuugacgggagc

SEQ ID NO: 18688 - RNA, 20 nt, Artificial Sequence
  MKO10018688_A_Fndc9
  gRNA
gcgcuauaacuuccaucacg

SEQ ID NO: 18689 - RNA, 20 nt, Artificial Sequence
  MKO10018689_A_Fndc9
  gRNA
cggccauacugccucacuau

SEQ ID NO: 18690 - RNA, 20 nt, Artificial Sequence
  MKO10018690_A_Fndc9
  gRNA
gccuccgcugucacgaaccu

SEQ ID NO: 18691 - RNA, 20 nt, Artificial Sequence
  MKO10018691_A_Fnip1
  gRNA
gauacuacugccaguccgug

SEQ ID NO: 18692 - RNA, 20 nt, Artificial Sequence
  MKO10018692_A_Fnip1
  gRNA
acgaucagucgaaucugacu

SEQ ID NO: 18693 - RNA, 20 nt, Artificial Sequence
  MKO10018693_A_Fnip1
  gRNA
acuuugcuaagcauaagcug

SEQ ID NO: 18694 - RNA, 20 nt, Artificial Sequence
  MKO10018694_A_Fnip2
  gRNA
cauccgccugcuaguuuacc

SEQ ID NO: 18695 - RNA, 20 nt, Artificial Sequence
  MKO10018695_A_Fnip2
  gRNA
accguauguaguguaucuuc

SEQ ID NO: 18696 - RNA, 20 nt, Artificial Sequence
  MKO10018696_A_Fnip2
  gRNA
aauccacaguuggucguguu

SEQ ID NO: 18697 - RNA, 20 nt, Artificial Sequence
  MKO10018697_A_Fnua
  gRNA
gcaccacaggcgaguauuag

SEQ ID NO: 18698 - RNA, 20 nt, Artificial Sequence
  MKO10018698_A_Fnua
  gRNA
cuguucugcagcgcgaugag

SEQ ID NO: 18699 - RNA, 20 nt, Artificial Sequence
  MKO10018699_A_Fnua
  gRNA
auuccacuaauacucgccug

SEQ ID NO: 18700 - RNA, 20 nt, Artificial Sequence
  MKO10018700_A_Fntb
  gRNA
aggcaucugucaguugucga

SEQ ID NO: 18701 - RNA, 20 nt, Artificial Sequence
  MKO10018701_A_Fntb
  gRNA
gaugaugcacagcgcauuga

SEQ ID NO: 18702 - RNA, 20 nt, Artificial Sequence
  MKO10018702_A_Fntb
  gRNA
aagccuacaacgucauuaac

SEQ ID NO: 18703 - RNA, 20 nt, Artificial Sequence
  MKO10018703_A_Focad
  gRNA
ugaucaccgugcuugagcac

SEQ ID NO: 18704 - RNA, 20 nt, Artificial Sequence
  MKO10018704_A_Focad
  gRNA
acugguggcacuugucgccc

SEQ ID NO: 18705 - RNA, 20 nt, Artificial Sequence
  MKO10018705_A_Focad
  gRNA
ugugcggacagccugcagcg

SEQ ID NO: 18706 - RNA, 20 nt, Artificial Sequence
  MKO10018706_A_Folh1
  gRNA
agagauguggaacgcacugc

SEQ ID NO: 18707 - RNA, 20 nt, Artificial Sequence
  MKO10018707_A_Folh1
  gRNA
cgccagcgcuggcuccgugu

SEQ ID NO: 18708 - RNA, 20 nt, Artificial Sequence
  MKO10018708_A_Folh1
  gRNA
uuaucugaacagccaccccc

SEQ ID NO: 18709 - RNA, 20 nt, Artificial Sequence
  MKO10018709_A_Folr1
  gRNA
ccaguugaaccgguacaggu

SEQ ID NO: 18710 - RNA, 20 nt, Artificial Sequence
  MKO10018710_A_Folr1
  gRNA
ugaggacaauuuacacgacc

SEQ ID NO: 18711 - RNA, 20 nt, Artificial Sequence
  MKO10018711_A_Folr1
  gRNA
acagcaggaauucgucuucc

SEQ ID NO: 18712 - RNA, 20 nt, Artificial Sequence
  MKO10018712_A_Folr2
  gRNA
aacgcucuuuacgccaacuc

SEQ ID NO: 18713 - RNA, 20 nt, Artificial Sequence
  MKO10018713_A_Folr2
  gRNA
agaccuacucaacguuugca

SEQ ID NO: 18714 - RNA, 20 nt, Artificial Sequence
  MKO10018714_A_Folr2
  gRNA
acucccgucuguacuucaac

SEQ ID NO: 18715 - RNA, 20 nt, Artificial Sequence
  MKO10018715_A_Folr4
  gRNA
ucaaggccagucccgagcgc

SEQ ID NO: 18716 - RNA, 20 nt, Artificial Sequence
  MKO10018716_A_Folr4
  gRNA
cacccuuagcaaccccaacg

SEQ ID NO: 18717 - RNA, 20 nt, Artificial Sequence
  MKO10018717_A_Folr4
  gRNA
agguucuugcuuguggcgcu

SEQ ID NO: 18718 - RNA, 20 nt, Artificial Sequence
  MKO10018718_A_Fopnl
  gRNA
ucucaugagacaaagacggu

SEQ ID NO: 18719 - RNA, 20 nt, Artificial Sequence
  MKO10018719_A_Fopnl
  gRNA
ccuaccgucaggucuucugc

SEQ ID NO: 18720 - RNA, 20 nt, Artificial Sequence
  MKO10018720_A_Fopnl
  gRNA
uuucucuagaugaccacgug

SEQ ID NO: 18721 - RNA, 20 nt, Artificial Sequence
  MKO10018721_A_Fosb
  gRNA
ccggcgaacgcggagaccuc

SEQ ID NO: 18722 - RNA, 20 nt, Artificial Sequence
  MKO10018722_A_Fosb
  gRNA
cugcaagauccccuacgaag

SEQ ID NO: 18723 - RNA, 20 nt, Artificial Sequence
  MKO10018723_A_Fosb
  gRNA
guugugauugcggugaccgu

SEQ ID NO: 18724 - RNA, 20 nt, Artificial Sequence
  MKO10018724_A_Fosl1
  gRNA
gucccgguuccccguagucu

SEQ ID NO: 18725 - RNA, 20 nt, Artificial Sequence
  MKO10018725_A_Fosl1
  gRNA
uccgcucgcgucucacccug

SEQ ID NO: 18726 - RNA, 20 nt, Artificial Sequence
  MKO10018726_A_Fosl1
  gRNA
gccgcagggugagacgcgag

SEQ ID NO: 18727 - RNA, 20 nt, Artificial Sequence
  MKO10018727_A_Fosl2
  gRNA
aggaggagaagcgucgaauc

SEQ ID NO: 18728 - RNA, 20 nt, Artificial Sequence
  MKO10018728_A_Fosl2
  gRNA
ggcacugcccguaccgcgca

SEQ ID NO: 18729 - RNA, 20 nt, Artificial Sequence
  MKO10018729_A_Fosl2
  gRNA
cguggaggucaccacgaugg

SEQ ID NO: 18730 - RNA, 20 nt, Artificial Sequence
  MKO10018730_A_Fos
  gRNA
ggaauggugaagaccguguc

SEQ ID NO: 18731 - RNA, 20 nt, Artificial Sequence
  MKO10018731_A_Fos
  gRNA
ugcaagauccccgaugaccu

SEQ ID NO: 18732 - RNA, 20 nt, Artificial Sequence
  MKO10018732_A_Fos
  gRNA
ccaucuuauuccguucccuu

SEQ ID NO: 18733 - RNA, 20 nt, Artificial Sequence
  MKO10018733_A_Foxa1
  gRNA
guuggacggcgcguacgcca

SEQ ID NO: 18734 - RNA, 20 nt, Artificial Sequence
  MKO10018734_A_Foxa1
  gRNA
cgaagcgcccccugucgccg

SEQ ID NO: 18735 - RNA, 20 nt, Artificial Sequence
  MKO10018735_A_Foxa1
  gRNA
cagcuacuacgcggacacgc

SEQ ID NO: 18736 - RNA, 20 nt, Artificial Sequence
  MKO10018736_A_Foxa2
  gRNA
cgguuccggcaacaugagcg

SEQ ID NO: 18737 - RNA, 20 nt, Artificial Sequence
  MKO10018737_A_Foxa2
  gRNA
ggaaugagcccgucgcuagc

SEQ ID NO: 18738 - RNA, 20 nt, Artificial Sequence
  MKO10018738_A_Foxa2
  gRNA
aagggcacgagccauccgac

SEQ ID NO: 18739 - RNA, 20 nt, Artificial Sequence
  MKO10018739_A_Foxa3
  gRNA
uggaccucuucccguacuac

SEQ ID NO: 18740 - RNA, 20 nt, Artificial Sequence
  MKO10018740_A_Foxa3
  gRNA
gcucccgggggaacuaaagu

SEQ ID NO: 18741 - RNA, 20 nt, Artificial Sequence
  MKO10018741_A_Foxa3
  gRNA
aggcucaugaccuggccgag

SEQ ID NO: 18742 - RNA, 20 nt, Artificial Sequence
  MKO10018742_A_Foxb1
  gRNA
agguacugcgcggcguccgc

SEQ ID NO: 18743 - RNA, 20 nt, Artificial Sequence
  MKO10018743_A_Foxb1
  gRNA
gcaacgucuggcccgcggcg

SEQ ID NO: 18744 - RNA, 20 nt, Artificial Sequence
  MKO10018744_A_Foxb1
  gRNA
ggcugagucgaucauacccg

SEQ ID NO: 18745 - RNA, 20 nt, Artificial Sequence
  MKO10018745_A_Foxb2
  gRNA
gcaauguugucggcuccgug

SEQ ID NO: 18746 - RNA, 20 nt, Artificial Sequence
  MKO10018746_A_Foxb2
  gRNA
aggccggaccaacccgguaa

SEQ ID NO: 18747 - RNA, 20 nt, Artificial Sequence
  MKO10018747_A_Foxb2
  gRNA
guagcaccuugaagcgcuug

SEQ ID NO: 18748 - RNA, 20 nt, Artificial Sequence
  MKO10018748_A_Foxc1
  gRNA
gagcuacuaucgcgcugccg

SEQ ID NO: 18749 - RNA, 20 nt, Artificial Sequence
  MKO10018749_A_Foxc1
  gRNA
cugcggcguauaaggcccgu

SEQ ID NO: 18750 - RNA, 20 nt, Artificial Sequence
  MKO10018750_A_Foxc1
  gRNA
cacgcucgcccgccgcguac

SEQ ID NO: 18751 - RNA, 20 nt, Artificial Sequence
  MKO10018751_A_Foxc2
  gRNA
gacgcugcgcacgucgccuc

SEQ ID NO: 18752 - RNA, 20 nt, Artificial Sequence
  MKO10018752_A_Foxc2
  gRNA
uuacacgcagccgugcgcgc

SEQ ID NO: 18753 - RNA, 20 nt, Artificial Sequence
  MKO10018753_A_Foxc2
  gRNA
acuggacaacucgucccucg

SEQ ID NO: 18754 - RNA, 20 nt, Artificial Sequence
  MKO10018754_A_Foxd1
  gRNA
gccguaggcuccguagccgc

SEQ ID NO: 18755 - RNA, 20 nt, Artificial Sequence
  MKO10018755_A_Foxd1
  gRNA
cguaagagcgccuccgccgc

SEQ ID NO: 18756 - RNA, 20 nt, Artificial Sequence
  MKO10018756_A_Foxd1
  gRNA
cgccggggaggacgaucucg

SEQ ID NO: 18757 - RNA, 20 nt, Artificial Sequence
  MKO10018757_A_Foxd2
  gRNA
guagccguaagcgccguaag

SEQ ID NO: 18758 - RNA, 20 nt, Artificial Sequence
  MKO10018758_A_Foxd2
  gRNA
cucucgagcuucgccgcuua

SEQ ID NO: 18759 - RNA, 20 nt, Artificial Sequence
  MKO10018759_A_Foxd2
  gRNA
cucaagacggacgccggcgg

SEQ ID NO: 18760 - RNA, 20 nt, Artificial Sequence
  MKO10018760_A_Foxd3
  gRNA
gccacgggugguagcgcgua

SEQ ID NO: 18761 - RNA, 20 nt, Artificial Sequence
  MKO10018761_A_Foxd3
  gRNA
cgucuggccggacauaucgc

SEQ ID NO: 18762 - RNA, 20 nt, Artificial Sequence
  MKO10018762_A_Foxd3
  gRNA
ggagcucccgugucguuccc

SEQ ID NO: 18763 - RNA, 20 nt, Artificial Sequence
  MKO10018763_A_Foxd4
  gRNA
accgccguaaguuccccgcc

SEQ ID NO: 18764 - RNA, 20 nt, Artificial Sequence
  MKO10018764_A_Foxd4
  gRNA
gaacgaagcgcacccgcguc

SEQ ID NO: 18765 - RNA, 20 nt, Artificial Sequence
  MKO10018765_A_Foxd4
  gRNA
gccuaaccgcacgccuuuac

SEQ ID NO: 18766 - RNA, 20 nt, Artificial Sequence
  MKO10018766_A_Foxe1
  gRNA
cuacuaccccgccgcgucgc

SEQ ID NO: 18767 - RNA, 20 nt, Artificial Sequence
  MKO10018767_A_Foxe1
  gRNA
cggcgcguagcccgcauaga

SEQ ID NO: 18768 - RNA, 20 nt, Artificial Sequence
  MKO10018768_A_Foxe1
  gRNA
gcgcccguagaaguccaccg

SEQ ID NO: 18769 - RNA, 20 nt, Artificial Sequence
  MKO10018769_A_Foxe3
  gRNA
cuacuggacgcucgaucccg

SEQ ID NO: 18770 - RNA, 20 nt, Artificial Sequence
  MKO10018770_A_Foxe3
  gRNA
ucccggccgccgucuaacgc

SEQ ID NO: 18771 - RNA, 20 nt, Artificial Sequence
  MKO10018771_A_Foxe3
  gRNA
gcagcggcgcggguaacccc

SEQ ID NO: 18772 - RNA, 20 nt, Artificial Sequence
  MKO10018772_A_Foxf1
  gRNA
guacccgcaccacgacagcu

SEQ ID NO: 18773 - RNA, 20 nt, Artificial Sequence
  MKO10018773_A_Foxf1
  gRNA
gcgacugugagugauaccga

SEQ ID NO: 18774 - RNA, 20 nt, Artificial Sequence
  MKO10018774_A_Foxf1
  gRNA
gugcggcuccaugacuccgc

SEQ ID NO: 18775 - RNA, 20 nt, Artificial Sequence
  MKO10018775_A_Foxf2
  gRNA
cgacuuccaagcgcccccgu

SEQ ID NO: 18776 - RNA, 20 nt, Artificial Sequence
  MKO10018776_A_Foxf2
  gRNA
gacgccaagcaguaaucccg

SEQ ID NO: 18777 - RNA, 20 nt, Artificial Sequence
  MKO10018777_A_Foxf2
  gRNA
aaaucuuuccugucgcacac

SEQ ID NO: 18778 - RNA, 20 nt, Artificial Sequence
  MKO10018778_A_Foxg1
  gRNA
accgcgccacuacgacgacc

SEQ ID NO: 18779 - RNA, 20 nt, Artificial Sequence
  MKO10018779_A_Foxg1
  gRNA
ucgagcgacgacguguucau

SEQ ID NO: 18780 - RNA, 20 nt, Artificial Sequence
  MKO10018780_A_Foxg1
  gRNA
augaacacgucgucgcucga

SEQ ID NO: 18781 - RNA, 20 nt, Artificial Sequence
  MKO10018781_A_Foxh1
  gRNA
cucagcugagaguugucgcg

SEQ ID NO: 18782 - RNA, 20 nt, Artificial Sequence
  MKO10018782_A_Foxh1
  gRNA
acacugcccugugccgucga

SEQ ID NO: 18783 - RNA, 20 nt, Artificial Sequence
  MKO10018783_A_Foxh1
  gRNA
cuuauggaagcaccgauuag

SEQ ID NO: 18784 - RNA, 20 nt, Artificial Sequence
  MKO10018784_A_Foxi1
  gRNA
guauucgccaccaccuucga

SEQ ID NO: 18785 - RNA, 20 nt, Artificial Sequence
  MKO10018785_A_Foxi1
  gRNA
gaaaguugucggccacguac

SEQ ID NO: 18786 - RNA, 20 nt, Artificial Sequence
  MKO10018786_A_Foxi1
  gRNA
aaacccuauuagccgcuccg

SEQ ID NO: 18787 - RNA, 20 nt, Artificial Sequence
  MKO10018787_A_Foxi2
  gRNA
uccaaagcgcgccgcuacgc

SEQ ID NO: 18788 - RNA, 20 nt, Artificial Sequence
  MKO10018788_A_Foxi2
  gRNA
aucgcgcaucccccgagcua

SEQ ID NO: 18789 - RNA, 20 nt, Artificial Sequence
  MKO10018789_A_Foxi2
  gRNA
cagauuccuaacaccgcgcc

SEQ ID NO: 18790 - RNA, 20 nt, Artificial Sequence
  MKO10018790_A_Foxi3
  gRNA
cgaaguugucgccgcaauac

SEQ ID NO: 18791 - RNA, 20 nt, Artificial Sequence
  MKO10018791_A_Foxi3
  gRNA
gcgaccacccuacucguacu

SEQ ID NO: 18792 - RNA, 20 nt, Artificial Sequence
  MKO10018792_A_Foxi3
  gRNA
ucggaagcgaaggcgccgcg

SEQ ID NO: 18793 - RNA, 20 nt, Artificial Sequence
  MKO10018793_A_Foxj1
  gRNA
cacaucucgaagcgcgcccc

SEQ ID NO: 18794 - RNA, 20 nt, Artificial Sequence
  MKO10018794_A_Foxj1
  gRNA
ucgagaugugcacgacgaug

SEQ ID NO: 18795 - RNA, 20 nt, Artificial Sequence
  MKO10018795_A_Foxj1
  gRNA
gugggccucugaccgugaac

SEQ ID NO: 18796 - RNA, 20 nt, Artificial Sequence
  MKO10018796_A_Foxj2
  gRNA
gcaggugucaauuguccaau

SEQ ID NO: 18797 - RNA, 20 nt, Artificial Sequence
  MKO10018797_A_Foxj2
  gRNA
aguccccucgugagagagug

SEQ ID NO: 18798 - RNA, 20 nt, Artificial Sequence
  MKO10018798_A_Foxj2
  gRNA
ccuuccggaaacacuuguua

SEQ ID NO: 18799 - RNA, 20 nt, Artificial Sequence
  MKO10018799_A_Foxj3
  gRNA
agagggcaagauccguagaa

SEQ ID NO: 18800 - RNA, 20 nt, Artificial Sequence
  MKO10018800_A_Foxj3
  gRNA
guaggcagcgugucuuccuu

SEQ ID NO: 18801 - RNA, 20 nt, Artificial Sequence
  MKO10018801_A_Foxj3
  gRNA
gcagccuaacaucuauggac

SEQ ID NO: 18802 - RNA, 20 nt, Artificial Sequence
  MKO10018802_A_Foxk1
  gRNA
cugcacgaucagcugcgcau

SEQ ID NO: 18803 - RNA, 20 nt, Artificial Sequence
  MKO10018803_A_Foxk1
  gRNA
ugauggccgugcucgggaac

SEQ ID NO: 18804 - RNA, 20 nt, Artificial Sequence
  MKO10018804_A_Foxk1
  gRNA
cuaugcgcagcugaucgugc

SEQ ID NO: 18805 - RNA, 20 nt, Artificial Sequence
  MKO10018805_A_Foxk2
  gRNA
gccaucggaccucaguuuaa

SEQ ID NO: 18806 - RNA, 20 nt, Artificial Sequence
  MKO10018806_A_Foxk2
  gRNA
gcuauaccugauaguucccg

SEQ ID NO: 18807 - RNA, 20 nt, Artificial Sequence
  MKO10018807_A_Foxk2
  gRNA
ccugaagacccugcuccgcg

SEQ ID NO: 18808 - RNA, 20 nt, Artificial Sequence
  MKO10018808_A_Foxl1
  gRNA
cggcucgacccgggugcgcu

SEQ ID NO: 18809 - RNA, 20 nt, Artificial Sequence
  MKO10018809_A_Foxl1
  gRNA
cgauguaggguccccggacc

SEQ ID NO: 18810 - RNA, 20 nt, Artificial Sequence
  MKO10018810_A_Foxl1
  gRNA
uucgacgcgcacguccaggg

SEQ ID NO: 18811 - RNA, 20 nt, Artificial Sequence
  MKO10018811_A_Foxl2
  gRNA
gaagcccccguacucguacg

SEQ ID NO: 18812 - RNA, 20 nt, Artificial Sequence
  MKO10018812_A_Foxl2
  gRNA
agggccccccaggccguugu

SEQ ID NO: 18813 - RNA, 20 nt, Artificial Sequence
  MKO10018813_A_Foxl2
  gRNA
gcgcgcccgucuugcugucg

SEQ ID NO: 18814 - RNA, 20 nt, Artificial Sequence
  MKO10018814_A_Foxm1
  gRNA
gggccccugcagcguuaagc

SEQ ID NO: 18815 - RNA, 20 nt, Artificial Sequence
  MKO10018815_A_Foxm1
  gRNA
uccacaaucgcccgagcacu

SEQ ID NO: 18816 - RNA, 20 nt, Artificial Sequence
  MKO10018816_A_Foxm1
  gRNA
gucaaguagcgauuggcacu

SEQ ID NO: 18817 - RNA, 20 nt, Artificial Sequence
  MKO10018817_A_Foxn1
  gRNA
gcaccccaggccaacgccga

SEQ ID NO: 18818 - RNA, 20 nt, Artificial Sequence
  MKO10018818_A_Foxn1
  gRNA
caucaagugccauggccguc

SEQ ID NO: 18819 - RNA, 20 nt, Artificial Sequence
  MKO10018819_A_Foxn1
  gRNA
cugcacagccggacccggcc

SEQ ID NO: 18820 - RNA, 20 nt, Artificial Sequence
  MKO10018820_A_Foxn2
  gRNA
ggcuacgcaccgcaagcucg

SEQ ID NO: 18821 - RNA, 20 nt, Artificial Sequence
  MKO10018821_A_Foxn2
  gRNA
cauccgucuccucgucgcug

SEQ ID NO: 18822 - RNA, 20 nt, Artificial Sequence
  MKO10018822_A_Foxn2
  gRNA
uucuggaucaacgcaccaca

SEQ ID NO: 18823 - RNA, 20 nt, Artificial Sequence
  MKO10018823_A_Foxn3
  gRNA
gccgcccgagagcgaugacg

SEQ ID NO: 18824 - RNA, 20 nt, Artificial Sequence
  MKO10018824_A_Foxn3
  gRNA
augcguauccgcuguccccc

SEQ ID NO: 18825 - RNA, 20 nt, Artificial Sequence
  MKO10018825_A_Foxn3
  gRNA
auugguaacggccggacacc

SEQ ID NO: 18826 - RNA, 20 nt, Artificial Sequence
  MKO10018826_A_Foxn4
  gRNA
cggauagaccugggcaguuc

SEQ ID NO: 18827 - RNA, 20 nt, Artificial Sequence
  MKO10018827_A_Foxn4
  gRNA
cacguccacggccgugagcc

SEQ ID NO: 18828 - RNA, 20 nt, Artificial Sequence
  MKO10018828_A_Foxn4
  gRNA
gagacgcaugcauugccccg

SEQ ID NO: 18829 - RNA, 20 nt, Artificial Sequence
  MKO10018829_A_Foxo1
  gRNA
gcucgucgcgccgcaacgcg

SEQ ID NO: 18830 - RNA, 20 nt, Artificial Sequence
  MKO10018830_A_Foxo1
  gRNA
uuggcggccgcgccgcccga

SEQ ID NO: 18831 - RNA, 20 nt, Artificial Sequence
  MKO10018831_A_Foxo1
  gRNA
cacgggggucaagcgguuca

SEQ ID NO: 18832 - RNA, 20 nt, Artificial Sequence
  MKO10018832_A_Foxo3
  gRNA
cguugcgaagcaucacguuc

SEQ ID NO: 18833 - RNA, 20 nt, Artificial Sequence
  MKO10018833_A_Foxo3
  gRNA
ucucgauggcgcgggugauc

SEQ ID NO: 18834 - RNA, 20 nt, Artificial Sequence
  MKO10018834_A_Foxo3
  gRNA
ggacugucgucugccgacuc

SEQ ID NO: 18835 - RNA, 20 nt, Artificial Sequence
  MKO10018835_A_Foxo4
  gRNA
cacucgcccagaucuacgaa

SEQ ID NO: 18836 - RNA, 20 nt, Artificial Sequence
  MKO10018836_A_Foxo4
  gRNA
gccguccgcgauccugcacc

SEQ ID NO: 18837 - RNA, 20 nt, Artificial Sequence
  MKO10018837_A_Foxo4
  gRNA
uguuauccaugucgcacucc

SEQ ID NO: 18838 - RNA, 20 nt, Artificial Sequence
  MKO10018838_A_Foxo6
  gRNA
ugcgaagcugcgagcgcauc

SEQ ID NO: 18839 - RNA, 20 nt, Artificial Sequence
  MKO10018839_A_Foxo6
  gRNA
acuuggccggcgacgaggac

SEQ ID NO: 18840 - RNA, 20 nt, Artificial Sequence
  MKO10018840_A_Foxo6
  gRNA
ccacgccucguagucgucac

SEQ ID NO: 18841 - RNA, 20 nt, Artificial Sequence
  MKO10018841_A_Foxp1
  gRNA
cgugugcuuaccuugagcga

SEQ ID NO: 18842 - RNA, 20 nt, Artificial Sequence
  MKO10018842_A_Foxp1
  gRNA
aacccgcaugccucuaccaa

SEQ ID NO: 18843 - RNA, 20 nt, Artificial Sequence
  MKO10018843_A_Foxp1
  gRNA
cagagcugcugcaguuccgu

SEQ ID NO: 18844 - RNA, 20 nt, Artificial Sequence
  MKO10018844_A_Foxp2
  gRNA
cuguaccuugaggcagcgac

SEQ ID NO: 18845 - RNA, 20 nt, Artificial Sequence
  MKO10018845_A_Foxp2
  gRNA
agaugaggcccuggcgcuga

SEQ ID NO: 18846 - RNA, 20 nt, Artificial Sequence
  MKO10018846_A_Foxp2
  gRNA
acaaaaguugucuugcugcc

SEQ ID NO: 18847 - RNA, 20 nt, Artificial Sequence
  MKO10018847_A_Foxp3
  gRNA
gcaccgucuggggcccgacu

SEQ ID NO: 18848 - RNA, 20 nt, Artificial Sequence
  MKO10018848_A_Foxp3
  gRNA
ugugcuccaagugcguccac

SEQ ID NO: 18849 - RNA, 20 nt, Artificial Sequence
  MKO10018849_A_Foxp3
  gRNA
gguuguccaguggacgcacu

SEQ ID NO: 18850 - RNA, 20 nt, Artificial Sequence
  MKO10018850_A_Foxp4
  gRNA
acaaucaggucggcuccguc

SEQ ID NO: 18851 - RNA, 20 nt, Artificial Sequence
  MKO10018851_A_Foxp4
  gRNA
caauggcgagaugagccccg

SEQ ID NO: 18852 - RNA, 20 nt, Artificial Sequence
  MKO10018852_A_Foxp4
  gRNA
gcugggggguaagcaucugc

SEQ ID NO: 18853 - RNA, 20 nt, Artificial Sequence
  MKO10018853_A_Foxq1
  gRNA
cgcgcagcaagccguacacg

SEQ ID NO: 18854 - RNA, 20 nt, Artificial Sequence
  MKO10018854_A_Foxq1
  gRNA
agcgaauacaccuucgccga

SEQ ID NO: 18855 - RNA, 20 nt, Artificial Sequence
  MKO10018855_A_Foxq1
  gRNA
gccgagcgcccaagacgguc

SEQ ID NO: 18856 - RNA, 20 nt, Artificial Sequence
  MKO10018856_A_Foxr1
  gRNA
gggcuccacucgagaauccg

SEQ ID NO: 18857 - RNA, 20 nt, Artificial Sequence
  MKO10018857_A_Foxr1
  gRNA
uauguucuugagcgcugagu

SEQ ID NO: 18858 - RNA, 20 nt, Artificial Sequence
  MKO10018858_A_Foxr1
  gRNA
aggagaaacuguaacgaccc

SEQ ID NO: 18859 - RNA, 20 nt, Artificial Sequence
  MKO10018859_A_Foxr2
  gRNA
ucuggugcuguccgaaaaua

SEQ ID NO: 18860 - RNA, 20 nt, Artificial Sequence
  MKO10018860_A_Foxr2
  gRNA
ucaggaggacacccgugucu

SEQ ID NO: 18861 - RNA, 20 nt, Artificial Sequence
  MKO10018861_A_Foxr2
  gRNA
gaugcucucccuucgagcau

SEQ ID NO: 18862 - RNA, 20 nt, Artificial Sequence
  MKO10018862_A_Foxred1
  gRNA
uacuccuucuacguuuaucc

SEQ ID NO: 18863 - RNA, 20 nt, Artificial Sequence
  MKO10018863_A_Foxred1
  gRNA
aaacguagaaggaguagcuc

SEQ ID NO: 18864 - RNA, 20 nt, Artificial Sequence
  MKO10018864_A_Foxred1
  gRNA
ggguugaacugaaguuccac

SEQ ID NO: 18865 - RNA, 20 nt, Artificial Sequence
  MKO10018865_A_Foxred2
  gRNA
acggucguaggccacccgca

SEQ ID NO: 18866 - RNA, 20 nt, Artificial Sequence
  MKO10018866_A_Foxred2
  gRNA
ugaagccgccagcggauuuc

SEQ ID NO: 18867 - RNA, 20 nt, Artificial Sequence
  MKO10018867_A_Foxred2
  gRNA
uccacaugcugagccguucc

SEQ ID NO: 18868 - RNA, 20 nt, Artificial Sequence
  MKO10018868_A_Foxs1
  gRNA
uggcaucuaccgcuacauca

SEQ ID NO: 18869 - RNA, 20 nt, Artificial Sequence
  MKO10018869_A_Foxs1
  gRNA
ugucguggcaguccggaucc

SEQ ID NO: 18870 - RNA, 20 nt, Artificial Sequence
  MKO10018870_A_Foxs1
  gRNA
ccucgugaugaccgcaagcc

SEQ ID NO: 18871 - RNA, 20 nt, Artificial Sequence
  MKO10018871_A_Fpgs
  gRNA
cggaauuacggccugaagac

SEQ ID NO: 18872 - RNA, 20 nt, Artificial Sequence
  MKO10018872_A_Fpgs
  gRNA
ccguucggugaaggcacagg

SEQ ID NO: 18873 - RNA, 20 nt, Artificial Sequence
  MKO10018873_A_Fpgs
  gRNA
cgggagcggauucgaaucaa

SEQ ID NO: 18874 - RNA, 20 nt, Artificial Sequence
  MKO10018874_A_Fpgu
  gRNA
cucuccgcgaagccacccug

SEQ ID NO: 18875 - RNA, 20 nt, Artificial Sequence
  MKO10018875_A_Fpgu
  gRNA
aaaaucugcgcaguuuccgc

SEQ ID NO: 18876 - RNA, 20 nt, Artificial Sequence
  MKO10018876_A_Fpgu
  gRNA
uuacagcgcuuaacauccca

SEQ ID NO: 18877 - RNA, 20 nt, Artificial Sequence
  MKO10018877_A_Fpr-rs3
  gRNA
uccugccgacucugaacuau

SEQ ID NO: 18878 - RNA, 20 nt, Artificial Sequence
  MKO10018878_A_Fpr-rs3
  gRNA
gacaccuuuaauugcuccuc

SEQ ID NO: 18879 - RNA, 20 nt, Artificial Sequence
  MKO10018879_A_Fpr-rs3
  gRNA
cuuguguccugcacccagua

SEQ ID NO: 18880 - RNA, 20 nt, Artificial Sequence
  MKO10018880_A_Fpr-rs4
  gRNA
gcccauuaccuagaacaccg

SEQ ID NO: 18881 - RNA, 20 nt, Artificial Sequence
  MKO10018881_A_Fpr-rs4
  gRNA
ucaaggacuagucuucccuc

SEQ ID NO: 18882 - RNA, 20 nt, Artificial Sequence
  MKO10018882_A_Fpr-rs4
  gRNA
uuuguguccugugcccagua

SEQ ID NO: 18883 - RNA, 20 nt, Artificial Sequence
  MKO10018883_A_Fpr-rs6
  gRNA
cacagaauaauauugacacg

SEQ ID NO: 18884 - RNA, 20 nt, Artificial Sequence
  MKO10018884_A_Fpr-rs6
  gRNA
guagucacgaagauacaaug

SEQ ID NO: 18885 - RNA, 20 nt, Artificial Sequence
  MKO10018885_A_Fpr-rs6
  gRNA
cgaaagugaucuuuggagcu

SEQ ID NO: 18886 - RNA, 20 nt, Artificial Sequence
  MKO10018886_A_Fpr1
  gRNA
acagucccuaauaguagacu

SEQ ID NO: 18887 - RNA, 20 nt, Artificial Sequence
  MKO10018887_A_Fpr1
  gRNA
guggucaaacgaaugauaac

SEQ ID NO: 18888 - RNA, 20 nt, Artificial Sequence
  MKO10018888_A_Fpr1
  gRNA
ccacaauccaaguccgugaa

SEQ ID NO: 18889 - RNA, 20 nt, Artificial Sequence
  MKO10018889_A_Fpr2
  gRNA
uaaaucucucacgaaagucc

SEQ ID NO: 18890 - RNA, 20 nt, Artificial Sequence
  MKO10018890_A_Fpr2
  gRNA
cucucucaagacuauaaggc

SEQ ID NO: 18891 - RNA, 20 nt, Artificial Sequence
  MKO10018891_A_Fpr2
  gRNA
gccuuuaacucaaugucugc

SEQ ID NO: 18892 - RNA, 20 nt, Artificial Sequence
  MKO10018892_A_Fpr3
  gRNA
aggacggcuggaauuaacaa

SEQ ID NO: 18893 - RNA, 20 nt, Artificial Sequence
  MKO10018893_A_Fpr3
  gRNA
gcaguagauguaaaccuauu

SEQ ID NO: 18894 - RNA, 20 nt, Artificial Sequence
  MKO10018894_A_Fpr3
  gRNA
uuccucaacagaguugcccc

SEQ ID NO: 18895 - RNA, 20 nt, Artificial Sequence
  MKO10018895_A_Fra10ac1
  gRNA
ucgccgcagacuugcucgac

SEQ ID NO: 18896 - RNA, 20 nt, Artificial Sequence
  MKO10018896_A_Fra10ac1
  gRNA
acaccugucgagcaagucug

SEQ ID NO: 18897 - RNA, 20 nt, Artificial Sequence
  MKO10018897_A_Fra10ac1
  gRNA
aauauagucguuuacaaacu

SEQ ID NO: 18898 - RNA, 20 nt, Artificial Sequence
  MKO10018898_A_Fras1
  gRNA
acgcugcugcccuaucugug

SEQ ID NO: 18899 - RNA, 20 nt, Artificial Sequence
  MKO10018899_A_Fras1
  gRNA
cgacaguucuggcaugaauc

SEQ ID NO: 18900 - RNA, 20 nt, Artificial Sequence
  MKO10018900_A_Fras1
  gRNA
ugccagaacugucguugcca

SEQ ID NO: 18901 - RNA, 20 nt, Artificial Sequence
  MKO10018901_A_Frau1
  gRNA
auccgcgucgcuguugcaag

SEQ ID NO: 18902 - RNA, 20 nt, Artificial Sequence
  MKO10018902_A_Frau1
  gRNA
cuugacggacccccggggac

SEQ ID NO: 18903 - RNA, 20 nt, Artificial Sequence
  MKO10018903_A_Frau1
  gRNA
gugcuuaguuugccgguccc

SEQ ID NO: 18904 - RNA, 20 nt, Artificial Sequence
  MKO10018904_A_Frau2
  gRNA
caaccgcggcgaccgcucgc

SEQ ID NO: 18905 - RNA, 20 nt, Artificial Sequence
  MKO10018905_A_Frau2
  gRNA
ugacugaguccgguccgcuu

SEQ ID NO: 18906 - RNA, 20 nt, Artificial Sequence
  MKO10018906_A_Frau2
  gRNA
cccggaccccggagcgcucg

SEQ ID NO: 18907 - RNA, 20 nt, Artificial Sequence
  MKO10018907_A_Frem1
  gRNA
cguggugaaucguaagucag

SEQ ID NO: 18908 - RNA, 20 nt, Artificial Sequence
  MKO10018908_A_Frem1
  gRNA
acgaccagcuugccgugagc

SEQ ID NO: 18909 - RNA, 20 nt, Artificial Sequence
  MKO10018909_A_Frem1
  gRNA
gugaacauacuucacuucgu

SEQ ID NO: 18910 - RNA, 20 nt, Artificial Sequence
  MKO10018910_A_Frem2
  gRNA
gcucguguuccccgucgcuc

SEQ ID NO: 18911 - RNA, 20 nt, Artificial Sequence
  MKO10018911_A_Frem2
  gRNA
uuuccgcagguaucggcacc

SEQ ID NO: 18912 - RNA, 20 nt, Artificial Sequence
  MKO10018912_A_Frem2
  gRNA
gauauuguucuuacacgcag

SEQ ID NO: 18913 - RNA, 20 nt, Artificial Sequence
  MKO10018913_A_Frem3
  gRNA
ucgaagugacucucacccgc

SEQ ID NO: 18914 - RNA, 20 nt, Artificial Sequence
  MKO10018914_A_Frem3
  gRNA
uaacgacagaugugccucca

SEQ ID NO: 18915 - RNA, 20 nt, Artificial Sequence
  MKO10018915_A_Frem3
  gRNA
cugguuccugugagacgauc

SEQ ID NO: 18916 - RNA, 20 nt, Artificial Sequence
  MKO10018916_A_Frg1
  gRNA
guugggcguucggaugcaau

SEQ ID NO: 18917 - RNA, 20 nt, Artificial Sequence
  MKO10018917_A_Frg1
  gRNA
gcuuacccacaauaucaagu

SEQ ID NO: 18918 - RNA, 20 nt, Artificial Sequence
  MKO10018918_A_Frg1
  gRNA
aggagccuauauccaugcac

SEQ ID NO: 18919 - RNA, 20 nt, Artificial Sequence
  MKO10018919_A_Frk
  gRNA
aguugcggucuaucucccac

SEQ ID NO: 18920 - RNA, 20 nt, Artificial Sequence
  MKO10018920_A_Frk
  gRNA
cagucgcuucaaaagcugua

SEQ ID NO: 18921 - RNA, 20 nt, Artificial Sequence
  MKO10018921_A_Frk
  gRNA
acacagcccgucacuuguug

SEQ ID NO: 18922 - RNA, 20 nt, Artificial Sequence
  MKO10018922_A_Frmd3
  gRNA
cgagucguccagcagucgaa

SEQ ID NO: 18923 - RNA, 20 nt, Artificial Sequence
  MKO10018923_A_Frmd3
  gRNA
ucuugucacugugcgccgag

SEQ ID NO: 18924 - RNA, 20 nt, Artificial Sequence
  MKO10018924_A_Frmd3
  gRNA
cugcaacuacuauagccugc

SEQ ID NO: 18925 - RNA, 20 nt, Artificial Sequence
  MKO10018925_A_Frmd4a
  gRNA
cgagaucgccauugaccuga

SEQ ID NO: 18926 - RNA, 20 nt, Artificial Sequence
  MKO10018926_A_Frmd4a
  gRNA
ggaaucagauagcucgcagu

SEQ ID NO: 18927 - RNA, 20 nt, Artificial Sequence
  MKO10018927_A_Frmd4a
  gRNA
uggcgaucucgcucagacuu

SEQ ID NO: 18928 - RNA, 20 nt, Artificial Sequence
  MKO10018928_A_Frmd4b
  gRNA
cucuucugcacuucgcuguc

SEQ ID NO: 18929 - RNA, 20 nt, Artificial Sequence
  MKO10018929_A_Frmd4b
  gRNA
gaacccuuaccugcaaaacc

SEQ ID NO: 18930 - RNA, 20 nt, Artificial Sequence
  MKO10018930_A_Frmd4b
  gRNA
gugucuuaccuuguguacac

SEQ ID NO: 18931 - RNA, 20 nt, Artificial Sequence
  MKO10018931_A_Frmd5
  gRNA
ugacuuacccgcugcuuauc

SEQ ID NO: 18932 - RNA, 20 nt, Artificial Sequence
  MKO10018932_A_Frmd5
  gRNA
cggcaggguaaaacuucacg

SEQ ID NO: 18933 - RNA, 20 nt, Artificial Sequence
  MKO10018933_A_Frmd5
  gRNA
cgaccccgcugcccugaaag

SEQ ID NO: 18934 - RNA, 20 nt, Artificial Sequence
  MKO10018934_A_Frmd6
  gRNA
uucguauugccguaccuugc

SEQ ID NO: 18935 - RNA, 20 nt, Artificial Sequence
  MKO10018935_A_Frmd6
  gRNA
ucucagggcaucgaccaguu

SEQ ID NO: 18936 - RNA, 20 nt, Artificial Sequence
  MKO10018936_A_Frmd6
  gRNA
uugcaagauacuauuauuac

SEQ ID NO: 18937 - RNA, 20 nt, Artificial Sequence
  MKO10018937_A_Frmd7
  gRNA
aucuucgggaagaacucaca

SEQ ID NO: 18938 - RNA, 20 nt, Artificial Sequence
  MKO10018938_A_Frmd7
  gRNA
gaguucuucccgaagauguc

SEQ ID NO: 18939 - RNA, 20 nt, Artificial Sequence
  MKO10018939_A_Frmd7
  gRNA
ccaucucaaucuugcugaaa

SEQ ID NO: 18940 - RNA, 20 nt, Artificial Sequence
  MKO10018940_A_Frmd8
  gRNA
gcacuacuguaucauccgcc

SEQ ID NO: 18941 - RNA, 20 nt, Artificial Sequence
  MKO10018941_A_Frmd8
  gRNA
gcaggacuucacggacugcg

SEQ ID NO: 18942 - RNA, 20 nt, Artificial Sequence
  MKO10018942_A_Frmd8
  gRNA
ccacuggcggcccaguuuau

SEQ ID NO: 18943 - RNA, 20 nt, Artificial Sequence
  MKO10018943_A_Frmpd1
  gRNA
aauaucagccgcucguucac

SEQ ID NO: 18944 - RNA, 20 nt, Artificial Sequence
  MKO10018944_A_Frmpd1
  gRNA
agagguuuaccgaugugcag

SEQ ID NO: 18945 - RNA, 20 nt, Artificial Sequence
  MKO10018945_A_Frmpd1
  gRNA
gcugaagagcaaccccguga

SEQ ID NO: 18946 - RNA, 20 nt, Artificial Sequence
  MKO10018946_A_Frmpd3
  gRNA
ggaugugauggcgacucuac

SEQ ID NO: 18947 - RNA, 20 nt, Artificial Sequence
  MKO10018947_A_Frmpd3
  gRNA
uuucgaguacuuauacaucc

SEQ ID NO: 18948 - RNA, 20 nt, Artificial Sequence
  MKO10018948_A_Frmpd3
  gRNA
uauaaguacucgaaagcagc

SEQ ID NO: 18949 - RNA, 20 nt, Artificial Sequence
  MKO10018949_A_Frmpd4
  gRNA
guuacugaccgaacgaccac

SEQ ID NO: 18950 - RNA, 20 nt, Artificial Sequence
  MKO10018950_A_Frmpd4
  gRNA
agguggccagcccgaagacu

SEQ ID NO: 18951 - RNA, 20 nt, Artificial Sequence
  MKO10018951_A_Frmpd4
  gRNA
ugaaguagucacguccaucu

SEQ ID NO: 18952 - RNA, 20 nt, Artificial Sequence
  MKO10018952_A_Frrs1l
  gRNA
cacgggacgcuuaaaccugc

SEQ ID NO: 18953 - RNA, 20 nt, Artificial Sequence
  MKO10018953_A_Frrs1l
  gRNA
agaacaaccgcgucaccugc

SEQ ID NO: 18954 - RNA, 20 nt, Artificial Sequence
  MKO10018954_A_Frrs1l
  gRNA
ccacgucagcgccuaucauc

SEQ ID NO: 18955 - RNA, 20 nt, Artificial Sequence
  MKO10018955_A_Frrs1
  gRNA
acaaaccuguacaucgguac

SEQ ID NO: 18956 - RNA, 20 nt, Artificial Sequence
  MKO10018956_A_Frrs1
  gRNA
ucugaccuguaccgauguac

SEQ ID NO: 18957 - RNA, 20 nt, Artificial Sequence
  MKO10018957_A_Frrs1
  gRNA
aaacgacacauagccgucac

SEQ ID NO: 18958 - RNA, 20 nt, Artificial Sequence
  MKO10018958_A_Frs2
  gRNA
cgagauguaccgucgucucg

SEQ ID NO: 18959 - RNA, 20 nt, Artificial Sequence
  MKO10018959_A_Frs2
  gRNA
agucauagccguaucgucgu

SEQ ID NO: 18960 - RNA, 20 nt, Artificial Sequence
  MKO10018960_A_Frs2
  gRNA
uaccucugccuacgacgaua

SEQ ID NO: 18961 - RNA, 20 nt, Artificial Sequence
  MKO10018961_A_Frs3
  gRNA
gucccacugacccgccgacg

SEQ ID NO: 18962 - RNA, 20 nt, Artificial Sequence
  MKO10018962_A_Frs3
  gRNA
agucugcgacaccccucgcc

SEQ ID NO: 18963 - RNA, 20 nt, Artificial Sequence
  MKO10018963_A_Frs3
  gRNA
agucguagccauagcgccgc

SEQ ID NO: 18964 - RNA, 20 nt, Artificial Sequence
  MKO10018964_A_Fryl
  gRNA
ggcgucgguaccagucaaac

SEQ ID NO: 18965 - RNA, 20 nt, Artificial Sequence
  MKO10018965_A_Fryl
  gRNA
ccgcgagagagauuaccucc

SEQ ID NO: 18966 - RNA, 20 nt, Artificial Sequence
  MKO10018966_A_Fryl
  gRNA
gcccgaccccuuaguccaug

SEQ ID NO: 18967 - RNA, 20 nt, Artificial Sequence
  MKO10018967_A_Fry
  gRNA
accagucgaagaguguucgc

SEQ ID NO: 18968 - RNA, 20 nt, Artificial Sequence
  MKO10018968_A_Fry
  gRNA
uugacgaagucucugcagcg

SEQ ID NO: 18969 - RNA, 20 nt, Artificial Sequence
  MKO10018969_A_Fry
  gRNA
uuggacuuauugcuuguucg

SEQ ID NO: 18970 - RNA, 20 nt, Artificial Sequence
  MKO10018970_A_Frzb
  gRNA
ucaugaugugaccgccguug

SEQ ID NO: 18971 - RNA, 20 nt, Artificial Sequence
  MKO10018971_A_Frzb
  gRNA
cauccgggcuaaaguuaaag

SEQ ID NO: 18972 - RNA, 20 nt, Artificial Sequence
  MKO10018972_A_Frzb
  gRNA
uguccaguacuugaauccau

SEQ ID NO: 18973 - RNA, 20 nt, Artificial Sequence
  MKO10018973_A_Fsbp
  gRNA
agcugaaagcgacucgcuua

SEQ ID NO: 18974 - RNA, 20 nt, Artificial Sequence
  MKO10018974_A_Fsbp
  gRNA
gcaguuaacuauaaugcgau

SEQ ID NO: 18975 - RNA, 20 nt, Artificial Sequence
  MKO10018975_A_Fsbp
  gRNA
uaccaguucgcugcagguaa

SEQ ID NO: 18976 - RNA, 20 nt, Artificial Sequence
  MKO10018976_A_Fscb
  gRNA
uagcuccaugacuaagucga

SEQ ID NO: 18977 - RNA, 20 nt, Artificial Sequence
  MKO10018977_A_Fscb
  gRNA
uacuaugcaagaguuucgug

SEQ ID NO: 18978 - RNA, 20 nt, Artificial Sequence
  MKO10018978_A_Fscb
  gRNA
uuuaguagaaccugaucugc

SEQ ID NO: 18979 - RNA, 20 nt, Artificial Sequence
  MKO10018979_A_Fscn1
  gRNA
cggguucauuggcugccgca

SEQ ID NO: 18980 - RNA, 20 nt, Artificial Sequence
  MKO10018980_A_Fscn1
  gRNA
accgccccaucaucguguuc

SEQ ID NO: 18981 - RNA, 20 nt, Artificial Sequence
  MKO10018981_A_Fscn1
  gRNA
gcugcuacuuugacaucgag

SEQ ID NO: 18982 - RNA, 20 nt, Artificial Sequence
  MKO10018982_A_Fscn2
  gRNA
cgucgcugcacacgcuucca

SEQ ID NO: 18983 - RNA, 20 nt, Artificial Sequence
  MKO10018983_A_Fscn2
  gRNA
gauggcgccuaucagauuag

SEQ ID NO: 18984 - RNA, 20 nt, Artificial Sequence
  MKO10018984_A_Fscn2
  gRNA
auuccugaugcaaaucgacc

SEQ ID NO: 18985 - RNA, 20 nt, Artificial Sequence
  MKO10018985_A_Fscn3
  gRNA
ggguccauuugccguuucgg

SEQ ID NO: 18986 - RNA, 20 nt, Artificial Sequence
  MKO10018986_A_Fscn3
  gRNA
aggcggcacauuguauccgc

SEQ ID NO: 18987 - RNA, 20 nt, Artificial Sequence
  MKO10018987_A_Fscn3
  gRNA
ucgaccgcguaagacgagaa

SEQ ID NO: 18988 - RNA, 20 nt, Artificial Sequence
  MKO10018988_A_Fsd1l
  gRNA
ugauagcuuguacucuauau

SEQ ID NO: 18989 - RNA, 20 nt, Artificial Sequence
  MKO10018989_A_Fsd1l
  gRNA
aacuacuagaauuugcaaca

SEQ ID NO: 18990 - RNA, 20 nt, Artificial Sequence
  MKO10018990_A_Fsd1l
  gRNA
auaccuauccuugaucuguc

SEQ ID NO: 18991 - RNA, 20 nt, Artificial Sequence
  MKO10018991_A_Fsd1
  gRNA
ugguugcaccugcagcucgu

SEQ ID NO: 18992 - RNA, 20 nt, Artificial Sequence
  MKO10018992_A_Fsd1
  gRNA
gcucuccagggcucgugugc

SEQ ID NO: 18993 - RNA, 20 nt, Artificial Sequence
  MKO10018993_A_Fsd1
  gRNA
gcuccuccagaaccgacgug

SEQ ID NO: 18994 - RNA, 20 nt, Artificial Sequence
  MKO10018994_A_Fsd2
  gRNA
gcugaccaguuguccguaua

SEQ ID NO: 18995 - RNA, 20 nt, Artificial Sequence
  MKO10018995_A_Fsd2
  gRNA
ggaaaauuucgcuagccacc

SEQ ID NO: 18996 - RNA, 20 nt, Artificial Sequence
  MKO10018996_A_Fsd2
  gRNA
auagcauucauacuccucgc

SEQ ID NO: 18997 - RNA, 20 nt, Artificial Sequence
  MKO10018997_A_Fshb
  gRNA
uacgagaccguaagauugcc

SEQ ID NO: 18998 - RNA, 20 nt, Artificial Sequence
  MKO10018998_A_Fshb
  gRNA
gcaguagcccgcacaccaag

SEQ ID NO: 18999 - RNA, 20 nt, Artificial Sequence
  MKO10018999_A_Fshb
  gRNA
gcauaagcaucaauaccacu

SEQ ID NO: 19000 - RNA, 20 nt, Artificial Sequence
  MKO10019000_A_Fshr
  gRNA
cucuuacagauaucggagac

SEQ ID NO: 19001 - RNA, 20 nt, Artificial Sequence
  MKO10019001_A_Fshr
  gRNA
aagcuucgagucauuccaaa

SEQ ID NO: 19002 - RNA, 20 nt, Artificial Sequence
  MKO10019002_A_Fshr
  gRNA
ucuagguuaauauccaacac

SEQ ID NO: 19003 - RNA, 20 nt, Artificial Sequence
  MKO10019003_A_Fsip1
  gRNA
gucgucccaccugaaugcuc

SEQ ID NO: 19004 - RNA, 20 nt, Artificial Sequence
  MKO10019004_A_Fsip1
  gRNA
ggaauaguaaugaugcuaag

SEQ ID NO: 19005 - RNA, 20 nt, Artificial Sequence
  MKO10019005_A_Fsip1
  gRNA
agcauucgucucuucuaauu

SEQ ID NO: 19006 - RNA, 20 nt, Artificial Sequence
  MKO10019006_A_Fstl1
  gRNA
cuaaccgcgaugagcuccga

SEQ ID NO: 19007 - RNA, 20 nt, Artificial Sequence
  MKO10019007_A_Fstl1
  gRNA
ggcgccgucggagcucaucg

SEQ ID NO: 19008 - RNA, 20 nt, Artificial Sequence
  MKO10019008_A_Fstl1
  gRNA
agugcccaucauaaucaacc

SEQ ID NO: 19009 - RNA, 20 nt, Artificial Sequence
  MKO10019009_A_Fstl3
  gRNA
gacuugcgcgucauguaccg

SEQ ID NO: 19010 - RNA, 20 nt, Artificial Sequence
  MKO10019010_A_Fstl3
  gRNA
cgagugcgugcccaacugcg

SEQ ID NO: 19011 - RNA, 20 nt, Artificial Sequence
  MKO10019011_A_Fstl3
  gRNA
caggugacacgacgagaugu

SEQ ID NO: 19012 - RNA, 20 nt, Artificial Sequence
  MKO10019012_A_Fstl4
  gRNA
ugcuugcucaauaggacgac

SEQ ID NO: 19013 - RNA, 20 nt, Artificial Sequence
  MKO10019013_A_Fstl4
  gRNA
gccgacggcaaugggcaccu

SEQ ID NO: 19014 - RNA, 20 nt, Artificial Sequence
  MKO10019014_A_Fstl4
  gRNA
uauuauagucaucaaaucgc

SEQ ID NO: 19015 - RNA, 20 nt, Artificial Sequence
  MKO10019015_A_Fstl5
  gRNA
cuucaacgcugacaagcacc

SEQ ID NO: 19016 - RNA, 20 nt, Artificial Sequence
  MKO10019016_A_Fstl5
  gRNA
gcagucuucauugugaacga

SEQ ID NO: 19017 - RNA, 20 nt, Artificial Sequence
  MKO10019017_A_Fstl5
  gRNA
ugauugucaggugauuaaac

SEQ ID NO: 19018 - RNA, 20 nt, Artificial Sequence
  MKO10019018_A_Fst
  gRNA
cggcgggaaaaaaugccuau

SEQ ID NO: 19019 - RNA, 20 nt, Artificial Sequence
  MKO10019019_A_Fst
  gRNA
aagaguguugcagcaccggc

SEQ ID NO: 19020 - RNA, 20 nt, Artificial Sequence
  MKO10019020_A_Fst
  gRNA
auugucguucacauccuccu

SEQ ID NO: 19021 - RNA, 20 nt, Artificial Sequence
  MKO10019021_A_Fucd
  gRNA
gugcuguuggacgucgaugc

SEQ ID NO: 19022 - RNA, 20 nt, Artificial Sequence
  MKO10019022_A_Fucd
  gRNA
acauccagagcgcccauucg

SEQ ID NO: 19023 - RNA, 20 nt, Artificial Sequence
  MKO10019023_A_Fucd
  gRNA
ccgcacugucuacacuuucg

SEQ ID NO: 19024 - RNA, 20 nt, Artificial Sequence
  MKO10019024_A_Fth1
  gRNA
guaguucuggcgcacuugcg

SEQ ID NO: 19025 - RNA, 20 nt, Artificial Sequence
  MKO10019025_A_Fth1
  gRNA
cgugaccaacuuacgcaaga

SEQ ID NO: 19026 - RNA, 20 nt, Artificial Sequence
  MKO10019026_A_Fth1
  gRNA
ggcacccaucuugcguaagu

SEQ ID NO: 19027 - RNA, 20 nt, Artificial Sequence
  MKO10019027_A_Fthl17
  gRNA
acaggcugagcuugucaaag

SEQ ID NO: 19028 - RNA, 20 nt, Artificial Sequence
  MKO10019028_A_Fthl17
  gRNA
gaaugcagcagaacuaugac

SEQ ID NO: 19029 - RNA, 20 nt, Artificial Sequence
  MKO10019029_A_Fthl17
  gRNA
ugaacaucucugcacugguc

SEQ ID NO: 19030 - RNA, 20 nt, Artificial Sequence
  MKO10019030_A_Ftl1
  gRNA
uacuuacaugaggguccgcg

SEQ ID NO: 19031 - RNA, 20 nt, Artificial Sequence
  MKO10019031_A_Ftl1
  gRNA
cgcuucuuaccugcacaucc

SEQ ID NO: 19032 - RNA, 20 nt, Artificial Sequence
  MKO10019032_A_Ftl1
  gRNA
ugcacucuuccaggaugugc

SEQ ID NO: 19033 - RNA, 20 nt, Artificial Sequence
  MKO10019033_A_Ftmt
  gRNA
aagauauuccgcuaagcccg

SEQ ID NO: 19034 - RNA, 20 nt, Artificial Sequence
  MKO10019034_A_Ftmt
  gRNA
ccagaacuuucacccggacu

SEQ ID NO: 19035 - RNA, 20 nt, Artificial Sequence
  MKO10019035_A_Ftmt
  gRNA
cguaggaugcguaaagcucc

SEQ ID NO: 19036 - RNA, 20 nt, Artificial Sequence
  MKO10019036_A_Fto
  gRNA
gcuuguuucgggacguggug

SEQ ID NO: 19037 - RNA, 20 nt, Artificial Sequence
  MKO10019037_A_Fto
  gRNA
guguacagcuauagcugcga

SEQ ID NO: 19038 - RNA, 20 nt, Artificial Sequence
  MKO10019038_A_Fto
  gRNA
guuuaguuccacucaccgug

SEQ ID NO: 19039 - RNA, 20 nt, Artificial Sequence
  MKO10019039_A_Ftsj1
  gRNA
gagccccgucacacacuacu

SEQ ID NO: 19040 - RNA, 20 nt, Artificial Sequence
  MKO10019040_A_Ftsj1
  gRNA
gccaggugugauacagauac

SEQ ID NO: 19041 - RNA, 20 nt, Artificial Sequence
  MKO10019041_A_Ftsj1
  gRNA
gcugaccuaguaguguguga

SEQ ID NO: 19042 - RNA, 20 nt, Artificial Sequence
  MKO10019042_A_Ftsj2
  gRNA
ugaugagcuuaucgugaucg

SEQ ID NO: 19043 - RNA, 20 nt, Artificial Sequence
  MKO10019043_A_Ftsj2
  gRNA
agaaaaguugcucccgccaa

SEQ ID NO: 19044 - RNA, 20 nt, Artificial Sequence
  MKO10019044_A_Ftsj2
  gRNA
uaggcguuccccuuaagguu

SEQ ID NO: 19045 - RNA, 20 nt, Artificial Sequence
  MKO10019045_A_Ftsj3
  gRNA
auccgccaggcgcagcacac

SEQ ID NO: 19046 - RNA, 20 nt, Artificial Sequence
  MKO10019046_A_Ftsj3
  gRNA
acugaaagcggcgauugagc

SEQ ID NO: 19047 - RNA, 20 nt, Artificial Sequence
  MKO10019047_A_Ftsj3
  gRNA
uaccuugggaguaagcguca

SEQ ID NO: 19048 - RNA, 20 nt, Artificial Sequence
  MKO10019048_A_Fubp1
  gRNA
cuaaauccgaccaucccauc

SEQ ID NO: 19049 - RNA, 20 nt, Artificial Sequence
  MKO10019049_A_Fubp1
  gRNA
uaccuuugcugcugaugcau

SEQ ID NO: 19050 - RNA, 20 nt, Artificial Sequence
  MKO10019050_A_Fubp1
  gRNA
uaacuuaccuccaucuucua

SEQ ID NO: 19051 - RNA, 20 nt, Artificial Sequence
  MKO10019051_A_Fubp3
  gRNA
uacuccguauccguacacug

SEQ ID NO: 19052 - RNA, 20 nt, Artificial Sequence
  MKO10019052_A_Fubp3
  gRNA
gaccccucaguguacggaua

SEQ ID NO: 19053 - RNA, 20 nt, Artificial Sequence
  MKO10019053_A_Fubp3
  gRNA
gccacaguagguaaccaguu

SEQ ID NO: 19054 - RNA, 20 nt, Artificial Sequence
  MKO10019054_A_Fuca1
  gRNA
cuacaacgauagcccuguca

SEQ ID NO: 19055 - RNA, 20 nt, Artificial Sequence
  MKO10019055_A_Fuca1
  gRNA
gaccaugucgaccaucgcca

SEQ ID NO: 19056 - RNA, 20 nt, Artificial Sequence
  MKO10019056_A_Fuca1
  gRNA
acuccccgucggaccagauc

SEQ ID NO: 19057 - RNA, 20 nt, Artificial Sequence
  MKO10019057_A_Fuca2
  gRNA
ggggcgcgccagaucacuac

SEQ ID NO: 19058 - RNA, 20 nt, Artificial Sequence
  MKO10019058_A_Fuca2
  gRNA
caguagucaccaaugaucgc

SEQ ID NO: 19059 - RNA, 20 nt, Artificial Sequence
  MKO10019059_A_Fuca2
  gRNA
cccgacuccccagcgaucau

SEQ ID NO: 19060 - RNA, 20 nt, Artificial Sequence
  MKO10019060_A_Fuk
  gRNA
ccccagacucgagucggcag

SEQ ID NO: 19061 - RNA, 20 nt, Artificial Sequence
  MKO10019061_A_Fuk
  gRNA
gccaguaacaucguccccgc

SEQ ID NO: 19062 - RNA, 20 nt, Artificial Sequence
  MKO10019062_A_Fuk
  gRNA
ggcccugccacagucaucga

SEQ ID NO: 19063 - RNA, 20 nt, Artificial Sequence
  MKO10019063_A_Fundc1
  gRNA
ugacgaaucauacgaagugu

SEQ ID NO: 19064 - RNA, 20 nt, Artificial Sequence
  MKO10019064_A_Fundc1
  gRNA
aaagccucccacgaagccgc

SEQ ID NO: 19065 - RNA, 20 nt, Artificial Sequence
  MKO10019065_A_Fundc1
  gRNA
caaauacucgauuccaccag

SEQ ID NO: 19066 - RNA, 20 nt, Artificial Sequence
  MKO10019066_A_Fundc2
  gRNA
aaauuggcugcaacagcugu

SEQ ID NO: 19067 - RNA, 20 nt, Artificial Sequence
  MKO10019067_A_Fundc2
  gRNA
cacugguuucguauuccaga

SEQ ID NO: 19068 - RNA, 20 nt, Artificial Sequence
  MKO10019068_A_Fundc2
  gRNA
uuguagcuggcaaaccauac

SEQ ID NO: 19069 - RNA, 20 nt, Artificial Sequence
  MKO10019069_A_Fuom
  gRNA
uagggaaguucgcaucagca

SEQ ID NO: 19070 - RNA, 20 nt, Artificial Sequence
  MKO10019070_A_Fuom
  gRNA
gauucauaacgcuuccauau

SEQ ID NO: 19071 - RNA, 20 nt, Artificial Sequence
  MKO10019071_A_Fuom
  gRNA
ccucaccgggcuuuccacgu

SEQ ID NO: 19072 - RNA, 20 nt, Artificial Sequence
  MKO10019072_A_Furin
  gRNA
aagaaucaucccgaccuagc

SEQ ID NO: 19073 - RNA, 20 nt, Artificial Sequence
  MKO10019073_A_Furin
  gRNA
ucagcgagaccugaauguga

SEQ ID NO: 19074 - RNA, 20 nt, Artificial Sequence
  MKO10019074_A_Furin
  gRNA
cccugucgccucaccgcccg

SEQ ID NO: 19075 - RNA, 20 nt, Artificial Sequence
  MKO10019075_A_Fus
  gRNA
agcagcuaugguucuucuua

SEQ ID NO: 19076 - RNA, 20 nt, Artificial Sequence
  MKO10019076_A_Fus
  gRNA
cauaaccacuguaacucugu

SEQ ID NO: 19077 - RNA, 20 nt, Artificial Sequence
  MKO10019077_A_Fus
  gRNA
cucaccuuugaguugcuugu

SEQ ID NO: 19078 - RNA, 20 nt, Artificial Sequence
  MKO10019078_A_Fuu10
  gRNA
ggggucgugcccguguauua

SEQ ID NO: 19079 - RNA, 20 nt, Artificial Sequence
  MKO10019079_A_Fuu10
  gRNA
cucgcaacgaucucccacgu

SEQ ID NO: 19080 - RNA, 20 nt, Artificial Sequence
  MKO10019080_A_Fuu10
  gRNA
cccuggucaucggaugaugc

SEQ ID NO: 19081 - RNA, 20 nt, Artificial Sequence
  MKO10019081_A_Fuu11
  gRNA
gcaugagcucgcguacguau

SEQ ID NO: 19082 - RNA, 20 nt, Artificial Sequence
  MKO10019082_A_Fuu11
  gRNA
agagcaacggcgcguauccg

SEQ ID NO: 19083 - RNA, 20 nt, Artificial Sequence
  MKO10019083_A_Fuu11
  gRNA
gacaguucaugugcgacgac

SEQ ID NO: 19084 - RNA, 20 nt, Artificial Sequence
  MKO10019084_A_Fuu1
  gRNA
cuauacggagcccgcucaac

SEQ ID NO: 19085 - RNA, 20 nt, Artificial Sequence
  MKO10019085_A_Fuu1
  gRNA
gauagucuccacgacgcaca

SEQ ID NO: 19086 - RNA, 20 nt, Artificial Sequence
  MKO10019086_A_Fuu1
  gRNA
ugugcgucguggagacuauc

SEQ ID NO: 19087 - RNA, 20 nt, Artificial Sequence
  MKO10019087_A_Fuu2
  gRNA
gacgugguguuugcgggcaa

SEQ ID NO: 19088 - RNA, 20 nt, Artificial Sequence
  MKO10019088_A_Fuu2
  gRNA
guugauguucucccggcacc

SEQ ID NO: 19089 - RNA, 20 nt, Artificial Sequence
  MKO10019089_A_Fuu2
  gRNA
uuacaagcaacgguauggcc

SEQ ID NO: 19090 - RNA, 20 nt, Artificial Sequence
  MKO10019090_A_Fuu4
  gRNA
cgaagacauccgagucgguc

SEQ ID NO: 19091 - RNA, 20 nt, Artificial Sequence
  MKO10019091_A_Fuu4
  gRNA
gcgccuuauccgugcguucu

SEQ ID NO: 19092 - RNA, 20 nt, Artificial Sequence
  MKO10019092_A_Fuu4
  gRNA
ccucacggacgguggacgcg

SEQ ID NO: 19093 - RNA, 20 nt, Artificial Sequence
  MKO10019093_A_Fuu7
  gRNA
gaagcgguaccgggccaaag

SEQ ID NO: 19094 - RNA, 20 nt, Artificial Sequence
  MKO10019094_A_Fuu7
  gRNA
ggcgagaccggcuccgugug

SEQ ID NO: 19095 - RNA, 20 nt, Artificial Sequence
  MKO10019095_A_Fuu7
  gRNA
ccagccugccuguccacgcc

SEQ ID NO: 19096 - RNA, 20 nt, Artificial Sequence
  MKO10019096_A_Fuu8
  gRNA
cagaauuggcgcuaugcuac

SEQ ID NO: 19097 - RNA, 20 nt, Artificial Sequence
  MKO10019097_A_Fuu8
  gRNA
auuccaagaugaguguucgc

SEQ ID NO: 19098 - RNA, 20 nt, Artificial Sequence
  MKO10019098_A_Fuu8
  gRNA
aggggauuggcgugaaaaag

SEQ ID NO: 19099 - RNA, 20 nt, Artificial Sequence
  MKO10019099_A_Fuu9
  gRNA
ucacguauucuccgaaugcu

SEQ ID NO: 19100 - RNA, 20 nt, Artificial Sequence
  MKO10019100_A_Fuu9
  gRNA
cacggcgauaaguuagaguc

SEQ ID NO: 19101 - RNA, 20 nt, Artificial Sequence
  MKO10019101_A_Fuu9
  gRNA
gcaugugauucccaaaaccg

SEQ ID NO: 19102 - RNA, 20 nt, Artificial Sequence
  MKO10019102_A_Fuz
  gRNA
accugcauggcagaccccuc

SEQ ID NO: 19103 - RNA, 20 nt, Artificial Sequence
  MKO10019103_A_Fuz
  gRNA
uugaggagcugaccaauauc

SEQ ID NO: 19104 - RNA, 20 nt, Artificial Sequence
  MKO10019104_A_Fuz
  gRNA
cucaauggaguccacauguu

SEQ ID NO: 19105 - RNA, 20 nt, Artificial Sequence
  MKO10019105_A_Fv1
  gRNA
aaguuccuuaccgcucgaaa

SEQ ID NO: 19106 - RNA, 20 nt, Artificial Sequence
  MKO10019106_A_Fv1
  gRNA
uacccaucacgagagcuaug

SEQ ID NO: 19107 - RNA, 20 nt, Artificial Sequence
  MKO10019107_A_Fv1
  gRNA
uuauccggagagucauuauc

SEQ ID NO: 19108 - RNA, 20 nt, Artificial Sequence
  MKO10019108_A_Fxn
  gRNA
uagauccccgcccagcuuaa

SEQ ID NO: 19109 - RNA, 20 nt, Artificial Sequence
  MKO10019109_A_Fxn
  gRNA
caaaaagcagagcgucugcg

SEQ ID NO: 19110 - RNA, 20 nt, Artificial Sequence
  MKO10019110_A_Fxn
  gRNA
cgcagacaagcccuauaccc

SEQ ID NO: 19111 - RNA, 20 nt, Artificial Sequence
  MKO10019111_A_Fxr1
  gRNA
uggagguucgcggcuccaac

SEQ ID NO: 19112 - RNA, 20 nt, Artificial Sequence
  MKO10019112_A_Fxr1
  gRNA
gguaaucgcacuucauuaaa

SEQ ID NO: 19113 - RNA, 20 nt, Artificial Sequence
  MKO10019113_A_Fxr1
  gRNA
gcuaaaguucggaugaugaa

SEQ ID NO: 19114 - RNA, 20 nt, Artificial Sequence
  MKO10019114_A_Fxr2
  gRNA
cucccuucaucauccgcacc

SEQ ID NO: 19115 - RNA, 20 nt, Artificial Sequence
  MKO10019115_A_Fxr2
  gRNA
cgguagucggacauccccaa

SEQ ID NO: 19116 - RNA, 20 nt, Artificial Sequence
  MKO10019116_A_Fxr2
  gRNA
gcaaggggacugggauugac

SEQ ID NO: 19117 - RNA, 20 nt, Artificial Sequence
  MKO10019117_A_Fxyd1
  gRNA
aucggcggccucacuaucgc

SEQ ID NO: 19118 - RNA, 20 nt, Artificial Sequence
  MKO10019118_A_Fxyd1
  gRNA
aacuggggaacccgacgaag

SEQ ID NO: 19119 - RNA, 20 nt, Artificial Sequence
  MKO10019119_A_Fxyd1
  gRNA
uuccccucaccguaggugaa

SEQ ID NO: 19120 - RNA, 20 nt, Artificial Sequence
  MKO10019120_A_Fxyd2
  gRNA
gaccggcuuaccguacucga

SEQ ID NO: 19121 - RNA, 20 nt, Artificial Sequence
  MKO10019121_A_Fxyd2
  gRNA
aggccugaucuucgcgggcc

SEQ ID NO: 19122 - RNA, 20 nt, Artificial Sequence
  MKO10019122_A_Fxyd2
  gRNA
aggccaggcccgcgaagauc

SEQ ID NO: 19123 - RNA, 20 nt, Artificial Sequence
  MKO10019123_A_Fxyd3
  gRNA
cacaaaugagcccgccgacu

SEQ ID NO: 19124 - RNA, 20 nt, Artificial Sequence
  MKO10019124_A_Fxyd3
  gRNA
ucauaaggacuauaaugccc

SEQ ID NO: 19125 - RNA, 20 nt, Artificial Sequence
  MKO10019125_A_Fxyd3
  gRNA
cgacucacuuucagggucau

SEQ ID NO: 19126 - RNA, 20 nt, Artificial Sequence
  MKO10019126_A_Fxyd4
  gRNA
ggagggcuccugugcaucgc

SEQ ID NO: 19127 - RNA, 20 nt, Artificial Sequence
  MKO10019127_A_Fxyd4
  gRNA
uagguggcaagugcaaaugu

SEQ ID NO: 19128 - RNA, 20 nt, Artificial Sequence
  MKO10019128_A_Fxyd4
  gRNA
guacucaccaacugggucac

SEQ ID NO: 19129 - RNA, 20 nt, Artificial Sequence
  MKO10019129_A_Fxyd5
  gRNA
auccuacauugaacauccac

SEQ ID NO: 19130 - RNA, 20 nt, Artificial Sequence
  MKO10019130_A_Fxyd5
  gRNA
acuacucgugacaauguccc

SEQ ID NO: 19131 - RNA, 20 nt, Artificial Sequence
  MKO10019131_A_Fxyd5
  gRNA
ucgaauccagugucagaucc

SEQ ID NO: 19132 - RNA, 20 nt, Artificial Sequence
  MKO10019132_A_Fxyd6
  gRNA
accugggccucuucgucacc

SEQ ID NO: 19133 - RNA, 20 nt, Artificial Sequence
  MKO10019133_A_Fxyd6
  gRNA
gcucacucaccguaauagaa

SEQ ID NO: 19134 - RNA, 20 nt, Artificial Sequence
  MKO10019134_A_Fxyd6
  gRNA
gguuaccguuuguagugaug

SEQ ID NO: 19135 - RNA, 20 nt, Artificial Sequence
  MKO10019135_A_Fxyd7
  gRNA
ggagggcaguuccgacuuac

SEQ ID NO: 19136 - RNA, 20 nt, Artificial Sequence
  MKO10019136_A_Fxyd7
  gRNA
ggccacuaucauguucgugc

SEQ ID NO: 19137 - RNA, 20 nt, Artificial Sequence
  MKO10019137_A_Fxyd7
  gRNA
aacaugcaaauccuguaagu

SEQ ID NO: 19138 - RNA, 20 nt, Artificial Sequence
  MKO10019138_A_Fyb
  gRNA
cuggggacuggcggaugcgc

SEQ ID NO: 19139 - RNA, 20 nt, Artificial Sequence
  MKO10019139_A_Fyb
  gRNA
ggcagggaaguugucgagua

SEQ ID NO: 19140 - RNA, 20 nt, Artificial Sequence
  MKO10019140_A_Fyb
  gRNA
agguacuggaaaucuagaag

SEQ ID NO: 19141 - RNA, 20 nt, Artificial Sequence
  MKO10019141_A_Fyco1
  gRNA
augauggcauucgauuuguc

SEQ ID NO: 19142 - RNA, 20 nt, Artificial Sequence
  MKO10019142_A_Fyco1
  gRNA
caccaaagaguagcgaauga

SEQ ID NO: 19143 - RNA, 20 nt, Artificial Sequence
  MKO10019143_A_Fyco1
  gRNA
agccuucauucgcuacucuu

SEQ ID NO: 19144 - RNA, 20 nt, Artificial Sequence
  MKO10019144_A_Fyn
  gRNA
cgcgagagcgaaaccaccaa

SEQ ID NO: 19145 - RNA, 20 nt, Artificial Sequence
  MKO10019145_A_Fyn
  gRNA
aacuggagccacguaauugc

SEQ ID NO: 19146 - RNA, 20 nt, Artificial Sequence
  MKO10019146_A_Fyn
  gRNA
uacaacaacuuccacgcagc

SEQ ID NO: 19147 - RNA, 20 nt, Artificial Sequence
  MKO10019147_A_Fyuud1
  gRNA
accccagucaugaaccgguu

SEQ ID NO: 19148 - RNA, 20 nt, Artificial Sequence
  MKO10019148_A_Fyuud1
  gRNA
aaaacuaguuugagccguag

SEQ ID NO: 19149 - RNA, 20 nt, Artificial Sequence
  MKO10019149_A_Fyuud1
  gRNA
aggccggugauaacuccaua

SEQ ID NO: 19150 - RNA, 20 nt, Artificial Sequence
  MKO10019150_A_Fzd10
  gRNA
cgacgacaagcgcuucgcug

SEQ ID NO: 19151 - RNA, 20 nt, Artificial Sequence
  MKO10019151_A_Fzd10
  gRNA
ugaagcgcgaugggucgaug

SEQ ID NO: 19152 - RNA, 20 nt, Artificial Sequence
  MKO10019152_A_Fzd10
  gRNA
ucacgagaaccagcgcgagg

SEQ ID NO: 19153 - RNA, 20 nt, Artificial Sequence
  MKO10019153_A_Fzd1
  gRNA
ugguuaccgcggcggcuacc

SEQ ID NO: 19154 - RNA, 20 nt, Artificial Sequence
  MKO10019154_A_Fzd1
  gRNA
guacaugagcccguaaaccu

SEQ ID NO: 19155 - RNA, 20 nt, Artificial Sequence
  MKO10019155_A_Fzd1
  gRNA
caccccccggguagccgccg

SEQ ID NO: 19156 - RNA, 20 nt, Artificial Sequence
  MKO10019156_A_Fzd2
  gRNA
aucgacggcgaccugcugag

SEQ ID NO: 19157 - RNA, 20 nt, Artificial Sequence
  MKO10019157_A_Fzd2
  gRNA
ggcgcgguggugaguagcgc

SEQ ID NO: 19158 - RNA, 20 nt, Artificial Sequence
  MKO10019158_A_Fzd2
  gRNA
ugcgagcauuucccgcguca

SEQ ID NO: 19159 - RNA, 20 nt, Artificial Sequence
  MKO10019159_A_Fzd3
  gRNA
acgcugacacagccuacggc

SEQ ID NO: 19160 - RNA, 20 nt, Artificial Sequence
  MKO10019160_A_Fzd3
  gRNA
uuaaugcaucaacgucguag

SEQ ID NO: 19161 - RNA, 20 nt, Artificial Sequence
  MKO10019161_A_Fzd3
  gRNA
acaaucucgcacgugcagaa

SEQ ID NO: 19162 - RNA, 20 nt, Artificial Sequence
  MKO10019162_A_Fzd4
  gRNA
uucacgccgcucauccagua

SEQ ID NO: 19163 - RNA, 20 nt, Artificial Sequence
  MKO10019163_A_Fzd4
  gRNA
caugccaccgcacgggccga

SEQ ID NO: 19164 - RNA, 20 nt, Artificial Sequence
  MKO10019164_A_Fzd4
  gRNA
cagcucgugucccacuaagu

SEQ ID NO: 19165 - RNA, 20 nt, Artificial Sequence
  MKO10019165_A_Fzd5
  gRNA
cucacggcugcaagcgacgc

SEQ ID NO: 19166 - RNA, 20 nt, Artificial Sequence
  MKO10019166_A_Fzd5
  gRNA
guggcgaaugugcgcucguc

SEQ ID NO: 19167 - RNA, 20 nt, Artificial Sequence
  MKO10019167_A_Fzd5
  gRNA
ggccuuccuauacgugcgac

SEQ ID NO: 19168 - RNA, 20 nt, Artificial Sequence
  MKO10019168_A_Fzd6
  gRNA
uuucucacacaauuuccgac

SEQ ID NO: 19169 - RNA, 20 nt, Artificial Sequence
  MKO10019169_A_Fzd6
  gRNA
auuagcggcguuugcuucgu

SEQ ID NO: 19170 - RNA, 20 nt, Artificial Sequence
  MKO10019170_A_Fzd6
  gRNA
gggugauucucaccauuacg

SEQ ID NO: 19171 - RNA, 20 nt, Artificial Sequence
  MKO10019171_A_Fzd7
  gRNA
uucucgcagcgcaaccgcuc

SEQ ID NO: 19172 - RNA, 20 nt, Artificial Sequence
  MKO10019172_A_Fzd7
  gRNA
uggcuaccgcacgguggcgc

SEQ ID NO: 19173 - RNA, 20 nt, Artificial Sequence
  MKO10019173_A_Fzd7
  gRNA
cgagugcgacgccgccgugc

SEQ ID NO: 19174 - RNA, 20 nt, Artificial Sequence
  MKO10019174_A_Fzd8
  gRNA
cugaccgcaugcgcugcgau

SEQ ID NO: 19175 - RNA, 20 nt, Artificial Sequence
  MKO10019175_A_Fzd8
  gRNA
ucguacucgccgcgcgcgcc

SEQ ID NO: 19176 - RNA, 20 nt, Artificial Sequence
  MKO10019176_A_Fzd8
  gRNA
gcaaccgaucgcagcgcaug

SEQ ID NO: 19177 - RNA, 20 nt, Artificial Sequence
  MKO10019177_A_Fzd9
  gRNA
uucgauccggagcguggccg

SEQ ID NO: 19178 - RNA, 20 nt, Artificial Sequence
  MKO10019178_A_Fzd9
  gRNA
ggccacgcuccggaucgaag

SEQ ID NO: 19179 - RNA, 20 nt, Artificial Sequence
  MKO10019179_A_Fzd9
  gRNA
ccgccucgcccugcgacgug

SEQ ID NO: 19180 - RNA, 20 nt, Artificial Sequence
  MKO10019180_A_Fzr1
  gRNA
aagcgcucgaguccagauga

SEQ ID NO: 19181 - RNA, 20 nt, Artificial Sequence
  MKO10019181_A_Fzr1
  gRNA
agccgccgguccuccgucug

SEQ ID NO: 19182 - RNA, 20 nt, Artificial Sequence
  MKO10019182_A_Fzr1
  gRNA
ugucccccguuagcaacaaa

SEQ ID NO: 19183 - RNA, 20 nt, Artificial Sequence
  MKO10019183_A_G0s2
  gRNA
cagccgucugcgcgaccaag

SEQ ID NO: 19184 - RNA, 20 nt, Artificial Sequence
  MKO10019184_A_G0s2
  gRNA
ugugcuggcgcucuucggug

SEQ ID NO: 19185 - RNA, 20 nt, Artificial Sequence
  MKO10019185_A_G0s2
  gRNA
ggccuuaagaggcgugcugc

SEQ ID NO: 19186 - RNA, 20 nt, Artificial Sequence
  MKO10019186_A_G2e3
  gRNA
gugauaacuucguuuacacg

SEQ ID NO: 19187 - RNA, 20 nt, Artificial Sequence
  MKO10019187_A_G2e3
  gRNA
cgaaguuaucacuugccuug

SEQ ID NO: 19188 - RNA, 20 nt, Artificial Sequence
  MKO10019188_A_G2e3
  gRNA
gacuuaccaagcaguaguag

SEQ ID NO: 19189 - RNA, 20 nt, Artificial Sequence
  MKO10019189_A_G3bp1
  gRNA
auguucacaacgacaucuuc

SEQ ID NO: 19190 - RNA, 20 nt, Artificial Sequence
  MKO10019190_A_G3bp1
  gRNA
ccacaccaagauccgccacg

SEQ ID NO: 19191 - RNA, 20 nt, Artificial Sequence
  MKO10019191_A_G3bp1
  gRNA
cuuucuaugaucagacuguc

SEQ ID NO: 19192 - RNA, 20 nt, Artificial Sequence
  MKO10019192_A_G3bp2
  gRNA
aagcucccgaguauuugcac

SEQ ID NO: 19193 - RNA, 20 nt, Artificial Sequence
  MKO10019193_A_G3bp2
  gRNA
agcauccacaugacgaauuu

SEQ ID NO: 19194 - RNA, 20 nt, Artificial Sequence
  MKO10019194_A_G3bp2
  gRNA
ucauaccaaaauucgucaug

SEQ ID NO: 19195 - RNA, 20 nt, Artificial Sequence
  MKO10019195_A_G630090E17Rik
  gRNA
aauguugccgucuugcagaa

SEQ ID NO: 19196 - RNA, 20 nt, Artificial Sequence
  MKO10019196_A_G630090E17Rik
  gRNA
aaaauccgcggcaucugcug

SEQ ID NO: 19197 - RNA, 20 nt, Artificial Sequence
  MKO10019197_A_G630090E17Rik
  gRNA
cgccucagacuccguguucg

SEQ ID NO: 19198 - RNA, 20 nt, Artificial Sequence
  MKO10019198_A_G6b
  gRNA
gguccagaucagcguagugc

SEQ ID NO: 19199 - RNA, 20 nt, Artificial Sequence
  MKO10019199_A_G6b
  gRNA
gagccugcacuacgcugauc

SEQ ID NO: 19200 - RNA, 20 nt, Artificial Sequence
  MKO10019200_A_G6b
  gRNA
aagggcgccguccgaucuug

SEQ ID NO: 19201 - RNA, 20 nt, Artificial Sequence
  MKO10019201_A_G6pc2
  gRNA
caaugggcucaucgugcguc

SEQ ID NO: 19202 - RNA, 20 nt, Artificial Sequence
  MKO10019202_A_G6pc2
  gRNA
ccgugcccaucgccaaaaag

SEQ ID NO: 19203 - RNA, 20 nt, Artificial Sequence
  MKO10019203_A_G6pc2
  gRNA
caucaagaucccgacucacg

SEQ ID NO: 19204 - RNA, 20 nt, Artificial Sequence
  MKO10019204_A_G6pc3
  gRNA
guauuggacucucuuuacac

SEQ ID NO: 19205 - RNA, 20 nt, Artificial Sequence
  MKO10019205_A_G6pc3
  gRNA
aaagcuaagcucccgcucca

SEQ ID NO: 19206 - RNA, 20 nt, Artificial Sequence
  MKO10019206_A_G6pc3
  gRNA
ugaucacaggcgcagcucuu

SEQ ID NO: 19207 - RNA, 20 nt, Artificial Sequence
  MKO10019207_A_G6pc
  gRNA
ucuuaccggaauccauacgu

SEQ ID NO: 19208 - RNA, 20 nt, Artificial Sequence
  MKO10019208_A_G6pc
  gRNA
acgcccguauuggugggucc

SEQ ID NO: 19209 - RNA, 20 nt, Artificial Sequence
  MKO10019209_A_G6pc
  gRNA
ugaugagacaauacuuccgg

SEQ ID NO: 19210 - RNA, 20 nt, Artificial Sequence
  MKO10019210_A_G6pd2
  gRNA
acgcguaacuccuauguagu

SEQ ID NO: 19211 - RNA, 20 nt, Artificial Sequence
  MKO10019211_A_G6pd2
  gRNA
gccacggcugccauauacau

SEQ ID NO: 19212 - RNA, 20 nt, Artificial Sequence
  MKO10019212_A_G6pd2
  gRNA
cugcaauuccgagauauacc

SEQ ID NO: 19213 - RNA, 20 nt, Artificial Sequence
  MKO10019213_A_G6pdx
  gRNA
gucuuacgucugacucaugc

SEQ ID NO: 19214 - RNA, 20 nt, Artificial Sequence
  MKO10019214_A_G6pdx
  gRNA
gcccguaauuccuauguagc

SEQ ID NO: 19215 - RNA, 20 nt, Artificial Sequence
  MKO10019215_A_G6pdx
  gRNA
aggcuggaaccgcaucaucg

SEQ ID NO: 19216 - RNA, 20 nt, Artificial Sequence
  MKO10019216_A_Gaa
  gRNA
ccuuuggagugaucguucgu

SEQ ID NO: 19217 - RNA, 20 nt, Artificial Sequence
  MKO10019217_A_Gaa
  gRNA
ccuacgaacgaucacuccaa

SEQ ID NO: 19218 - RNA, 20 nt, Artificial Sequence
  MKO10019218_A_Gaa
  gRNA
gagggugauacgagcccagu

SEQ ID NO: 19219 - RNA, 20 nt, Artificial Sequence
  MKO10019219_A_Gab1
  gRNA
ugaaucgacgggugcuugug

SEQ ID NO: 19220 - RNA, 20 nt, Artificial Sequence
  MKO10019220_A_Gab1
  gRNA
uggcggaaugucguaacuga

SEQ ID NO: 19221 - RNA, 20 nt, Artificial Sequence
  MKO10019221_A_Gab1
  gRNA
aaagguguacagcuccccgu

SEQ ID NO: 19222 - RNA, 20 nt, Artificial Sequence
  MKO10019222_A_Gab2
  gRNA
cacuguaucaacggcgucgg

SEQ ID NO: 19223 - RNA, 20 nt, Artificial Sequence
  MKO10019223_A_Gab2
  gRNA
cuucggaguggccgaaugag

SEQ ID NO: 19224 - RNA, 20 nt, Artificial Sequence
  MKO10019224_A_Gab2
  gRNA
ccugauugaagccgcagauc

SEQ ID NO: 19225 - RNA, 20 nt, Artificial Sequence
  MKO10019225_A_Gab3
  gRNA
cgcaggcuuggcgcaaacgc

SEQ ID NO: 19226 - RNA, 20 nt, Artificial Sequence
  MKO10019226_A_Gab3
  gRNA
cucaggcggggccgcaugag

SEQ ID NO: 19227 - RNA, 20 nt, Artificial Sequence
  MKO10019227_A_Gab3
  gRNA
auccuguccaacugugagac

SEQ ID NO: 19228 - RNA, 20 nt, Artificial Sequence
  MKO10019228_A_Gabarapl1
  gRNA
aggaccaccccuucgaguau

SEQ ID NO: 19229 - RNA, 20 nt, Artificial Sequence
  MKO10019229_A_Gabarapl1
  gRNA
ccacucaccggcacccgguc

SEQ ID NO: 19230 - RNA, 20 nt, Artificial Sequence
  MKO10019230_A_Gabarapl1
  gRNA
cucuucuuaggacaaccacg

SEQ ID NO: 19231 - RNA, 20 nt, Artificial Sequence
  MKO10019231_A_Gabarapl2
  gRNA
ucucuuucaagccuaacuau

SEQ ID NO: 19232 - RNA, 20 nt, Artificial Sequence
  MKO10019232_A_Gabarapl2
  gRNA
cacacucaccggaacucggu

SEQ ID NO: 19233 - RNA, 20 nt, Artificial Sequence
  MKO10019233_A_Gabarapl2
  gRNA
acaagacagucccacagucc

SEQ ID NO: 19234 - RNA, 20 nt, Artificial Sequence
  MKO10019234_A_Gabarap
  gRNA
cacggagaugaauucgcuuc

SEQ ID NO: 19235 - RNA, 20 nt, Artificial Sequence
  MKO10019235_A_Gabarap
  gRNA
guccuuaccgggacccgguc

SEQ ID NO: 19236 - RNA, 20 nt, Artificial Sequence
  MKO10019236_A_Gabarap
  gRNA
guucgagaagcgccgcucug

SEQ ID NO: 19237 - RNA, 20 nt, Artificial Sequence
  MKO10019237_A_Gabbr1
  gRNA
ccccgacuaccuugcugucg

SEQ ID NO: 19238 - RNA, 20 nt, Artificial Sequence
  MKO10019238_A_Gabbr1
  gRNA
gccagauuauacauccgccc

SEQ ID NO: 19239 - RNA, 20 nt, Artificial Sequence
  MKO10019239_A_Gabbr1
  gRNA
cauauccguccaggagccgu

SEQ ID NO: 19240 - RNA, 20 nt, Artificial Sequence
  MKO10019240_A_Gabbr2
  gRNA
cucagacaacgcggugaacc

SEQ ID NO: 19241 - RNA, 20 nt, Artificial Sequence
  MKO10019241_A_Gabbr2
  gRNA
cguugucugagggcaccguc

SEQ ID NO: 19242 - RNA, 20 nt, Artificial Sequence
  MKO10019242_A_Gabbr2
  gRNA
gcccacaggggaacgacgug

SEQ ID NO: 19243 - RNA, 20 nt, Artificial Sequence
  MKO10019243_A_Gabpa
  gRNA
gaugcgcuucugcuuccgcg

SEQ ID NO: 19244 - RNA, 20 nt, Artificial Sequence
  MKO10019244_A_Gabpa
  gRNA
cgauccagaugcccaccacg

SEQ ID NO: 19245 - RNA, 20 nt, Artificial Sequence
  MKO10019245_A_Gabpa
  gRNA
cuccaaagaauuucuccccg

SEQ ID NO: 19246 - RNA, 20 nt, Artificial Sequence
  MKO10019246_A_Gabpb1
  gRNA
caucucuacuuacaccggcu

SEQ ID NO: 19247 - RNA, 20 nt, Artificial Sequence
  MKO10019247_A_Gabpb1
  gRNA
gcgaacuucaucaucuugac

SEQ ID NO: 19248 - RNA, 20 nt, Artificial Sequence
  MKO10019248_A_Gabpb1
  gRNA
ucuccggguugguguugauu

SEQ ID NO: 19249 - RNA, 20 nt, Artificial Sequence
  MKO10019249_A_Gabpb2
  gRNA
uaaguaacucgacgacaucc

SEQ ID NO: 19250 - RNA, 20 nt, Artificial Sequence
  MKO10019250_A_Gabpb2
  gRNA
agggacuccaucagucacga

SEQ ID NO: 19251 - RNA, 20 nt, Artificial Sequence
  MKO10019251_A_Gabpb2
  gRNA
acaucguggaacugcuuguu

SEQ ID NO: 19252 - RNA, 20 nt, Artificial Sequence
  MKO10019252_A_Gabra1
  gRNA
accauaucguggucugaaac

SEQ ID NO: 19253 - RNA, 20 nt, Artificial Sequence
  MKO10019253_A_Gabra1
  gRNA
guuuagccggagcacuguca

SEQ ID NO: 19254 - RNA, 20 nt, Artificial Sequence
  MKO10019254_A_Gabra1
  gRNA
accaguuucagaccacgaua

SEQ ID NO: 19255 - RNA, 20 nt, Artificial Sequence
  MKO10019255_A_Gabra2
  gRNA
ccauuaaauuguuaagucga

SEQ ID NO: 19256 - RNA, 20 nt, Artificial Sequence
  MKO10019256_A_Gabra2
  gRNA
aaacaagcugcuucgaaucc

SEQ ID NO: 19257 - RNA, 20 nt, Artificial Sequence
  MKO10019257_A_Gabra2
  gRNA
agccgaaugucccaugcacc

SEQ ID NO: 19258 - RNA, 20 nt, Artificial Sequence
  MKO10019258_A_Gabra3
  gRNA
auauuaucuguacuaucguc

SEQ ID NO: 19259 - RNA, 20 nt, Artificial Sequence
  MKO10019259_A_Gabra3
  gRNA
cgcugaaugccccaugcauu

SEQ ID NO: 19260 - RNA, 20 nt, Artificial Sequence
  MKO10019260_A_Gabra3
  gRNA
ggacccuccucuauacaaug

SEQ ID NO: 19261 - RNA, 20 nt, Artificial Sequence
  MKO10019261_A_Gabra4
  gRNA
ugcaguuuaaacgaaucccc

SEQ ID NO: 19262 - RNA, 20 nt, Artificial Sequence
  MKO10019262_A_Gabra4
  gRNA
uaauagacucaccauaagug

SEQ ID NO: 19263 - RNA, 20 nt, Artificial Sequence
  MKO10019263_A_Gabra4
  gRNA
uaugacaacaggcugcgucc

SEQ ID NO: 19264 - RNA, 20 nt, Artificial Sequence
  MKO10019264_A_Gabra5
  gRNA
uguuucagagcgaaucacgc

SEQ ID NO: 19265 - RNA, 20 nt, Artificial Sequence
  MKO10019265_A_Gabra5
  gRNA
ccguuguggaagaacguguc

SEQ ID NO: 19266 - RNA, 20 nt, Artificial Sequence
  MKO10019266_A_Gabra5
  gRNA
ucgucuuguacagaacuagu

SEQ ID NO: 19267 - RNA, 20 nt, Artificial Sequence
  MKO10019267_A_Gabra6
  gRNA
uaugacaaccgucuacggcc

SEQ ID NO: 19268 - RNA, 20 nt, Artificial Sequence
  MKO10019268_A_Gabra6
  gRNA
cucuuccgauuaaugcagaa

SEQ ID NO: 19269 - RNA, 20 nt, Artificial Sequence
  MKO10019269_A_Gabra6
  gRNA
caacucaccucaugguauag

SEQ ID NO: 19270 - RNA, 20 nt, Artificial Sequence
  MKO10019270_A_Gabrb1
  gRNA
auccgcaucccgacguccac

SEQ ID NO: 19271 - RNA, 20 nt, Artificial Sequence
  MKO10019271_A_Gabrb1
  gRNA
cgaugucgccagcauagaca

SEQ ID NO: 19272 - RNA, 20 nt, Artificial Sequence
  MKO10019272_A_Gabrb1
  gRNA
uuucacguaugacauguugc

SEQ ID NO: 19273 - RNA, 20 nt, Artificial Sequence
  MKO10019273_A_Gabrb2
  gRNA
ugacccuaguaauaugucgc

SEQ ID NO: 19274 - RNA, 20 nt, Artificial Sequence
  MKO10019274_A_Gabrb2
  gRNA
augauucgauugcaucccga

SEQ ID NO: 19275 - RNA, 20 nt, Artificial Sequence
  MKO10019275_A_Gabrb2
  gRNA
cgggaugcaaucgaaucaua

SEQ ID NO: 19276 - RNA, 20 nt, Artificial Sequence
  MKO10019276_A_Gabrb3
  gRNA
ccucacgcuugacaaucgag

SEQ ID NO: 19277 - RNA, 20 nt, Artificial Sequence
  MKO10019277_A_Gabrb3
  gRNA
gauaaaaggcucgccuauuc

SEQ ID NO: 19278 - RNA, 20 nt, Artificial Sequence
  MKO10019278_A_Gabrb3
  gRNA
auguucauccccacgcagac

SEQ ID NO: 19279 - RNA, 20 nt, Artificial Sequence
  MKO10019279_A_Gabrd
  gRNA
ggaccucgccaaguacccac

SEQ ID NO: 19280 - RNA, 20 nt, Artificial Sequence
  MKO10019280_A_Gabrd
  gRNA
uaugcccgaaacuuccgacc

SEQ ID NO: 19281 - RNA, 20 nt, Artificial Sequence
  MKO10019281_A_Gabrd
  gRNA
guccaggccuaaggucucgu

SEQ ID NO: 19282 - RNA, 20 nt, Artificial Sequence
  MKO10019282_A_Gabre
  gRNA
uaugaccauaaacugcgccc

SEQ ID NO: 19283 - RNA, 20 nt, Artificial Sequence
  MKO10019283_A_Gabre
  gRNA
acgaagacgcucaucauacc

SEQ ID NO: 19284 - RNA, 20 nt, Artificial Sequence
  MKO10019284_A_Gabre
  gRNA
auuaacucaccuccaaugcc

SEQ ID NO: 19285 - RNA, 20 nt, Artificial Sequence
  MKO10019285_A_Gabrg1
  gRNA
ucagacuuaccgccuauauc

SEQ ID NO: 19286 - RNA, 20 nt, Artificial Sequence
  MKO10019286_A_Gabrg1
  gRNA
caacgccuaaucgccugcug

SEQ ID NO: 19287 - RNA, 20 nt, Artificial Sequence
  MKO10019287_A_Gabrg1
  gRNA
caucacuccaaauccgcagc

SEQ ID NO: 19288 - RNA, 20 nt, Artificial Sequence
  MKO10019288_A_Gabrg2
  gRNA
ccaccauauugcuauucaac

SEQ ID NO: 19289 - RNA, 20 nt, Artificial Sequence
  MKO10019289_A_Gabrg2
  gRNA
aacaaacuucgaccugacau

SEQ ID NO: 19290 - RNA, 20 nt, Artificial Sequence
  MKO10019290_A_Gabrg2
  gRNA
cuccucauaccuccgauguc

SEQ ID NO: 19291 - RNA, 20 nt, Artificial Sequence
  MKO10019291_A_Gabrg3
  gRNA
ucauugugcuguugaaucga

SEQ ID NO: 19292 - RNA, 20 nt, Artificial Sequence
  MKO10019292_A_Gabrg3
  gRNA
auguccacaucgaucacagu

SEQ ID NO: 19293 - RNA, 20 nt, Artificial Sequence
  MKO10019293_A_Gabrg3
  gRNA
guugagaaucagcguuacau

SEQ ID NO: 19294 - RNA, 20 nt, Artificial Sequence
  MKO10019294_A_Gabrp
  gRNA
ggauaaccuaccaccgaaau

SEQ ID NO: 19295 - RNA, 20 nt, Artificial Sequence
  MKO10019295_A_Gabrp
  gRNA
acgcugccggagguauauag

SEQ ID NO: 19296 - RNA, 20 nt, Artificial Sequence
  MKO10019296_A_Gabrp
  gRNA
cugcucaccuaagugcguac

SEQ ID NO: 19297 - RNA, 20 nt, Artificial Sequence
  MKO10019297_A_Gabrq
  gRNA
ucucaugcauccgauaaucc

SEQ ID NO: 19298 - RNA, 20 nt, Artificial Sequence
  MKO10019298_A_Gabrq
  gRNA
ccauaucgcacugucccauc

SEQ ID NO: 19299 - RNA, 20 nt, Artificial Sequence
  MKO10019299_A_Gabrq
  gRNA
uauggcuuaccuccaaaauu

SEQ ID NO: 19300 - RNA, 20 nt, Artificial Sequence
  MKO10019300_A_Gabrr1
  gRNA
gugccucaaauauagcguca

SEQ ID NO: 19301 - RNA, 20 nt, Artificial Sequence
  MKO10019301_A_Gabrr1
  gRNA
ucaccaugacgcuauauuug

SEQ ID NO: 19302 - RNA, 20 nt, Artificial Sequence
  MKO10019302_A_Gabrr1
  gRNA
cacgacgaugcccacaagca

SEQ ID NO: 19303 - RNA, 20 nt, Artificial Sequence
  MKO10019303_A_Gabrr2
  gRNA
aggcuuuccuggccgcaucu

SEQ ID NO: 19304 - RNA, 20 nt, Artificial Sequence
  MKO10019304_A_Gabrr2
  gRNA
cgucccuccaguaaugccuc

SEQ ID NO: 19305 - RNA, 20 nt, Artificial Sequence
  MKO10019305_A_Gabrr2
  gRNA
augcugcgaguguuccccga

SEQ ID NO: 19306 - RNA, 20 nt, Artificial Sequence
  MKO10019306_A_Gabrr3
  gRNA
aagacgaccuuacuaaaguc

SEQ ID NO: 19307 - RNA, 20 nt, Artificial Sequence
  MKO10019307_A_Gabrr3
  gRNA
gauguagcauccgggaaacu

SEQ ID NO: 19308 - RNA, 20 nt, Artificial Sequence
  MKO10019308_A_Gabrr3
  gRNA
ugcugucgaugcuuucaacc

SEQ ID NO: 19309 - RNA, 20 nt, Artificial Sequence
  MKO10019309_A_Gad1
  gRNA
agaagucggucucugugcgc

SEQ ID NO: 19310 - RNA, 20 nt, Artificial Sequence
  MKO10019310_A_Gad1
  gRNA
ugcuccuagcguaugauacu

SEQ ID NO: 19311 - RNA, 20 nt, Artificial Sequence
  MKO10019311_A_Gad1
  gRNA
cugugcgaaccccguacuuc

SEQ ID NO: 19312 - RNA, 20 nt, Artificial Sequence
  MKO10019312_A_Gad2
  gRNA
uacgcguuucugcacgcaac

SEQ ID NO: 19313 - RNA, 20 nt, Artificial Sequence
  MKO10019313_A_Gad2
  gRNA
gcggcgggagcgugaccucg

SEQ ID NO: 19314 - RNA, 20 nt, Artificial Sequence
  MKO10019314_A_Gad2
  gRNA
caaaaguucacgggcggcau

SEQ ID NO: 19315 - RNA, 20 nt, Artificial Sequence
  MKO10019315_A_Gadd45a
  gRNA
cucguacacgccgaccguaa

SEQ ID NO: 19316 - RNA, 20 nt, Artificial Sequence
  MKO10019316_A_Gadd45a
  gRNA
cgcccgcaggauggacacgg

SEQ ID NO: 19317 - RNA, 20 nt, Artificial Sequence
  MKO10019317_A_Gadd45a
  gRNA
cguucucgcagcagaacgca

SEQ ID NO: 19318 - RNA, 20 nt, Artificial Sequence
  MKO10019318_A_Gadd45b
  gRNA
cauugucgcagcagaacgac

SEQ ID NO: 19319 - RNA, 20 nt, Artificial Sequence
  MKO10019319_A_Gadd45b
  gRNA
ccucaccguggggguguacg

SEQ ID NO: 19320 - RNA, 20 nt, Artificial Sequence
  MKO10019320_A_Gadd45b
  gRNA
cugcagggaccccgacagcg

SEQ ID NO: 19321 - RNA, 20 nt, Artificial Sequence
  MKO10019321_A_Gadd45gip1
  gRNA
agauggcggcgcucgcaaug

SEQ ID NO: 19322 - RNA, 20 nt, Artificial Sequence
  MKO10019322_A_Gadd45gip1
  gRNA
gccaugucguccgaacugcu

SEQ ID NO: 19323 - RNA, 20 nt, Artificial Sequence
  MKO10019323_A_Gadd45gip1
  gRNA
gcagcaacgaaagcgccuaa

SEQ ID NO: 19324 - RNA, 20 nt, Artificial Sequence
  MKO10019324_A_Gadd45g
  gRNA
cgacauugauaucgugcgcg

SEQ ID NO: 19325 - RNA, 20 nt, Artificial Sequence
  MKO10019325_A_Gadd45g
  gRNA
cgccagcggucagacagccc

SEQ ID NO: 19326 - RNA, 20 nt, Artificial Sequence
  MKO10019326_A_Gadd45g
  gRNA
cggcgcgccccccucuucgu

SEQ ID NO: 19327 - RNA, 20 nt, Artificial Sequence
  MKO10019327_A_Gadl1
  gRNA
ucugucuaguuauacguaug

SEQ ID NO: 19328 - RNA, 20 nt, Artificial Sequence
  MKO10019328_A_Gadl1
  gRNA
ccgccaaggaguaguaauca

SEQ ID NO: 19329 - RNA, 20 nt, Artificial Sequence
  MKO10019329_A_Gadl1
  gRNA
ucagcgccucuguuauaauc

SEQ ID NO: 19330 - RNA, 20 nt, Artificial Sequence
  MKO10019330_A_Gak
  gRNA
gcgauuacuauccaaugaag

SEQ ID NO: 19331 - RNA, 20 nt, Artificial Sequence
  MKO10019331_A_Gak
  gRNA
cugcuuacggagcuuuguaa

SEQ ID NO: 19332 - RNA, 20 nt, Artificial Sequence
  MKO10019332_A_Gak
  gRNA
cuuuacaaagcuccguaagc

SEQ ID NO: 19333 - RNA, 20 nt, Artificial Sequence
  MKO10019333_A_Gal3st1
  gRNA
agcuuucgggcgugagcgca

SEQ ID NO: 19334 - RNA, 20 nt, Artificial Sequence
  MKO10019334_A_Gal3st1
  gRNA
ggaguacuucgacgaauccc

SEQ ID NO: 19335 - RNA, 20 nt, Artificial Sequence
  MKO10019335_A_Gal3st1
  gRNA
auacaguggagguaccacau

SEQ ID NO: 19336 - RNA, 20 nt, Artificial Sequence
  MKO10019336_A_Gal3st2
  gRNA
uguccggcacuggugugcgc

SEQ ID NO: 19337 - RNA, 20 nt, Artificial Sequence
  MKO10019337_A_Gal3st2
  gRNA
acaccugacgccugagagcc

SEQ ID NO: 19338 - RNA, 20 nt, Artificial Sequence
  MKO10019338_A_Gal3st2
  gRNA
cuuaccucugugugccucuc

SEQ ID NO: 19339 - RNA, 20 nt, Artificial Sequence
  MKO10019339_A_Gal3st3
  gRNA
caccuggaacgcgcucgaug

SEQ ID NO: 19340 - RNA, 20 nt, Artificial Sequence
  MKO10019340_A_Gal3st3
  gRNA
gaaagucucgagcgacgcau

SEQ ID NO: 19341 - RNA, 20 nt, Artificial Sequence
  MKO10019341_A_Gal3st3
  gRNA
ugguggauugcugcaagcgc

SEQ ID NO: 19342 - RNA, 20 nt, Artificial Sequence
  MKO10019342_A_Gal3st4
  gRNA
cgcggauagaacaguauggc

SEQ ID NO: 19343 - RNA, 20 nt, Artificial Sequence
  MKO10019343_A_Gal3st4
  gRNA
cggccaaagacggugccuuu

SEQ ID NO: 19344 - RNA, 20 nt, Artificial Sequence
  MKO10019344_A_Gal3st4
  gRNA
gggcaaaacguagccccugc

SEQ ID NO: 19345 - RNA, 20 nt, Artificial Sequence
  MKO10019345_A_Galc
  gRNA
gcccuaucguucugaaauac

SEQ ID NO: 19346 - RNA, 20 nt, Artificial Sequence
  MKO10019346_A_Galc
  gRNA
ccccaauauaaucaaugucc

SEQ ID NO: 19347 - RNA, 20 nt, Artificial Sequence
  MKO10019347_A_Galc
  gRNA
ggguugccauggucauuccc

SEQ ID NO: 19348 - RNA, 20 nt, Artificial Sequence
  MKO10019348_A_Gale
  gRNA
gcgcaucggugaagauccuc

SEQ ID NO: 19349 - RNA, 20 nt, Artificial Sequence
  MKO10019349_A_Gale
  gRNA
ggaguugacaggccgcucug

SEQ ID NO: 19350 - RNA, 20 nt, Artificial Sequence
  MKO10019350_A_Gale
  gRNA
cuggggguucccguacacgg

SEQ ID NO: 19351 - RNA, 20 nt, Artificial Sequence
  MKO10019351_A_Galk1
  gRNA
ccagcgaguacccgguucgu

SEQ ID NO: 19352 - RNA, 20 nt, Artificial Sequence
  MKO10019352_A_Galk1
  gRNA
ggaccaacucaucgcgcugc

SEQ ID NO: 19353 - RNA, 20 nt, Artificial Sequence
  MKO10019353_A_Galk1
  gRNA
gccccagcagcgcgaugagu

SEQ ID NO: 19354 - RNA, 20 nt, Artificial Sequence
  MKO10019354_A_Galk2
  gRNA
uggaaauauacccccgaguu

SEQ ID NO: 19355 - RNA, 20 nt, Artificial Sequence
  MKO10019355_A_Galk2
  gRNA
ucgacaagaccaaaccucua

SEQ ID NO: 19356 - RNA, 20 nt, Artificial Sequence
  MKO10019356_A_Galk2
  gRNA
agcuggagaggcccgaacuc

SEQ ID NO: 19357 - RNA, 20 nt, Artificial Sequence
  MKO10019357_A_Galm
  gRNA
cggauucacgggguuugaua

SEQ ID NO: 19358 - RNA, 20 nt, Artificial Sequence
  MKO10019358_A_Galm
  gRNA
agcagaugcauauuugcccg

SEQ ID NO: 19359 - RNA, 20 nt, Artificial Sequence
  MKO10019359_A_Galm
  gRNA
caaaccccgugaauccgcca

SEQ ID NO: 19360 - RNA, 20 nt, Artificial Sequence
  MKO10019360_A_Galns
  gRNA
aggcuauaccaacaagaucg

SEQ ID NO: 19361 - RNA, 20 nt, Artificial Sequence
  MKO10019361_A_Galns
  gRNA
accauuccuugcaugagcgu

SEQ ID NO: 19362 - RNA, 20 nt, Artificial Sequence
  MKO10019362_A_Galns
  gRNA
gagagaccccaaauuuagac

SEQ ID NO: 19363 - RNA, 20 nt, Artificial Sequence
  MKO10019363_A_Galnt10
  gRNA
uaucggggagagagcgauuc

SEQ ID NO: 19364 - RNA, 20 nt, Artificial Sequence
  MKO10019364_A_Galnt10
  gRNA
cuccggaccaagaaacggga

SEQ ID NO: 19365 - RNA, 20 nt, Artificial Sequence
  MKO10019365_A_Galnt10
  gRNA
ccugauaaggacccgaaugc

SEQ ID NO: 19366 - RNA, 20 nt, Artificial Sequence
  MKO10019366_A_Galnt11
  gRNA
acggcgccacggccccaaua

SEQ ID NO: 19367 - RNA, 20 nt, Artificial Sequence
  MKO10019367_A_Galnt11
  gRNA
uugauccgaggacgaaugau

SEQ ID NO: 19368 - RNA, 20 nt, Artificial Sequence
  MKO10019368_A_Galnt11
  gRNA
uugaaaccuccccgaacuac

SEQ ID NO: 19369 - RNA, 20 nt, Artificial Sequence
  MKO10019369_A_Galnt12
  gRNA
ugcgccugauccgugcuagc

SEQ ID NO: 19370 - RNA, 20 nt, Artificial Sequence
  MKO10019370_A_Galnt12
  gRNA
ccaguagccgggcucgcacu

SEQ ID NO: 19371 - RNA, 20 nt, Artificial Sequence
  MKO10019371_A_Galnt12
  gRNA
cgcagauuggcggcuuugac

SEQ ID NO: 19372 - RNA, 20 nt, Artificial Sequence
  MKO10019372_A_Galnt13
  gRNA
uuaauacgcgcccgucuccg

SEQ ID NO: 19373 - RNA, 20 nt, Artificial Sequence
  MKO10019373_A_Galnt13
  gRNA
cgcacuuaaccgaagucugc

SEQ ID NO: 19374 - RNA, 20 nt, Artificial Sequence
  MKO10019374_A_Galnt13
  gRNA
aagugccagugaagauuauc

SEQ ID NO: 19375 - RNA, 20 nt, Artificial Sequence
  MKO10019375_A_Galnt14
  gRNA
gugagcggauaucgagcaau

SEQ ID NO: 19376 - RNA, 20 nt, Artificial Sequence
  MKO10019376_A_Galnt14
  gRNA
auauccgcucacucucccgu

SEQ ID NO: 19377 - RNA, 20 nt, Artificial Sequence
  MKO10019377_A_Galnt14
  gRNA
cucuacucagaaccauccgc

SEQ ID NO: 19378 - RNA, 20 nt, Artificial Sequence
  MKO10019378_A_Galnt15
  gRNA
cagucauagacgugauugac

SEQ ID NO: 19379 - RNA, 20 nt, Artificial Sequence
  MKO10019379_A_Galnt15
  gRNA
uccgcauccaagcugcaucg

SEQ ID NO: 19380 - RNA, 20 nt, Artificial Sequence
  MKO10019380_A_Galnt15
  gRNA
gaucguaugcuccgguguuu

SEQ ID NO: 19381 - RNA, 20 nt, Artificial Sequence
  MKO10019381_A_Galnt16
  gRNA
cuucccguuugucauugcga

SEQ ID NO: 19382 - RNA, 20 nt, Artificial Sequence
  MKO10019382_A_Galnt16
  gRNA
ugagcucagaccgacccauc

SEQ ID NO: 19383 - RNA, 20 nt, Artificial Sequence
  MKO10019383_A_Galnt16
  gRNA
cagguccgaagaauaggaca

SEQ ID NO: 19384 - RNA, 20 nt, Artificial Sequence
  MKO10019384_A_Galnt18
  gRNA
ggcacuguucgaugcccacg

SEQ ID NO: 19385 - RNA, 20 nt, Artificial Sequence
  MKO10019385_A_Galnt18
  gRNA
aggcguuguagccguaguac

SEQ ID NO: 19386 - RNA, 20 nt, Artificial Sequence
  MKO10019386_A_Galnt18
  gRNA
ucuggcaggggccggucgag

SEQ ID NO: 19387 - RNA, 20 nt, Artificial Sequence
  MKO10019387_A_Galnt1
  gRNA
auucgaauggagcagcgcuc

SEQ ID NO: 19388 - RNA, 20 nt, Artificial Sequence
  MKO10019388_A_Galnt1
  gRNA
ucacugaucacgucgaugau

SEQ ID NO: 19389 - RNA, 20 nt, Artificial Sequence
  MKO10019389_A_Galnt1
  gRNA
accagucgucauuccgaaag

SEQ ID NO: 19390 - RNA, 20 nt, Artificial Sequence
  MKO10019390_A_Galnt2
  gRNA
uugaacuuguugcgugcgua

SEQ ID NO: 19391 - RNA, 20 nt, Artificial Sequence
  MKO10019391_A_Galnt2
  gRNA
uaccgccaacguaugccucc

SEQ ID NO: 19392 - RNA, 20 nt, Artificial Sequence
  MKO10019392_A_Galnt2
  gRNA
cccugcugcggacggugguc

SEQ ID NO: 19393 - RNA, 20 nt, Artificial Sequence
  MKO10019393_A_Galnt3
  gRNA
ggaaaggccugaucaccgcg

SEQ ID NO: 19394 - RNA, 20 nt, Artificial Sequence
  MKO10019394_A_Galnt3
  gRNA
agcugccccuagcaaccgcg

SEQ ID NO: 19395 - RNA, 20 nt, Artificial Sequence
  MKO10019395_A_Galnt3
  gRNA
ugcgaugucuggacucacca

SEQ ID NO: 19396 - RNA, 20 nt, Artificial Sequence
  MKO10019396_A_Galnt4
  gRNA
aacgaaagauuagcccccgu

SEQ ID NO: 19397 - RNA, 20 nt, Artificial Sequence
  MKO10019397_A_Galnt4
  gRNA
cugguccgggcccgucuaau

SEQ ID NO: 19398 - RNA, 20 nt, Artificial Sequence
  MKO10019398_A_Galnt4
  gRNA
ccgcccgcgcgguauucugu

SEQ ID NO: 19399 - RNA, 20 nt, Artificial Sequence
  MKO10019399_A_Galnt5
  gRNA
uccaaagaggugucuucacc

SEQ ID NO: 19400 - RNA, 20 nt, Artificial Sequence
  MKO10019400_A_Galnt5
  gRNA
gccaggugaagacaccucuu

SEQ ID NO: 19401 - RNA, 20 nt, Artificial Sequence
  MKO10019401_A_Galnt5
  gRNA
agaauaccucaaagcugauu

SEQ ID NO: 19402 - RNA, 20 nt, Artificial Sequence
  MKO10019402_A_Galnt6
  gRNA
acagccggggcaacuucgac

SEQ ID NO: 19403 - RNA, 20 nt, Artificial Sequence
  MKO10019403_A_Galnt6
  gRNA
agucgaaguugccccggcug

SEQ ID NO: 19404 - RNA, 20 nt, Artificial Sequence
  MKO10019404_A_Galnt6
  gRNA
gguaccgaugugcucaaagu

SEQ ID NO: 19405 - RNA, 20 nt, Artificial Sequence
  MKO10019405_A_Galnt7
  gRNA
ggcguaagucauugacgcug

SEQ ID NO: 19406 - RNA, 20 nt, Artificial Sequence
  MKO10019406_A_Galnt7
  gRNA
cauuucgaaauaccuucacg

SEQ ID NO: 19407 - RNA, 20 nt, Artificial Sequence
  MKO10019407_A_Galnt7
  gRNA
cgugauccugugcuacgccc

SEQ ID NO: 19408 - RNA, 20 nt, Artificial Sequence
  MKO10019408_A_Galnt9
  gRNA
gcgguaccucuccguacgug

SEQ ID NO: 19409 - RNA, 20 nt, Artificial Sequence
  MKO10019409_A_Galnt9
  gRNA
acgccaaacguaaugcacua

SEQ ID NO: 19410 - RNA, 20 nt, Artificial Sequence
  MKO10019410_A_Galnt9
  gRNA
cgcccuuagugcauuacguu

SEQ ID NO: 19411 - RNA, 20 nt, Artificial Sequence
  MKO10019411_A_Galntl5
  gRNA
ucuuaccggauagguguacu

SEQ ID NO: 19412 - RNA, 20 nt, Artificial Sequence
  MKO10019412_A_Galntl5
  gRNA
auccauaucgccucaauccu

SEQ ID NO: 19413 - RNA, 20 nt, Artificial Sequence
  MKO10019413_A_Galntl5
  gRNA
ucaaaagcuccccuuacaau

SEQ ID NO: 19414 - RNA, 20 nt, Artificial Sequence
  MKO10019414_A_Galntl6
  gRNA
guccaaccuucguugugaaa

SEQ ID NO: 19415 - RNA, 20 nt, Artificial Sequence
  MKO10019415_A_Galntl6
  gRNA
ucucauccggacccgacucc

SEQ ID NO: 19416 - RNA, 20 nt, Artificial Sequence
  MKO10019416_A_Galntl6
  gRNA
gcaacaauauugcucuagag

SEQ ID NO: 19417 - RNA, 20 nt, Artificial Sequence
  MKO10019417_A_Galp
  gRNA
acguuugucaaagcgaauac

SEQ ID NO: 19418 - RNA, 20 nt, Artificial Sequence
  MKO10019418_A_Galp
  gRNA
caauagugcugguuaccucc

SEQ ID NO: 19419 - RNA, 20 nt, Artificial Sequence
  MKO10019419_A_Galp
  gRNA
acucaccaaugaucuuccac

SEQ ID NO: 19420 - RNA, 20 nt, Artificial Sequence
  MKO10019420_A_Galr1
  gRNA
uccacgccaaugccgaagag

SEQ ID NO: 19421 - RNA, 20 nt, Artificial Sequence
  MKO10019421_A_Galr1
  gRNA
gcacgcccaucgcgaaaauc

SEQ ID NO: 19422 - RNA, 20 nt, Artificial Sequence
  MKO10019422_A_Galr1
  gRNA
acacuugcuuguacgccuuc

SEQ ID NO: 19423 - RNA, 20 nt, Artificial Sequence
  MKO10019423_A_Galr2
  gRNA
cgcaccacgacgucgcgcca

SEQ ID NO: 19424 - RNA, 20 nt, Artificial Sequence
  MKO10019424_A_Galr2
  gRNA
gacacggaugaucgucaucg

SEQ ID NO: 19425 - RNA, 20 nt, Artificial Sequence
  MKO10019425_A_Galr2
  gRNA
agccaaacacccaaucgucc

SEQ ID NO: 19426 - RNA, 20 nt, Artificial Sequence
  MKO10019426_A_Galr3
  gRNA
gcaccgugccguaguagcuu

SEQ ID NO: 19427 - RNA, 20 nt, Artificial Sequence
  MKO10019427_A_Galr3
  gRNA
ggcuccauacuccaaccgcg

SEQ ID NO: 19428 - RNA, 20 nt, Artificial Sequence
  MKO10019428_A_Galr3
  gRNA
ccaguguguagauggccgcc

SEQ ID NO: 19429 - RNA, 20 nt, Artificial Sequence
  MKO10019429_A_Galt
  gRNA
gcggguuguagcgaauaugc

SEQ ID NO: 19430 - RNA, 20 nt, Artificial Sequence
  MKO10019430_A_Galt
  gRNA
uauucgcuacaacccgcucc

SEQ ID NO: 19431 - RNA, 20 nt, Artificial Sequence
  MKO10019431_A_Galt
  gRNA
gcgucacauccgaccagggg

SEQ ID NO: 19432 - RNA, 20 nt, Artificial Sequence
  MKO10019432_A_Gal
  gRNA
caacauuguccgcacuauaa

SEQ ID NO: 19433 - RNA, 20 nt, Artificial Sequence
  MKO10019433_A_Gal
  gRNA
aucacucacgugggcccaga

SEQ ID NO: 19434 - RNA, 20 nt, Artificial Sequence
  MKO10019434_A_Gal
  gRNA
agaucauuuagcgacaagca

SEQ ID NO: 19435 - RNA, 20 nt, Artificial Sequence
  MKO10019435_A_Gamt
  gRNA
ccuccuagggggccgggucu

SEQ ID NO: 19436 - RNA, 20 nt, Artificial Sequence
  MKO10019436_A_Gamt
  gRNA
cacguacccgcugucugaag

SEQ ID NO: 19437 - RNA, 20 nt, Artificial Sequence
  MKO10019437_A_Gamt
  gRNA
ccuacugcaaccucacgucc

SEQ ID NO: 19438 - RNA, 20 nt, Artificial Sequence
  MKO10019438_A_Ganab
  gRNA
cacucgguaucgaggccgcc

SEQ ID NO: 19439 - RNA, 20 nt, Artificial Sequence
  MKO10019439_A_Ganab
  gRNA
acagacggcagcgaagcauu

SEQ ID NO: 19440 - RNA, 20 nt, Artificial Sequence
  MKO10019440_A_Ganab
  gRNA
ggaggcuucgaucuucuagc

SEQ ID NO: 19441 - RNA, 20 nt, Artificial Sequence
  MKO10019441_A_Ganc
  gRNA
cgauuugcugucgaagaacg

SEQ ID NO: 19442 - RNA, 20 nt, Artificial Sequence
  MKO10019442_A_Ganc
  gRNA
gacagcaaaucgaucuugaa

SEQ ID NO: 19443 - RNA, 20 nt, Artificial Sequence
  MKO10019443_A_Ganc
  gRNA
agcuugcuguugaugacguc

SEQ ID NO: 19444 - RNA, 20 nt, Artificial Sequence
  MKO10019444_A_Gan
  gRNA
uuugacgauuucucgcacca

SEQ ID NO: 19445 - RNA, 20 nt, Artificial Sequence
  MKO10019445_A_Gan
  gRNA
cauucagcaucugcucgcgc

SEQ ID NO: 19446 - RNA, 20 nt, Artificial Sequence
  MKO10019446_A_Gan
  gRNA
ccugcaccacgugcauuacc

SEQ ID NO: 19447 - RNA, 20 nt, Artificial Sequence
  MKO10019447_A_Gap43
  gRNA
gcuuccguggacacauaaca

SEQ ID NO: 19448 - RNA, 20 nt, Artificial Sequence
  MKO10019448_A_Gap43
  gRNA
gccuuaugagccuuaucuuc

SEQ ID NO: 19449 - RNA, 20 nt, Artificial Sequence
  MKO10019449_A_Gap43
  gRNA
uguagacgaagccaaaccua

SEQ ID NO: 19450 - RNA, 20 nt, Artificial Sequence
  MKO10019450_A_Gapdhs
  gRNA
gccuguacacuccaccacgu

SEQ ID NO: 19451 - RNA, 20 nt, Artificial Sequence
  MKO10019451_A_Gapdhs
  gRNA
aggcgucuaucuguccaucg

SEQ ID NO: 19452 - RNA, 20 nt, Artificial Sequence
  MKO10019452_A_Gapdhs
  gRNA
gguggauccucaaccuuggg

SEQ ID NO: 19453 - RNA, 20 nt, Artificial Sequence
  MKO10019453_A_Gapdh
  gRNA
ucuuucagauuuggccguau

SEQ ID NO: 19454 - RNA, 20 nt, Artificial Sequence
  MKO10019454_A_Gapdh
  gRNA
acuuaccccggccuucucca

SEQ ID NO: 19455 - RNA, 20 nt, Artificial Sequence
  MKO10019455_A_Gapdh
  gRNA
ccuuaaacaggcccacuuga

SEQ ID NO: 19456 - RNA, 20 nt, Artificial Sequence
  MKO10019456_A_Gapt
  gRNA
cacgcagccgucuaaucucg

SEQ ID NO: 19457 - RNA, 20 nt, Artificial Sequence
  MKO10019457_A_Gapt
  gRNA
acguguuccucgagauuaga

SEQ ID NO: 19458 - RNA, 20 nt, Artificial Sequence
  MKO10019458_A_Gapt
  gRNA
uugaaaagcuagucgcaauc

SEQ ID NO: 19459 - RNA, 20 nt, Artificial Sequence
  MKO10019459_A_Gapvd1
  gRNA
aaucaugcagcuccucguag

SEQ ID NO: 19460 - RNA, 20 nt, Artificial Sequence
  MKO10019460_A_Gapvd1
  gRNA
gcucaugcaaaguagccgua

SEQ ID NO: 19461 - RNA, 20 nt, Artificial Sequence
  MKO10019461_A_Gapvd1
  gRNA
uuacagucagcuuauuacuc

SEQ ID NO: 19462 - RNA, 20 nt, Artificial Sequence
  MKO10019462_A_Gar1
  gRNA
acacacgaugucaucuucac

SEQ ID NO: 19463 - RNA, 20 nt, Artificial Sequence
  MKO10019463_A_Gar1
  gRNA
ugcagcggcagcagcuugua

SEQ ID NO: 19464 - RNA, 20 nt, Artificial Sequence
  MKO10019464_A_Gar1
  gRNA
agaggagguggcggauuccg

SEQ ID NO: 19465 - RNA, 20 nt, Artificial Sequence
  MKO10019465_A_Gareml
  gRNA
cgcaccaggcgcucgacgcg

SEQ ID NO: 19466 - RNA, 20 nt, Artificial Sequence
  MKO10019466_A_Gareml
  gRNA
cugccgcgagcgcuucgauc

SEQ ID NO: 19467 - RNA, 20 nt, Artificial Sequence
  MKO10019467_A_Gareml
  gRNA
cccugaccgaaucuucguga

SEQ ID NO: 19468 - RNA, 20 nt, Artificial Sequence
  MKO10019468_A_Garem
  gRNA
auuuagcacccgaagucccc

SEQ ID NO: 19469 - RNA, 20 nt, Artificial Sequence
  MKO10019469_A_Garem
  gRNA
uccugaacguguguacguca

SEQ ID NO: 19470 - RNA, 20 nt, Artificial Sequence
  MKO10019470_A_Garem
  gRNA
cggacuggcuugacuguucg

SEQ ID NO: 19471 - RNA, 20 nt, Artificial Sequence
  MKO10019471_A_Garnl3
  gRNA
cucaucucuagugaugccga

SEQ ID NO: 19472 - RNA, 20 nt, Artificial Sequence
  MKO10019472_A_Garnl3
  gRNA
guagacguggggauuucagu

SEQ ID NO: 19473 - RNA, 20 nt, Artificial Sequence
  MKO10019473_A_Garnl3
  gRNA
caaagaauugcacgauacug

SEQ ID NO: 19474 - RNA, 20 nt, Artificial Sequence
  MKO10019474_A_Gars
  gRNA
cgagcagaccaccuguugaa

SEQ ID NO: 19475 - RNA, 20 nt, Artificial Sequence
  MKO10019475_A_Gars
  gRNA
agucagcaaauuugucuacg

SEQ ID NO: 19476 - RNA, 20 nt, Artificial Sequence
  MKO10019476_A_Gars
  gRNA
gcauggugcagucaaucucc

SEQ ID NO: 19477 - RNA, 20 nt, Artificial Sequence
  MKO10019477_A_Gart
  gRNA
ucugcaggaguacgaugcuu

SEQ ID NO: 19478 - RNA, 20 nt, Artificial Sequence
  MKO10019478_A_Gart
  gRNA
aagauugaacucguaguugu

SEQ ID NO: 19479 - RNA, 20 nt, Artificial Sequence
  MKO10019479_A_Gart
  gRNA
aaagcaucguacuccugcag

SEQ ID NO: 19480 - RNA, 20 nt, Artificial Sequence
  MKO10019480_A_Gas1
  gRNA
guccgaguuccgcgcacuuc

SEQ ID NO: 19481 - RNA, 20 nt, Artificial Sequence
  MKO10019481_A_Gas1
  gRNA
acugggcgaaucgaagcgcc

SEQ ID NO: 19482 - RNA, 20 nt, Artificial Sequence
  MKO10019482_A_Gas1
  gRNA
ccgccgcgcugcgcuagcac

SEQ ID NO: 19483 - RNA, 20 nt, Artificial Sequence
  MKO10019483_A_Gas2l1
  gRNA
gcgacccuuccgauccagug

SEQ ID NO: 19484 - RNA, 20 nt, Artificial Sequence
  MKO10019484_A_Gas2l1
  gRNA
ggccaaggcgcgccccacgc

SEQ ID NO: 19485 - RNA, 20 nt, Artificial Sequence
  MKO10019485_A_Gas2l1
  gRNA
ccgggacuuucuccccgcag

SEQ ID NO: 19486 - RNA, 20 nt, Artificial Sequence
  MKO10019486_A_Gas2l2
  gRNA
ccacgcucuucacguucuug

SEQ ID NO: 19487 - RNA, 20 nt, Artificial Sequence
  MKO10019487_A_Gas2l2
  gRNA
uggagcugggucgccgcgcu

SEQ ID NO: 19488 - RNA, 20 nt, Artificial Sequence
  MKO10019488_A_Gas2l2
  gRNA
cccucacuggggguucacua

SEQ ID NO: 19489 - RNA, 20 nt, Artificial Sequence
  MKO10019489_A_Gas2l3
  gRNA
acguuugccaguaugacgag

SEQ ID NO: 19490 - RNA, 20 nt, Artificial Sequence
  MKO10019490_A_Gas2l3
  gRNA
ucucgucaacaccgaugugu

SEQ ID NO: 19491 - RNA, 20 nt, Artificial Sequence
  MKO10019491_A_Gas2l3
  gRNA
cuaaaccuuccgacucaaag

SEQ ID NO: 19492 - RNA, 20 nt, Artificial Sequence
  MKO10019492_A_Gas2
  gRNA
uugcaaagccagugcacccu

SEQ ID NO: 19493 - RNA, 20 nt, Artificial Sequence
  MKO10019493_A_Gas2
  gRNA
aaaggagcccgagggugcac

SEQ ID NO: 19494 - RNA, 20 nt, Artificial Sequence
  MKO10019494_A_Gas2
  gRNA
ucagcuugcagcaacugugc

SEQ ID NO: 19495 - RNA, 20 nt, Artificial Sequence
  MKO10019495_A_Gas6
  gRNA
gucguucucgaacaccucuc

SEQ ID NO: 19496 - RNA, 20 nt, Artificial Sequence
  MKO10019496_A_Gas6
  gRNA
ccgcgccuaccaagucuucg

SEQ ID NO: 19497 - RNA, 20 nt, Artificial Sequence
  MKO10019497_A_Gas6
  gRNA
uauuucuauccacgauauca

SEQ ID NO: 19498 - RNA, 20 nt, Artificial Sequence
  MKO10019498_A_Gas7
  gRNA
uaugucaacacgacuaccaa

SEQ ID NO: 19499 - RNA, 20 nt, Artificial Sequence
  MKO10019499_A_Gas7
  gRNA
gugaauggauaccacgcauc

SEQ ID NO: 19500 - RNA, 20 nt, Artificial Sequence
  MKO10019500_A_Gas7
  gRNA
aaccugggauccucaucgcc

SEQ ID NO: 19501 - RNA, 20 nt, Artificial Sequence
  MKO10019501_A_Gas8
  gRNA
aggaacaugucgcccgcauc

SEQ ID NO: 19502 - RNA, 20 nt, Artificial Sequence
  MKO10019502_A_Gas8
  gRNA
uucaaagucauuucgcaucu

SEQ ID NO: 19503 - RNA, 20 nt, Artificial Sequence
  MKO10019503_A_Gas8
  gRNA
ccuugcgcagagcgcccucc

SEQ ID NO: 19504 - RNA, 20 nt, Artificial Sequence
  MKO10019504_A_Gast
  gRNA
gccaaaguccauccauccgu

SEQ ID NO: 19505 - RNA, 20 nt, Artificial Sequence
  MKO10019505_A_Gast
  gRNA
acagcgccaguucaacaagc

SEQ ID NO: 19506 - RNA, 20 nt, Artificial Sequence
  MKO10019506_A_Gast
  gRNA
ggggccccagcugccuucga

SEQ ID NO: 19507 - RNA, 20 nt, Artificial Sequence
  MKO10019507_A_Gaua1
  gRNA
guagagugccgucuugccau

SEQ ID NO: 19508 - RNA, 20 nt, Artificial Sequence
  MKO10019508_A_Gaua1
  gRNA
ggggcucaccuuaugcuagc

SEQ ID NO: 19509 - RNA, 20 nt, Artificial Sequence
  MKO10019509_A_Gaua1
  gRNA
guuguaggcgaucccagcag

SEQ ID NO: 19510 - RNA, 20 nt, Artificial Sequence
  MKO10019510_A_Gaua2
  gRNA
cgcucaucaagcccaagcgg

SEQ ID NO: 19511 - RNA, 20 nt, Artificial Sequence
  MKO10019511_A_Gaua2
  gRNA
ugcuggacaucuuccgauuc

SEQ ID NO: 19512 - RNA, 20 nt, Artificial Sequence
  MKO10019512_A_Gaua2
  gRNA
cauugugcagcuuguaguag

SEQ ID NO: 19513 - RNA, 20 nt, Artificial Sequence
  MKO10019513_A_Gaua3
  gRNA
ccggguucggauguaagucg

SEQ ID NO: 19514 - RNA, 20 nt, Artificial Sequence
  MKO10019514_A_Gaua3
  gRNA
gguggucugacaguucgcgc

SEQ ID NO: 19515 - RNA, 20 nt, Artificial Sequence
  MKO10019515_A_Gaua3
  gRNA
acgcccaugcauccgcccuc

SEQ ID NO: 19516 - RNA, 20 nt, Artificial Sequence
  MKO10019516_A_Gaua4
  gRNA
uguuguaguccgcuucccgc

SEQ ID NO: 19517 - RNA, 20 nt, Artificial Sequence
  MKO10019517_A_Gaua4
  gRNA
cauuaagccucagcgccgcc

SEQ ID NO: 19518 - RNA, 20 nt, Artificial Sequence
  MKO10019518_A_Gaua4
  gRNA
ucacuuaccaggcggcgcug

SEQ ID NO: 19519 - RNA, 20 nt, Artificial Sequence
  MKO10019519_A_Gaua5
  gRNA
agcagcauaggccggaucuu

SEQ ID NO: 19520 - RNA, 20 nt, Artificial Sequence
  MKO10019520_A_Gaua5
  gRNA
ccacacucaccagacgcuuc

SEQ ID NO: 19521 - RNA, 20 nt, Artificial Sequence
  MKO10019521_A_Gaua5
  gRNA
ugcgccacagugguguagac

SEQ ID NO: 19522 - RNA, 20 nt, Artificial Sequence
  MKO10019522_A_Gaua6
  gRNA
agccgcgagugcgugaacug

SEQ ID NO: 19523 - RNA, 20 nt, Artificial Sequence
  MKO10019523_A_Gaua6
  gRNA
agccgcaguucacgcacucg

SEQ ID NO: 19524 - RNA, 20 nt, Artificial Sequence
  MKO10019524_A_Gaua6
  gRNA
cucagcauuucuacgccaua

SEQ ID NO: 19525 - RNA, 20 nt, Artificial Sequence
  MKO10019525_A_Gauad1
  gRNA
acagauucaggcgcuuugau

SEQ ID NO: 19526 - RNA, 20 nt, Artificial Sequence
  MKO10019526_A_Gauad1
  gRNA
agaagagugccgcgcugaca

SEQ ID NO: 19527 - RNA, 20 nt, Artificial Sequence
  MKO10019527_A_Gauad1
  gRNA
guuuccuuaauaguuaucgc

SEQ ID NO: 19528 - RNA, 20 nt, Artificial Sequence
  MKO10019528_A_Gauad2a
  gRNA
uucuggguaccccgcacgag

SEQ ID NO: 19529 - RNA, 20 nt, Artificial Sequence
  MKO10019529_A_Gauad2a
  gRNA
ucuccacaucauccuccguu

SEQ ID NO: 19530 - RNA, 20 nt, Artificial Sequence
  MKO10019530_A_Gauad2a
  gRNA
aucauccgcucucguucuuc

SEQ ID NO: 19531 - RNA, 20 nt, Artificial Sequence
  MKO10019531_A_Gauad2b
  gRNA
acgauuggaagaagcucgcc

SEQ ID NO: 19532 - RNA, 20 nt, Artificial Sequence
  MKO10019532_A_Gauad2b
  gRNA
caauuccuugagccccgggu

SEQ ID NO: 19533 - RNA, 20 nt, Artificial Sequence
  MKO10019533_A_Gauad2b
  gRNA
cguugagacaucaacaugug

SEQ ID NO: 19534 - RNA, 20 nt, Artificial Sequence
  MKO10019534_A_Gauc
  gRNA
cuccagaugcucgauuaccg

SEQ ID NO: 19535 - RNA, 20 nt, Artificial Sequence
  MKO10019535_A_Gauc
  gRNA
aagcuucggcccgcguccag

SEQ ID NO: 19536 - RNA, 20 nt, Artificial Sequence
  MKO10019536_A_Gauc
  gRNA
guauuccuccacaacgugau

SEQ ID NO: 19537 - RNA, 20 nt, Artificial Sequence
  MKO10019537_A_Gaum
  gRNA
ucuuugaguaccgagcguac

SEQ ID NO: 19538 - RNA, 20 nt, Artificial Sequence
  MKO10019538_A_Gaum
  gRNA
ugauaauugaccuguacgcu

SEQ ID NO: 19539 - RNA, 20 nt, Artificial Sequence
  MKO10019539_A_Gaum
  gRNA
auacuugagugaccagucga

SEQ ID NO: 19540 - RNA, 20 nt, Artificial Sequence
  MKO10019540_A_Gausl2
  gRNA
uuucuccauugacaacgcgu

SEQ ID NO: 19541 - RNA, 20 nt, Artificial Sequence
  MKO10019541_A_Gausl2
  gRNA
ucuuugucacaccgaugggc

SEQ ID NO: 19542 - RNA, 20 nt, Artificial Sequence
  MKO10019542_A_Gausl2
  gRNA
accauccuacgcguugucaa

SEQ ID NO: 19543 - RNA, 20 nt, Artificial Sequence
  MKO10019543_A_Gausl3
  gRNA
cuugacccagguacgggagc

SEQ ID NO: 19544 - RNA, 20 nt, Artificial Sequence
  MKO10019544_A_Gausl3
  gRNA
cccauccgaguuccugcaag

SEQ ID NO: 19545 - RNA, 20 nt, Artificial Sequence
  MKO10019545_A_Gausl3
  gRNA
accaugagaguguaaucuuc

SEQ ID NO: 19546 - RNA, 20 nt, Artificial Sequence
  MKO10019546_A_Gba2
  gRNA
auaguaugcuugcgucgaga

SEQ ID NO: 19547 - RNA, 20 nt, Artificial Sequence
  MKO10019547_A_Gba2
  gRNA
cagucgucccgcccuguucc

SEQ ID NO: 19548 - RNA, 20 nt, Artificial Sequence
  MKO10019548_A_Gba2
  gRNA
acagggcgggacgacuguuc

SEQ ID NO: 19549 - RNA, 20 nt, Artificial Sequence
  MKO10019549_A_Gbas
  gRNA
uucaguucacaacguuaagc

SEQ ID NO: 19550 - RNA, 20 nt, Artificial Sequence
  MKO10019550_A_Gbas
  gRNA
acguguuccacguccccacc

SEQ ID NO: 19551 - RNA, 20 nt, Artificial Sequence
  MKO10019551_A_Gbas
  gRNA
gggacguggaacacguggua

SEQ ID NO: 19552 - RNA, 20 nt, Artificial Sequence
  MKO10019552_A_Gba
  gRNA
cacgucgagugcucucguaa

SEQ ID NO: 19553 - RNA, 20 nt, Artificial Sequence
  MKO10019553_A_Gba
  gRNA
gccauccaggccaaucgcac

SEQ ID NO: 19554 - RNA, 20 nt, Artificial Sequence
  MKO10019554_A_Gba
  gRNA
cccacuuggcucaagaccaa

SEQ ID NO: 19555 - RNA, 20 nt, Artificial Sequence
  MKO10019555_A_Gbe1
  gRNA
gggaucgauaaguucuccag

SEQ ID NO: 19556 - RNA, 20 nt, Artificial Sequence
  MKO10019556_A_Gbe1
  gRNA
gacggaaccuaccuucagcu

SEQ ID NO: 19557 - RNA, 20 nt, Artificial Sequence
  MKO10019557_A_Gbe1
  gRNA
guaguuauuacuaguaagag

SEQ ID NO: 19558 - RNA, 20 nt, Artificial Sequence
  MKO10019558_A_Gbf1
  gRNA
gugcuuaccuaugagugcgu

SEQ ID NO: 19559 - RNA, 20 nt, Artificial Sequence
  MKO10019559_A_Gbf1
  gRNA
uuccuguccuacgcacucau

SEQ ID NO: 19560 - RNA, 20 nt, Artificial Sequence
  MKO10019560_A_Gbf1
  gRNA
cggagcagauccaacucaug

SEQ ID NO: 19561 - RNA, 20 nt, Artificial Sequence
  MKO10019561_A_Gbgu1
  gRNA
uuggcacccaucgucuccga

SEQ ID NO: 19562 - RNA, 20 nt, Artificial Sequence
  MKO10019562_A_Gbgu1
  gRNA
cagccguugaaccugaccau

SEQ ID NO: 19563 - RNA, 20 nt, Artificial Sequence
  MKO10019563_A_Gbgu1
  gRNA
guacccucagccuaagcugc

SEQ ID NO: 19564 - RNA, 20 nt, Artificial Sequence
  MKO10019564_A_Gbp10
  gRNA
cuuccauucaggcuucccuc

SEQ ID NO: 19565 - RNA, 20 nt, Artificial Sequence
  MKO10019565_A_Gbp10
  gRNA
cgaacaauccagacaaaguc

SEQ ID NO: 19566 - RNA, 20 nt, Artificial Sequence
  MKO10019566_A_Gbp10
  gRNA
cacugugcagucucaaacca

SEQ ID NO: 19567 - RNA, 20 nt, Artificial Sequence
  MKO10019567_A_Gbp11
  gRNA
aggaguucuaugucauaagu

SEQ ID NO: 19568 - RNA, 20 nt, Artificial Sequence
  MKO10019568_A_Gbp11
  gRNA
ucagacguuucuuuccaaau

SEQ ID NO: 19569 - RNA, 20 nt, Artificial Sequence
  MKO10019569_A_Gbp11
  gRNA
caucacaagugauggguacc

SEQ ID NO: 19570 - RNA, 20 nt, Artificial Sequence
  MKO10019570_A_Gbp2b
  gRNA
auaugccucgccuguguauc

SEQ ID NO: 19571 - RNA, 20 nt, Artificial Sequence
  MKO10019571_A_Gbp2b
  gRNA
cuccuguauccacucuaguu

SEQ ID NO: 19572 - RNA, 20 nt, Artificial Sequence
  MKO10019572_A_Gbp2b
  gRNA
uugucuacaucacucugauc

SEQ ID NO: 19573 - RNA, 20 nt, Artificial Sequence
  MKO10019573_A_Gbp2
  gRNA
uuccguuaaccuccagcucg

SEQ ID NO: 19574 - RNA, 20 nt, Artificial Sequence
  MKO10019574_A_Gbp2
  gRNA
ucgucuaccccacucugguc

SEQ ID NO: 19575 - RNA, 20 nt, Artificial Sequence
  MKO10019575_A_Gbp2
  gRNA
aauuuccugaugcacagucg

SEQ ID NO: 19576 - RNA, 20 nt, Artificial Sequence
  MKO10019576_A_Gbp3
  gRNA
caauaaacguuugucgcuug

SEQ ID NO: 19577 - RNA, 20 nt, Artificial Sequence
  MKO10019577_A_Gbp3
  gRNA
aagacaaagcacuuccguac

SEQ ID NO: 19578 - RNA, 20 nt, Artificial Sequence
  MKO10019578_A_Gbp3
  gRNA
cugaauuaacacagcuaauc

SEQ ID NO: 19579 - RNA, 20 nt, Artificial Sequence
  MKO10019579_A_Gbp4
  gRNA
uacguuuaaggaaagugcaa

SEQ ID NO: 19580 - RNA, 20 nt, Artificial Sequence
  MKO10019580_A_Gbp4
  gRNA
auugcacuuuccuuaaacgu

SEQ ID NO: 19581 - RNA, 20 nt, Artificial Sequence
  MKO10019581_A_Gbp4
  gRNA
accccaccaagccagagcac

SEQ ID NO: 19582 - RNA, 20 nt, Artificial Sequence
  MKO10019582_A_Gbp5
  gRNA
acucacgagguccguugacc

SEQ ID NO: 19583 - RNA, 20 nt, Artificial Sequence
  MKO10019583_A_Gbp5
  gRNA
gcaauaggucgauagccccc

SEQ ID NO: 19584 - RNA, 20 nt, Artificial Sequence
  MKO10019584_A_Gbp5
  gRNA
gaaagcuuacuuccaagcgc

SEQ ID NO: 19585 - RNA, 20 nt, Artificial Sequence
  MKO10019585_A_Gbp6
  gRNA
cuucccuucaggcuuuccuc

SEQ ID NO: 19586 - RNA, 20 nt, Artificial Sequence
  MKO10019586_A_Gbp6
  gRNA
caccgugcagucucagacca

SEQ ID NO: 19587 - RNA, 20 nt, Artificial Sequence
  MKO10019587_A_Gbp6
  gRNA
gugauccuaagaacgacuug

SEQ ID NO: 19588 - RNA, 20 nt, Artificial Sequence
  MKO10019588_A_Gbp7
  gRNA
cacuucuucagaccgugaag

SEQ ID NO: 19589 - RNA, 20 nt, Artificial Sequence
  MKO10019589_A_Gbp7
  gRNA
cuacaucuucuccaauucga

SEQ ID NO: 19590 - RNA, 20 nt, Artificial Sequence
  MKO10019590_A_Gbp7
  gRNA
caaguucacacucgugcuuc

SEQ ID NO: 19591 - RNA, 20 nt, Artificial Sequence
  MKO10019591_A_Gbp8
  gRNA
aaggauacuguaguuucucc

SEQ ID NO: 19592 - RNA, 20 nt, Artificial Sequence
  MKO10019592_A_Gbp8
  gRNA
ugcucugguuuaguggggug

SEQ ID NO: 19593 - RNA, 20 nt, Artificial Sequence
  MKO10019593_A_Gbp8
  gRNA
aagucuucaccaaauccuga

SEQ ID NO: 19594 - RNA, 20 nt, Artificial Sequence
  MKO10019594_A_Gbp9
  gRNA
ucuucccucagguuucccuc

SEQ ID NO: 19595 - RNA, 20 nt, Artificial Sequence
  MKO10019595_A_Gbp9
  gRNA
aagucuucccgaaaucccca

SEQ ID NO: 19596 - RNA, 20 nt, Artificial Sequence
  MKO10019596_A_Gbp9
  gRNA
uaaguuccgggaaggaacaa

SEQ ID NO: 19597 - RNA, 20 nt, Artificial Sequence
  MKO10019597_A_Gbx1
  gRNA
gggcuccggguugcuucgcg

SEQ ID NO: 19598 - RNA, 20 nt, Artificial Sequence
  MKO10019598_A_Gbx1
  gRNA
ccaccaucgagggcaccgcc

SEQ ID NO: 19599 - RNA, 20 nt, Artificial Sequence
  MKO10019599_A_Gbx1
  gRNA
ccauaccugugcacgucaac

SEQ ID NO: 19600 - RNA, 20 nt, Artificial Sequence
  MKO10019600_A_Gbx2
  gRNA
gaagcggugcaggcgucgcu

SEQ ID NO: 19601 - RNA, 20 nt, Artificial Sequence
  MKO10019601_A_Gbx2
  gRNA
gagcgacgccugcaccgcuu

SEQ ID NO: 19602 - RNA, 20 nt, Artificial Sequence
  MKO10019602_A_Gbx2
  gRNA
ugaaggcaguccgccgccgc

SEQ ID NO: 19603 - RNA, 20 nt, Artificial Sequence
  MKO10019603_A_Gcau
  gRNA
cauccgcguggacggcaucu

SEQ ID NO: 19604 - RNA, 20 nt, Artificial Sequence
  MKO10019604_A_Gcau
  gRNA
caaguaccguuaccgccacc

SEQ ID NO: 19605 - RNA, 20 nt, Artificial Sequence
  MKO10019605_A_Gcau
  gRNA
ccgccgcgcacauucagcgc

SEQ ID NO: 19606 - RNA, 20 nt, Artificial Sequence
  MKO10019606_A_Gca
  gRNA
aaccguuagagagacuacac

SEQ ID NO: 19607 - RNA, 20 nt, Artificial Sequence
  MKO10019607_A_Gca
  gRNA
uuugggccgcucuuaaugcc

SEQ ID NO: 19608 - RNA, 20 nt, Artificial Sequence
  MKO10019608_A_Gca
  gRNA
ccccugccgacgacuccaug

SEQ ID NO: 19609 - RNA, 20 nt, Artificial Sequence
  MKO10019609_A_Gcc1
  gRNA
uaccgcgcucuacuaccaac

SEQ ID NO: 19610 - RNA, 20 nt, Artificial Sequence
  MKO10019610_A_Gcc1
  gRNA
gcgggcauaugccgcugauc

SEQ ID NO: 19611 - RNA, 20 nt, Artificial Sequence
  MKO10019611_A_Gcc1
  gRNA
acugucgguaucccacgagg

SEQ ID NO: 19612 - RNA, 20 nt, Artificial Sequence
  MKO10019612_A_Gcc2
  gRNA
acagguacuaacugaacgcu

SEQ ID NO: 19613 - RNA, 20 nt, Artificial Sequence
  MKO10019613_A_Gcc2
  gRNA
aguaccuguacaccuugcuu

SEQ ID NO: 19614 - RNA, 20 nt, Artificial Sequence
  MKO10019614_A_Gcc2
  gRNA
gccguagcugcagcacccuc

SEQ ID NO: 19615 - RNA, 20 nt, Artificial Sequence
  MKO10019615_A_Gcdh
  gRNA
ccagucaaacacggggcgag

SEQ ID NO: 19616 - RNA, 20 nt, Artificial Sequence
  MKO10019616_A_Gcdh
  gRNA
uucgagacauaagccgcucc

SEQ ID NO: 19617 - RNA, 20 nt, Artificial Sequence
  MKO10019617_A_Gcdh
  gRNA
ugaucuuacauuuggccggu

SEQ ID NO: 19618 - RNA, 20 nt, Artificial Sequence
  MKO10019618_A_Gcfc2
  gRNA
agcccgcagaaaacgggagu

SEQ ID NO: 19619 - RNA, 20 nt, Artificial Sequence
  MKO10019619_A_Gcfc2
  gRNA
uccaaugaaauguagucccc

SEQ ID NO: 19620 - RNA, 20 nt, Artificial Sequence
  MKO10019620_A_Gcfc2
  gRNA
gaaggaacacauaccuugac

SEQ ID NO: 19621 - RNA, 20 nt, Artificial Sequence
  MKO10019621_A_Gcgr
  gRNA
ccagcaggaguacuugucga

SEQ ID NO: 19622 - RNA, 20 nt, Artificial Sequence
  MKO10019622_A_Gcgr
  gRNA
ccuucgacaaguacuccugc

SEQ ID NO: 19623 - RNA, 20 nt, Artificial Sequence
  MKO10019623_A_Gcgr
  gRNA
cccucgaacccacugcccau

SEQ ID NO: 19624 - RNA, 20 nt, Artificial Sequence
  MKO10019624_A_Gcg
  gRNA
cucggccgcaggcacgcuga

SEQ ID NO: 19625 - RNA, 20 nt, Artificial Sequence
  MKO10019625_A_Gcg
  gRNA
agacucuuaccgguuccucu

SEQ ID NO: 19626 - RNA, 20 nt, Artificial Sequence
  MKO10019626_A_Gcg
  gRNA
uucccagacagaagcgcaug

SEQ ID NO: 19627 - RNA, 20 nt, Artificial Sequence
  MKO10019627_A_Gch1
  gRNA
gauggccaccgcaaucuguu

SEQ ID NO: 19628 - RNA, 20 nt, Artificial Sequence
  MKO10019628_A_Gch1
  gRNA
gcgccucaccaaacagauug

SEQ ID NO: 19629 - RNA, 20 nt, Artificial Sequence
  MKO10019629_A_Gch1
  gRNA
gaacuuacccuuccuacaaa

SEQ ID NO: 19630 - RNA, 20 nt, Artificial Sequence
  MKO10019630_A_Gchfr
  gRNA
cgacccuccucgcauagucc

SEQ ID NO: 19631 - RNA, 20 nt, Artificial Sequence
  MKO10019631_A_Gchfr
  gRNA
caucagcacucagauccgua

SEQ ID NO: 19632 - RNA, 20 nt, Artificial Sequence
  MKO10019632_A_Gchfr
  gRNA
gggugaugaacacucggauc

SEQ ID NO: 19633 - RNA, 20 nt, Artificial Sequence
  MKO10019633_A_Gckr
  gRNA
gucccagaccuuucaucagc

SEQ ID NO: 19634 - RNA, 20 nt, Artificial Sequence
  MKO10019634_A_Gckr
  gRNA
ggguuggacuucucugugau

SEQ ID NO: 19635 - RNA, 20 nt, Artificial Sequence
  MKO10019635_A_Gckr
  gRNA
agaaguccaacccacugacc

SEQ ID NO: 19636 - RNA, 20 nt, Artificial Sequence
  MKO10019636_A_Gck
  gRNA
uacgugcguuccaccccaga

SEQ ID NO: 19637 - RNA, 20 nt, Artificial Sequence
  MKO10019637_A_Gck
  gRNA
ccagauguauuccauccccg

SEQ ID NO: 19638 - RNA, 20 nt, Artificial Sequence
  MKO10019638_A_Gck
  gRNA
ccucggggauggaauacauc

SEQ ID NO: 19639 - RNA, 20 nt, Artificial Sequence
  MKO10019639_A_Gclc
  gRNA
gccucacucacccgaagcgg

SEQ ID NO: 19640 - RNA, 20 nt, Artificial Sequence
  MKO10019640_A_Gclc
  gRNA
cucagacaucguuccuccgu

SEQ ID NO: 19641 - RNA, 20 nt, Artificial Sequence
  MKO10019641_A_Gclc
  gRNA
ucuacagccauccgacccuc

SEQ ID NO: 19642 - RNA, 20 nt, Artificial Sequence
  MKO10019642_A_Gclm
  gRNA
aaaucagccccgauuuaguc

SEQ ID NO: 19643 - RNA, 20 nt, Artificial Sequence
  MKO10019643_A_Gclm
  gRNA
ucuacuuacccugacuaaau

SEQ ID NO: 19644 - RNA, 20 nt, Artificial Sequence
  MKO10019644_A_Gclm
  gRNA
auggugcauuccaaaacauc

SEQ ID NO: 19645 - RNA, 20 nt, Artificial Sequence
  MKO10019645_A_Gcm1
  gRNA
accucccggauuggaccaca

SEQ ID NO: 19646 - RNA, 20 nt, Artificial Sequence
  MKO10019646_A_Gcm1
  gRNA
ucguagucuccauacguccc

SEQ ID NO: 19647 - RNA, 20 nt, Artificial Sequence
  MKO10019647_A_Gcm1
  gRNA
gggaugaucaugcucgccuu

SEQ ID NO: 19648 - RNA, 20 nt, Artificial Sequence
  MKO10019648_A_Gcm2
  gRNA
augaagcgcacguagccauc

SEQ ID NO: 19649 - RNA, 20 nt, Artificial Sequence
  MKO10019649_A_Gcm2
  gRNA
ccagggcagccgugcuauug

SEQ ID NO: 19650 - RNA, 20 nt, Artificial Sequence
  MKO10019650_A_Gcm2
  gRNA
ccuguauaaagauuccuccg

SEQ ID NO: 19651 - RNA, 20 nt, Artificial Sequence
  MKO10019651_A_Gcn1l1
  gRNA
gcuugacacugcaucgauau

SEQ ID NO: 19652 - RNA, 20 nt, Artificial Sequence
  MKO10019652_A_Gcn1l1
  gRNA
agcgaagcgcuucagugucu

SEQ ID NO: 19653 - RNA, 20 nt, Artificial Sequence
  MKO10019653_A_Gcn1l1
  gRNA
acugaagcgcuucgcuguga

SEQ ID NO: 19654 - RNA, 20 nt, Artificial Sequence
  MKO10019654_A_Gcnt1
  gRNA
gucaaguggcaguacuucga

SEQ ID NO: 19655 - RNA, 20 nt, Artificial Sequence
  MKO10019655_A_Gcnt1
  gRNA
ugcaauucaagaagcgcccg

SEQ ID NO: 19656 - RNA, 20 nt, Artificial Sequence
  MKO10019656_A_Gcnt1
  gRNA
gucugccuuaacccgacucc

SEQ ID NO: 19657 - RNA, 20 nt, Artificial Sequence
  MKO10019657_A_Gcnt2
  gRNA
aaucaaccgcccguggguca

SEQ ID NO: 19658 - RNA, 20 nt, Artificial Sequence
  MKO10019658_A_Gcnt2
  gRNA
guccguacaacuauguacgc

SEQ ID NO: 19659 - RNA, 20 nt, Artificial Sequence
  MKO10019659_A_Gcnt2
  gRNA
aaaucauacguucuucacga

SEQ ID NO: 19660 - RNA, 20 nt, Artificial Sequence
  MKO10019660_A_Gcnt3
  gRNA
auagucccgaugagcaccuu

SEQ ID NO: 19661 - RNA, 20 nt, Artificial Sequence
  MKO10019661_A_Gcnt3
  gRNA
cuccacauaaaaaaucccgc

SEQ ID NO: 19662 - RNA, 20 nt, Artificial Sequence
  MKO10019662_A_Gcnt3
  gRNA
ucugcuggcacuaucgccug

SEQ ID NO: 19663 - RNA, 20 nt, Artificial Sequence
  MKO10019663_A_Gcnt4
  gRNA
gccaccuuaauccggauacc

SEQ ID NO: 19664 - RNA, 20 nt, Artificial Sequence
  MKO10019664_A_Gcnt4
  gRNA
ggucuacgagcacgagccuu

SEQ ID NO: 19665 - RNA, 20 nt, Artificial Sequence
  MKO10019665_A_Gcnt4
  gRNA
acgaccagcgaauaggcuau

SEQ ID NO: 19666 - RNA, 20 nt, Artificial Sequence
  MKO10019666_A_Gcnt7
  gRNA
ccaggugugcgcaagcgagc

SEQ ID NO: 19667 - RNA, 20 nt, Artificial Sequence
  MKO10019667_A_Gcnt7
  gRNA
ccuauguuauacaugcuccg

SEQ ID NO: 19668 - RNA, 20 nt, Artificial Sequence
  MKO10019668_A_Gcnt7
  gRNA
gacacauucgggccacaaag

SEQ ID NO: 19669 - RNA, 20 nt, Artificial Sequence
  MKO10019669_A_Gcsam
  gRNA
gaugacuucagcucccguuc

SEQ ID NO: 19670 - RNA, 20 nt, Artificial Sequence
  MKO10019670_A_Gcsam
  gRNA
aguuguugucacagcguuga

SEQ ID NO: 19671 - RNA, 20 nt, Artificial Sequence
  MKO10019671_A_Gcsam
  gRNA
ucauggggaacuguuugcag

SEQ ID NO: 19672 - RNA, 20 nt, Artificial Sequence
  MKO10019672_A_Gcsh
  gRNA
caacucaccaucuucguaac

SEQ ID NO: 19673 - RNA, 20 nt, Artificial Sequence
  MKO10019673_A_Gcsh
  gRNA
aacaaauccuguuacgaaga

SEQ ID NO: 19674 - RNA, 20 nt, Artificial Sequence
  MKO10019674_A_Gcsh
  gRNA
acugagugacccuucagaga

SEQ ID NO: 19675 - RNA, 20 nt, Artificial Sequence
  MKO10019675_A_Gc
  gRNA
gcuuacccuggugucguagc

SEQ ID NO: 19676 - RNA, 20 nt, Artificial Sequence
  MKO10019676_A_Gc
  gRNA
uugcaaugaacucgccaugc

SEQ ID NO: 19677 - RNA, 20 nt, Artificial Sequence
  MKO10019677_A_Gc
  gRNA
ucuaggccgagacuaugaga

SEQ ID NO: 19678 - RNA, 20 nt, Artificial Sequence
  MKO10019678_A_Gdap1l1
  gRNA
acgcccgagugcugcaguac

SEQ ID NO: 19679 - RNA, 20 nt, Artificial Sequence
  MKO10019679_A_Gdap1l1
  gRNA
guuccacguagucaaugauc

SEQ ID NO: 19680 - RNA, 20 nt, Artificial Sequence
  MKO10019680_A_Gdap1l1
  gRNA
gcauagcauaccucccguga

SEQ ID NO: 19681 - RNA, 20 nt, Artificial Sequence
  MKO10019681_A_Gdap1
  gRNA
uuuaugcgcuugaacucagc

SEQ ID NO: 19682 - RNA, 20 nt, Artificial Sequence
  MKO10019682_A_Gdap1
  gRNA
uuacauacugcgaauccuug

SEQ ID NO: 19683 - RNA, 20 nt, Artificial Sequence
  MKO10019683_A_Gdap1
  gRNA
cacagauuauguucuccccg

SEQ ID NO: 19684 - RNA, 20 nt, Artificial Sequence
  MKO10019684_A_Gdap2
  gRNA
uuguuucuagguugccgaac

SEQ ID NO: 19685 - RNA, 20 nt, Artificial Sequence
  MKO10019685_A_Gdap2
  gRNA
gucaucaauucugccaagcg

SEQ ID NO: 19686 - RNA, 20 nt, Artificial Sequence
  MKO10019686_A_Gdap2
  gRNA
ucuccgcugcagugcgguag

SEQ ID NO: 19687 - RNA, 20 nt, Artificial Sequence
  MKO10019687_A_Gda
  gRNA
caacguugaccugccgcuuu

SEQ ID NO: 19688 - RNA, 20 nt, Artificial Sequence
  MKO10019688_A_Gda
  gRNA
gucaacguugcuuccagcaa

SEQ ID NO: 19689 - RNA, 20 nt, Artificial Sequence
  MKO10019689_A_Gda
  gRNA
auuugggcagcgagcauuug

SEQ ID NO: 19690 - RNA, 20 nt, Artificial Sequence
  MKO10019690_A_Gde1
  gRNA
uuccaaaagacgcuguagcg

SEQ ID NO: 19691 - RNA, 20 nt, Artificial Sequence
  MKO10019691_A_Gde1
  gRNA
agccucgcuacagcgucuuu

SEQ ID NO: 19692 - RNA, 20 nt, Artificial Sequence
  MKO10019692_A_Gde1
  gRNA
gacaucgaguuuacuucuga

SEQ ID NO: 19693 - RNA, 20 nt, Artificial Sequence
  MKO10019693_A_Gdf10
  gRNA
ugcggucuuugcgccccgug

SEQ ID NO: 19694 - RNA, 20 nt, Artificial Sequence
  MKO10019694_A_Gdf10
  gRNA
ccguccgaagcuuccgugcc

SEQ ID NO: 19695 - RNA, 20 nt, Artificial Sequence
  MKO10019695_A_Gdf10
  gRNA
ccgggcacugaaaccccgca

SEQ ID NO: 19696 - RNA, 20 nt, Artificial Sequence
  MKO10019696_A_Gdf11
  gRNA
ucgaguguucaucgcagucc

SEQ ID NO: 19697 - RNA, 20 nt, Artificial Sequence
  MKO10019697_A_Gdf11
  gRNA
ucgggggggagcgcucgagc

SEQ ID NO: 19698 - RNA, 20 nt, Artificial Sequence
  MKO10019698_A_Gdf11
  gRNA
ggccaugcuuaugaccgucu

SEQ ID NO: 19699 - RNA, 20 nt, Artificial Sequence
  MKO10019699_A_Gdf15
  gRNA
aacucaacgccgacgagcua

SEQ ID NO: 19700 - RNA, 20 nt, Artificial Sequence
  MKO10019700_A_Gdf15
  gRNA
gaagcgaccccguagcucgu

SEQ ID NO: 19701 - RNA, 20 nt, Artificial Sequence
  MKO10019701_A_Gdf15
  gRNA
agcugcuacuccgcgucaac

SEQ ID NO: 19702 - RNA, 20 nt, Artificial Sequence
  MKO10019702_A_Gdf1
  gRNA
cguugggugaucgcgccgcg

SEQ ID NO: 19703 - RNA, 20 nt, Artificial Sequence
  MKO10019703_A_Gdf1
  gRNA
cggguacgacaagugcccac

SEQ ID NO: 19704 - RNA, 20 nt, Artificial Sequence
  MKO10019704_A_Gdf1
  gRNA
uugggcuucccgaagcgccc

SEQ ID NO: 19705 - RNA, 20 nt, Artificial Sequence
  MKO10019705_A_Gdf2
  gRNA
cgccugccuccaacaucgug

SEQ ID NO: 19706 - RNA, 20 nt, Artificial Sequence
  MKO10019706_A_Gdf2
  gRNA
auccuucgucccgaaugucc

SEQ ID NO: 19707 - RNA, 20 nt, Artificial Sequence
  MKO10019707_A_Gdf2
  gRNA
gcugaagcuccgcacgaugu

SEQ ID NO: 19708 - RNA, 20 nt, Artificial Sequence
  MKO10019708_A_Gdf3
  gRNA
aaccugugccucgcgucuua

SEQ ID NO: 19709 - RNA, 20 nt, Artificial Sequence
  MKO10019709_A_Gdf3
  gRNA
cacguagcauaaguccugcg

SEQ ID NO: 19710 - RNA, 20 nt, Artificial Sequence
  MKO10019710_A_Gdf3
  gRNA
gggaucgcccccacacgccc

SEQ ID NO: 19711 - RNA, 20 nt, Artificial Sequence
  MKO10019711_A_Gdf5
  gRNA
gcccggacuguaaccccaaa

SEQ ID NO: 19712 - RNA, 20 nt, Artificial Sequence
  MKO10019712_A_Gdf5
  gRNA
gggcccggcguuuccgccgc

SEQ ID NO: 19713 - RNA, 20 nt, Artificial Sequence
  MKO10019713_A_Gdf5
  gRNA
uugggcaacccgcccgcuac

SEQ ID NO: 19714 - RNA, 20 nt, Artificial Sequence
  MKO10019714_A_Gdf6
  gRNA
uagcauccuguacaucgacg

SEQ ID NO: 19715 - RNA, 20 nt, Artificial Sequence
  MKO10019715_A_Gdf6
  gRNA
cgaaggcggugcgucgccgc

SEQ ID NO: 19716 - RNA, 20 nt, Artificial Sequence
  MKO10019716_A_Gdf6
  gRNA
ugcggcagaaggaccuccgg

SEQ ID NO: 19717 - RNA, 20 nt, Artificial Sequence
  MKO10019717_A_Gdf7
  gRNA
agcgcuugccguccccgcga

SEQ ID NO: 19718 - RNA, 20 nt, Artificial Sequence
  MKO10019718_A_Gdf7
  gRNA
agcguucgacgugacggacg

SEQ ID NO: 19719 - RNA, 20 nt, Artificial Sequence
  MKO10019719_A_Gdf7
  gRNA
agaggcuggauacgucgaac

SEQ ID NO: 19720 - RNA, 20 nt, Artificial Sequence
  MKO10019720_A_Gdf9
  gRNA
uaccgaugccugaccgcccu

SEQ ID NO: 19721 - RNA, 20 nt, Artificial Sequence
  MKO10019721_A_Gdf9
  gRNA
gucaccucuacaauaccguc

SEQ ID NO: 19722 - RNA, 20 nt, Artificial Sequence
  MKO10019722_A_Gdf9
  gRNA
cuuucugcccucgacggcgc

SEQ ID NO: 19723 - RNA, 20 nt, Artificial Sequence
  MKO10019723_A_Gdi1
  gRNA
auggaccgaaaccccuacua

SEQ ID NO: 19724 - RNA, 20 nt, Artificial Sequence
  MKO10019724_A_Gdi1
  gRNA
uacagaagugacucgauauc

SEQ ID NO: 19725 - RNA, 20 nt, Artificial Sequence
  MKO10019725_A_Gdi1
  gRNA
ccgguagacaucacgcaugc

SEQ ID NO: 19726 - RNA, 20 nt, Artificial Sequence
  MKO10019726_A_Gdi2
  gRNA
uguuugagaaacgccguuuc

SEQ ID NO: 19727 - RNA, 20 nt, Artificial Sequence
  MKO10019727_A_Gdi2
  gRNA
auggaucagaacccauacua

SEQ ID NO: 19728 - RNA, 20 nt, Artificial Sequence
  MKO10019728_A_Gdi2
  gRNA
ucacugacauuauccccgac

SEQ ID NO: 19729 - RNA, 20 nt, Artificial Sequence
  MKO10019729_A_Gdnf
  gRNA
aaacgacaggucgucgucga

SEQ ID NO: 19730 - RNA, 20 nt, Artificial Sequence
  MKO10019730_A_Gdnf
  gRNA
acagucacuggucagcgcga

SEQ ID NO: 19731 - RNA, 20 nt, Artificial Sequence
  MKO10019731_A_Gdnf
  gRNA
gucuacggagaccggauccg

SEQ ID NO: 19732 - RNA, 20 nt, Artificial Sequence
  MKO10019732_A_Gdpd1
  gRNA
cacuuugaugucgauguuaa

SEQ ID NO: 19733 - RNA, 20 nt, Artificial Sequence
  MKO10019733_A_Gdpd1
  gRNA
cccaccuuaccuuugcaagc

SEQ ID NO: 19734 - RNA, 20 nt, Artificial Sequence
  MKO10019734_A_Gdpd1
  gRNA
gucuucagcgcaguuaccau

SEQ ID NO: 19735 - RNA, 20 nt, Artificial Sequence
  MKO10019735_A_Gdpd2
  gRNA
acagauuccuguuccgccau

SEQ ID NO: 19736 - RNA, 20 nt, Artificial Sequence
  MKO10019736_A_Gdpd2
  gRNA
uaugccacuccugccgccau

SEQ ID NO: 19737 - RNA, 20 nt, Artificial Sequence
  MKO10019737_A_Gdpd2
  gRNA
agacgaccagcaggacuauc

SEQ ID NO: 19738 - RNA, 20 nt, Artificial Sequence
  MKO10019738_A_Gdpd3
  gRNA
agaccggcacaugauuaguu

SEQ ID NO: 19739 - RNA, 20 nt, Artificial Sequence
  MKO10019739_A_Gdpd3
  gRNA
aagaaccugucccgccaguc

SEQ ID NO: 19740 - RNA, 20 nt, Artificial Sequence
  MKO10019740_A_Gdpd3
  gRNA
cauccuuauuuaggccugac

SEQ ID NO: 19741 - RNA, 20 nt, Artificial Sequence
  MKO10019741_A_Gdpd4
  gRNA
gucaaagccguuguauucau

SEQ ID NO: 19742 - RNA, 20 nt, Artificial Sequence
  MKO10019742_A_Gdpd4
  gRNA
ugccuacacuaccuugcuuu

SEQ ID NO: 19743 - RNA, 20 nt, Artificial Sequence
  MKO10019743_A_Gdpd4
  gRNA
agcugcacucagcaccaaaa

SEQ ID NO: 19744 - RNA, 20 nt, Artificial Sequence
  MKO10019744_A_Gdpd5
  gRNA
ugaacucaucguagucguug

SEQ ID NO: 19745 - RNA, 20 nt, Artificial Sequence
  MKO10019745_A_Gdpd5
  gRNA
acgacuacgaugaguucaac

SEQ ID NO: 19746 - RNA, 20 nt, Artificial Sequence
  MKO10019746_A_Gdpd5
  gRNA
cgacugguccgugcccaucc

SEQ ID NO: 19747 - RNA, 20 nt, Artificial Sequence
  MKO10019747_A_Gdpgp1
  gRNA
gcucagcugaauauagagcg

SEQ ID NO: 19748 - RNA, 20 nt, Artificial Sequence
  MKO10019748_A_Gdpgp1
  gRNA
gcagagucgaaacgggauag

SEQ ID NO: 19749 - RNA, 20 nt, Artificial Sequence
  MKO10019749_A_Gdpgp1
  gRNA
cacggcacuaggugaauccc

SEQ ID NO: 19750 - RNA, 20 nt, Artificial Sequence
  MKO10019750_A_Gemin2
  gRNA
uuccucuguagacgguccag

SEQ ID NO: 19751 - RNA, 20 nt, Artificial Sequence
  MKO10019751_A_Gemin2
  gRNA
aguaaccuucaggcgcaggc

SEQ ID NO: 19752 - RNA, 20 nt, Artificial Sequence
  MKO10019752_A_Gemin2
  gRNA
acuuguacauaaucgauccc

SEQ ID NO: 19753 - RNA, 20 nt, Artificial Sequence
  MKO10019753_A_Gemin4
  gRNA
gcugguuaaacgucguguug

SEQ ID NO: 19754 - RNA, 20 nt, Artificial Sequence
  MKO10019754_A_Gemin4
  gRNA
ccagaacccauaccaucgac

SEQ ID NO: 19755 - RNA, 20 nt, Artificial Sequence
  MKO10019755_A_Gemin4
  gRNA
ugggaacccaccuaggucca

SEQ ID NO: 19756 - RNA, 20 nt, Artificial Sequence
  MKO10019756_A_Gemin5
  gRNA
uggaguggaucucgucaucg

SEQ ID NO: 19757 - RNA, 20 nt, Artificial Sequence
  MKO10019757_A_Gemin5
  gRNA
gcaucuuuggcuucgcugcg

SEQ ID NO: 19758 - RNA, 20 nt, Artificial Sequence
  MKO10019758_A_Gemin5
  gRNA
cuccgucuuccucguccgcg

SEQ ID NO: 19759 - RNA, 20 nt, Artificial Sequence
  MKO10019759_A_Gemin6
  gRNA
aacugguaaccaugagcgaa

SEQ ID NO: 19760 - RNA, 20 nt, Artificial Sequence
  MKO10019760_A_Gemin6
  gRNA
ucagcuucucgcguacucug

SEQ ID NO: 19761 - RNA, 20 nt, Artificial Sequence
  MKO10019761_A_Gemin6
  gRNA
cuguaaaggauacagccccg

SEQ ID NO: 19762 - RNA, 20 nt, Artificial Sequence
  MKO10019762_A_Gemin7
  gRNA
uaugucacuacaucgaagca

SEQ ID NO: 19763 - RNA, 20 nt, Artificial Sequence
  MKO10019763_A_Gemin7
  gRNA
gugaguuucacgcugcacga

SEQ ID NO: 19764 - RNA, 20 nt, Artificial Sequence
  MKO10019764_A_Gemin7
  gRNA
gugcaugugaccgcccaguu

SEQ ID NO: 19765 - RNA, 20 nt, Artificial Sequence
  MKO10019765_A_Gemin8
  gRNA
ccacucuguaggccuccaac

SEQ ID NO: 19766 - RNA, 20 nt, Artificial Sequence
  MKO10019766_A_Gemin8
  gRNA
guucuacugcuauuacgcag

SEQ ID NO: 19767 - RNA, 20 nt, Artificial Sequence
  MKO10019767_A_Gemin8
  gRNA
cccagggcgacagcagcagc

SEQ ID NO: 19768 - RNA, 20 nt, Artificial Sequence
  MKO10019768_A_Gem
  gRNA
agucggacgaccagcuccgc

SEQ ID NO: 19769 - RNA, 20 nt, Artificial Sequence
  MKO10019769_A_Gem
  gRNA
ugcgacaggugcgccugcgc

SEQ ID NO: 19770 - RNA, 20 nt, Artificial Sequence
  MKO10019770_A_Gem
  gRNA
agauacauaugagcguaccc

SEQ ID NO: 19771 - RNA, 20 nt, Artificial Sequence
  MKO10019771_A_Gen1
  gRNA
aaggaaagcaucgccgucgu

SEQ ID NO: 19772 - RNA, 20 nt, Artificial Sequence
  MKO10019772_A_Gen1
  gRNA
uuggaucgagacgcucuggu

SEQ ID NO: 19773 - RNA, 20 nt, Artificial Sequence
  MKO10019773_A_Gen1
  gRNA
cagacucguuacgggccuuc

SEQ ID NO: 19774 - RNA, 20 nt, Artificial Sequence
  MKO10019774_A_Get4
  gRNA
cgagggcugcgccaacaugc

SEQ ID NO: 19775 - RNA, 20 nt, Artificial Sequence
  MKO10019775_A_Get4
  gRNA
cgaaucccuggaaaaggccg

SEQ ID NO: 19776 - RNA, 20 nt, Artificial Sequence
  MKO10019776_A_Get4
  gRNA
ugcccgaggcuuccgaagug

SEQ ID NO: 19777 - RNA, 20 nt, Artificial Sequence
  MKO10019777_A_Gfap
  gRNA
ccucgguccuagucgacaac

SEQ ID NO: 19778 - RNA, 20 nt, Artificial Sequence
  MKO10019778_A_Gfap
  gRNA
agagauucgcacucaauacg

SEQ ID NO: 19779 - RNA, 20 nt, Artificial Sequence
  MKO10019779_A_Gfap
  gRNA
cuggccggggcgcucaaugc

SEQ ID NO: 19780 - RNA, 20 nt, Artificial Sequence
  MKO10019780_A_Gfer
  gRNA
cgugggccuguccggguaau

SEQ ID NO: 19781 - RNA, 20 nt, Artificial Sequence
  MKO10019781_A_Gfer
  gRNA
cgcgucagucaccaggucgu

SEQ ID NO: 19782 - RNA, 20 nt, Artificial Sequence
  MKO10019782_A_Gfer
  gRNA
gcucgagaguagaugagcgu

SEQ ID NO: 19783 - RNA, 20 nt, Artificial Sequence
  MKO10019783_A_Gfi1b
  gRNA
uuccgccuccgcuacucucc

SEQ ID NO: 19784 - RNA, 20 nt, Artificial Sequence
  MKO10019784_A_Gfi1b
  gRNA
caccaugcaguccgccuucc

SEQ ID NO: 19785 - RNA, 20 nt, Artificial Sequence
  MKO10019785_A_Gfi1b
  gRNA
gcauacucacguccacucac

SEQ ID NO: 19786 - RNA, 20 nt, Artificial Sequence
  MKO10019786_A_Gfi1
  gRNA
cuaucggcagugcagcgcgc

SEQ ID NO: 19787 - RNA, 20 nt, Artificial Sequence
  MKO10019787_A_Gfi1
  gRNA
cuucgggcacgcggugagcc

SEQ ID NO: 19788 - RNA, 20 nt, Artificial Sequence
  MKO10019788_A_Gfi1
  gRNA
cuacggcgacuucgcgccug

SEQ ID NO: 19789 - RNA, 20 nt, Artificial Sequence
  MKO10019789_A_Gfm1
  gRNA
cugauuggaagacccgccga

SEQ ID NO: 19790 - RNA, 20 nt, Artificial Sequence
  MKO10019790_A_Gfm1
  gRNA
cguggacuuuaccauagaag

SEQ ID NO: 19791 - RNA, 20 nt, Artificial Sequence
  MKO10019791_A_Gfm1
  gRNA
caggauugccacgaugcacg

SEQ ID NO: 19792 - RNA, 20 nt, Artificial Sequence
  MKO10019792_A_Gfm2
  gRNA
uugaacagaauucguaauau

SEQ ID NO: 19793 - RNA, 20 nt, Artificial Sequence
  MKO10019793_A_Gfm2
  gRNA
ggaccacgauguucaccaaa

SEQ ID NO: 19794 - RNA, 20 nt, Artificial Sequence
  MKO10019794_A_Gfm2
  gRNA
uuccgucauuaacccuccug

SEQ ID NO: 19795 - RNA, 20 nt, Artificial Sequence
  MKO10019795_A_Gfod1
  gRNA
ugaccguaccgccacgccgc

SEQ ID NO: 19796 - RNA, 20 nt, Artificial Sequence
  MKO10019796_A_Gfod1
  gRNA
cuacaccagccgcaucgacg

SEQ ID NO: 19797 - RNA, 20 nt, Artificial Sequence
  MKO10019797_A_Gfod1
  gRNA
cgcuauugcgcuguccauag

SEQ ID NO: 19798 - RNA, 20 nt, Artificial Sequence
  MKO10019798_A_Gfod2
  gRNA
ggcagggggaucgccguacc

SEQ ID NO: 19799 - RNA, 20 nt, Artificial Sequence
  MKO10019799_A_Gfod2
  gRNA
gagcuguuucaugcgcacga

SEQ ID NO: 19800 - RNA, 20 nt, Artificial Sequence
  MKO10019800_A_Gfod2
  gRNA
gcugcaucaagacguagacc

SEQ ID NO: 19801 - RNA, 20 nt, Artificial Sequence
  MKO10019801_A_Gfpt1
  gRNA
cauacccguugggcgacaca

SEQ ID NO: 19802 - RNA, 20 nt, Artificial Sequence
  MKO10019802_A_Gfpt1
  gRNA
uucuccaugugucgcccaac

SEQ ID NO: 19803 - RNA, 20 nt, Artificial Sequence
  MKO10019803_A_Gfpt1
  gRNA
ucgaacaagacgagaaaucu

SEQ ID NO: 19804 - RNA, 20 nt, Artificial Sequence
  MKO10019804_A_Gfpt2
  gRNA
caacagucacccgcagcguu

SEQ ID NO: 19805 - RNA, 20 nt, Artificial Sequence
  MKO10019805_A_Gfpt2
  gRNA
uugucuuuguccgaacgcug

SEQ ID NO: 19806 - RNA, 20 nt, Artificial Sequence
  MKO10019806_A_Gfpt2
  gRNA
ucacuaauuacaaggaucua

SEQ ID NO: 19807 - RNA, 20 nt, Artificial Sequence
  MKO10019807_A_Gfra1
  gRNA
cauaugagccgguuaacagc

SEQ ID NO: 19808 - RNA, 20 nt, Artificial Sequence
  MKO10019808_A_Gfra1
  gRNA
gcggcgguugcagacuucau

SEQ ID NO: 19809 - RNA, 20 nt, Artificial Sequence
  MKO10019809_A_Gfra1
  gRNA
gauagucugucgccgccucu

SEQ ID NO: 19810 - RNA, 20 nt, Artificial Sequence
  MKO10019810_A_Gfra2
  gRNA
cugccgaagggugcgguacc

SEQ ID NO: 19811 - RNA, 20 nt, Artificial Sequence
  MKO10019811_A_Gfra2
  gRNA
ccgggaucgcaauaccaugc

SEQ ID NO: 19812 - RNA, 20 nt, Artificial Sequence
  MKO10019812_A_Gfra2
  gRNA
aggcaugcgccgagcgucgc

SEQ ID NO: 19813 - RNA, 20 nt, Artificial Sequence
  MKO10019813_A_Gfra3
  gRNA
cuuggugcuucaugcgccga

SEQ ID NO: 19814 - RNA, 20 nt, Artificial Sequence
  MKO10019814_A_Gfra3
  gRNA
caagugugaccgccugcgca

SEQ ID NO: 19815 - RNA, 20 nt, Artificial Sequence
  MKO10019815_A_Gfra3
  gRNA
cucucuaggugacuacgagu

SEQ ID NO: 19816 - RNA, 20 nt, Artificial Sequence
  MKO10019816_A_Gfra4
  gRNA
guccacgcagcgauucccgu

SEQ ID NO: 19817 - RNA, 20 nt, Artificial Sequence
  MKO10019817_A_Gfra4
  gRNA
gcguagacgcgcagacaacg

SEQ ID NO: 19818 - RNA, 20 nt, Artificial Sequence
  MKO10019818_A_Gfra4
  gRNA
cguugucugcgcgucuacgc

SEQ ID NO: 19819 - RNA, 20 nt, Artificial Sequence
  MKO10019819_A_Gfral
  gRNA
gccgaaaugaugaauuaugc

SEQ ID NO: 19820 - RNA, 20 nt, Artificial Sequence
  MKO10019820_A_Gfral
  gRNA
caaacagaugcagucuuguu

SEQ ID NO: 19821 - RNA, 20 nt, Artificial Sequence
  MKO10019821_A_Gfral
  gRNA
acauuguaaccugaguaucc

SEQ ID NO: 19822 - RNA, 20 nt, Artificial Sequence
  MKO10019822_A_Gfy
  gRNA
gcgcgguccucagaagaagu

SEQ ID NO: 19823 - RNA, 20 nt, Artificial Sequence
  MKO10019823_A_Gfy
  gRNA
acuucuacgcccccgaugcg

SEQ ID NO: 19824 - RNA, 20 nt, Artificial Sequence
  MKO10019824_A_Gfy
  gRNA
agccgcccacgaggcuccgu

SEQ ID NO: 19825 - RNA, 20 nt, Artificial Sequence
  MKO10019825_A_Gga1
  gRNA
caaccuugaugagcucguug

SEQ ID NO: 19826 - RNA, 20 nt, Artificial Sequence
  MKO10019826_A_Gga1
  gRNA
uccacuugccacucgcuugc

SEQ ID NO: 19827 - RNA, 20 nt, Artificial Sequence
  MKO10019827_A_Gga1
  gRNA
cucgcagaaacuguugaugc

SEQ ID NO: 19828 - RNA, 20 nt, Artificial Sequence
  MKO10019828_A_Gga2
  gRNA
aacucaccgucagggcauaa

SEQ ID NO: 19829 - RNA, 20 nt, Artificial Sequence
  MKO10019829_A_Gga2
  gRNA
uacuuuaguaccuaggggcc

SEQ ID NO: 19830 - RNA, 20 nt, Artificial Sequence
  MKO10019830_A_Gga2
  gRNA
ucagcccgacacaugcaccc

SEQ ID NO: 19831 - RNA, 20 nt, Artificial Sequence
  MKO10019831_A_Gga3
  gRNA
cggcugcaauauggcggagg

SEQ ID NO: 19832 - RNA, 20 nt, Artificial Sequence
  MKO10019832_A_Gga3
  gRNA
aaucaaagucgucucuccaa

SEQ ID NO: 19833 - RNA, 20 nt, Artificial Sequence
  MKO10019833_A_Gga3
  gRNA
uaccaauccuuccaaccgcc

SEQ ID NO: 19834 - RNA, 20 nt, Artificial Sequence
  MKO10019834_A_Ggacu
  gRNA
cagccaccuaugcacccgag

SEQ ID NO: 19835 - RNA, 20 nt, Artificial Sequence
  MKO10019835_A_Ggacu
  gRNA
augggcuacgcuacaacccc

SEQ ID NO: 19836 - RNA, 20 nt, Artificial Sequence
  MKO10019836_A_Ggacu
  gRNA
ggguuguagcguagcccaug

SEQ ID NO: 19837 - RNA, 20 nt, Artificial Sequence
  MKO10019837_A_Ggcu
  gRNA
cauggcgagcuccgacugug

SEQ ID NO: 19838 - RNA, 20 nt, Artificial Sequence
  MKO10019838_A_Ggcu
  gRNA
cgcucucguaguucgucauc

SEQ ID NO: 19839 - RNA, 20 nt, Artificial Sequence
  MKO10019839_A_Ggcu
  gRNA
ugcugccguaggcgaaguac

SEQ ID NO: 19840 - RNA, 20 nt, Artificial Sequence
  MKO10019840_A_Ggcx
  gRNA
acacguaccaguacgguagc

SEQ ID NO: 19841 - RNA, 20 nt, Artificial Sequence
  MKO10019841_A_Ggcx
  gRNA
gggagcuaaggccgcguucc

SEQ ID NO: 19842 - RNA, 20 nt, Artificial Sequence
  MKO10019842_A_Ggcx
  gRNA
uguuauuccugcuaccguac

SEQ ID NO: 19843 - RNA, 20 nt, Artificial Sequence
  MKO10019843_A_Ggh
  gRNA
guaaguucucuccacuaacc

SEQ ID NO: 19844 - RNA, 20 nt, Artificial Sequence
  MKO10019844_A_Ggh
  gRNA
gggaauaaccugaaucuguu

SEQ ID NO: 19845 - RNA, 20 nt, Artificial Sequence
  MKO10019845_A_Ggh
  gRNA
auacucugcaucacuaagau

SEQ ID NO: 19846 - RNA, 20 nt, Artificial Sequence
  MKO10019846_A_Ggnbp1
  gRNA
gggacagcucucgucgcuag

SEQ ID NO: 19847 - RNA, 20 nt, Artificial Sequence
  MKO10019847_A_Ggnbp1
  gRNA
gguggaccccaccuugcaag

SEQ ID NO: 19848 - RNA, 20 nt, Artificial Sequence
  MKO10019848_A_Ggnbp1
  gRNA
cuggaaggugggcaaccccg

SEQ ID NO: 19849 - RNA, 20 nt, Artificial Sequence
  MKO10019849_A_Ggnbp2
  gRNA
uucgcgugauguuaccacca

SEQ ID NO: 19850 - RNA, 20 nt, Artificial Sequence
  MKO10019850_A_Ggnbp2
  gRNA
cuucgacgacaaccaacaca

SEQ ID NO: 19851 - RNA, 20 nt, Artificial Sequence
  MKO10019851_A_Ggnbp2
  gRNA
aaacauaucuucgaaagcac

SEQ ID NO: 19852 - RNA, 20 nt, Artificial Sequence
  MKO10019852_A_Ggn
  gRNA
gccgacggugacgacguuga

SEQ ID NO: 19853 - RNA, 20 nt, Artificial Sequence
  MKO10019853_A_Ggn
  gRNA
aacccaagacucguacacgc

SEQ ID NO: 19854 - RNA, 20 nt, Artificial Sequence
  MKO10019854_A_Ggn
  gRNA
ccugcaagucguagugcucc

SEQ ID NO: 19855 - RNA, 20 nt, Artificial Sequence
  MKO10019855_A_Ggps1
  gRNA
aaaguauugugugcaguacc

SEQ ID NO: 19856 - RNA, 20 nt, Artificial Sequence
  MKO10019856_A_Ggps1
  gRNA
gugaaaagcuucaccgcauc

SEQ ID NO: 19857 - RNA, 20 nt, Artificial Sequence
  MKO10019857_A_Ggps1
  gRNA
ggugagaagcaaacuuucac

SEQ ID NO: 19858 - RNA, 20 nt, Artificial Sequence
  MKO10019858_A_Ggu1
  gRNA
aacgacacggccggcucccc

SEQ ID NO: 19859 - RNA, 20 nt, Artificial Sequence
  MKO10019859_A_Ggu1
  gRNA
cgcccccgaugcccauacug

SEQ ID NO: 19860 - RNA, 20 nt, Artificial Sequence
  MKO10019860_A_Ggu1
  gRNA
ugcuuguagggauauccuac

SEQ ID NO: 19861 - RNA, 20 nt, Artificial Sequence
  MKO10019861_A_Ggu5
  gRNA
ggagcuccgcggcuaugcug

SEQ ID NO: 19862 - RNA, 20 nt, Artificial Sequence
  MKO10019862_A_Ggu5
  gRNA
guguaaaaacguccugccau

SEQ ID NO: 19863 - RNA, 20 nt, Artificial Sequence
  MKO10019863_A_Ggu5
  gRNA
caccauugcacugcuccgag

SEQ ID NO: 19864 - RNA, 20 nt, Artificial Sequence
  MKO10019864_A_Ggu6
  gRNA
gggguccuguucacgacucc

SEQ ID NO: 19865 - RNA, 20 nt, Artificial Sequence
  MKO10019865_A_Ggu6
  gRNA
gccaagaguugcuugucgcu

SEQ ID NO: 19866 - RNA, 20 nt, Artificial Sequence
  MKO10019866_A_Ggu6
  gRNA
acucauccuucgugacaacc

SEQ ID NO: 19867 - RNA, 20 nt, Artificial Sequence
  MKO10019867_A_Ggu7
  gRNA
gcggcugccuucgucgucau

SEQ ID NO: 19868 - RNA, 20 nt, Artificial Sequence
  MKO10019868_A_Ggu7
  gRNA
uccuugcgagucucccguaa

SEQ ID NO: 19869 - RNA, 20 nt, Artificial Sequence
  MKO10019869_A_Ggu7
  gRNA
caugcccagcgccgugcaac

SEQ ID NO: 19870 - RNA, 20 nt, Artificial Sequence
  MKO10019870_A_Ggua1
  gRNA
gaugcugauugucucaaccg

SEQ ID NO: 19871 - RNA, 20 nt, Artificial Sequence
  MKO10019871_A_Ggua1
  gRNA
uucccaaaacacgacaacca

SEQ ID NO: 19872 - RNA, 20 nt, Artificial Sequence
  MKO10019872_A_Ggua1
  gRNA
uugaaccagucccauagcug

SEQ ID NO: 19873 - RNA, 20 nt, Artificial Sequence
  MKO10019873_A_Ghdc
  gRNA
cugggccggguaagccccga

SEQ ID NO: 19874 - RNA, 20 nt, Artificial Sequence
  MKO10019874_A_Ghdc
  gRNA
ccgcuccuuaggugccgccu

SEQ ID NO: 19875 - RNA, 20 nt, Artificial Sequence
  MKO10019875_A_Ghdc
  gRNA
gugugaccccuacaucgcca

SEQ ID NO: 19876 - RNA, 20 nt, Artificial Sequence
  MKO10019876_A_Ghitm
  gRNA
ugugcuugcagucgaucaaa

SEQ ID NO: 19877 - RNA, 20 nt, Artificial Sequence
  MKO10019877_A_Ghitm
  gRNA
cuuggagcgcucugcuacua

SEQ ID NO: 19878 - RNA, 20 nt, Artificial Sequence
  MKO10019878_A_Ghitm
  gRNA
cucaugaacuucaugaugac

SEQ ID NO: 19879 - RNA, 20 nt, Artificial Sequence
  MKO10019879_A_Ghrhr
  gRNA
agccacgcagagggcuacaa

SEQ ID NO: 19880 - RNA, 20 nt, Artificial Sequence
  MKO10019880_A_Ghrhr
  gRNA
cuccauuguagcccucugcg

SEQ ID NO: 19881 - RNA, 20 nt, Artificial Sequence
  MKO10019881_A_Ghrhr
  gRNA
ccgaagugagagaagaauuc

SEQ ID NO: 19882 - RNA, 20 nt, Artificial Sequence
  MKO10019882_A_Ghrh
  gRNA
ggggcucaagcguccgcuga

SEQ ID NO: 19883 - RNA, 20 nt, Artificial Sequence
  MKO10019883_A_Ghrh
  gRNA
ucacuuuccgggcauacagc

SEQ ID NO: 19884 - RNA, 20 nt, Artificial Sequence
  MKO10019884_A_Ghrh
  gRNA
aagggccaggcucagccgcc

SEQ ID NO: 19885 - RNA, 20 nt, Artificial Sequence
  MKO10019885_A_Ghrl
  gRNA
uaaacugcagccacgagcuc

SEQ ID NO: 19886 - RNA, 20 nt, Artificial Sequence
  MKO10019886_A_Ghrl
  gRNA
uucaaugcucccuucgaugu

SEQ ID NO: 19887 - RNA, 20 nt, Artificial Sequence
  MKO10019887_A_Ghrl
  gRNA
cagcuugaugccaacaucga

SEQ ID NO: 19888 - RNA, 20 nt, Artificial Sequence
  MKO10019888_A_Ghr
  gRNA
gaacgacacuuggugaaucg

SEQ ID NO: 19889 - RNA, 20 nt, Artificial Sequence
  MKO10019889_A_Ghr
  gRNA
uaguacagcugaauagaucc

SEQ ID NO: 19890 - RNA, 20 nt, Artificial Sequence
  MKO10019890_A_Ghr
  gRNA
cuaaccuugcagcuugucgu

SEQ ID NO: 19891 - RNA, 20 nt, Artificial Sequence
  MKO10019891_A_Ghsr
  gRNA
gccggagccuaacgucacgc

SEQ ID NO: 19892 - RNA, 20 nt, Artificial Sequence
  MKO10019892_A_Ghsr
  gRNA
ucguccgccucuggcaguau

SEQ ID NO: 19893 - RNA, 20 nt, Artificial Sequence
  MKO10019893_A_Ghsr
  gRNA
gaucagucaguacugcaacc

SEQ ID NO: 19894 - RNA, 20 nt, Artificial Sequence
  MKO10019894_A_Gh
  gRNA
cgcgucgucgcugcgcaugu

SEQ ID NO: 19895 - RNA, 20 nt, Artificial Sequence
  MKO10019895_A_Gh
  gRNA
caugaagugucgccgcuuug

SEQ ID NO: 19896 - RNA, 20 nt, Artificial Sequence
  MKO10019896_A_Gh
  gRNA
ggagcgugccuacauucccg

SEQ ID NO: 19897 - RNA, 20 nt, Artificial Sequence
  MKO10019897_A_Gid4
  gRNA
ucccacuuccgaguuaagaa

SEQ ID NO: 19898 - RNA, 20 nt, Artificial Sequence
  MKO10019898_A_Gid4
  gRNA
cuuaccauucugagcuccga

SEQ ID NO: 19899 - RNA, 20 nt, Artificial Sequence
  MKO10019899_A_Gid4
  gRNA
acuaccaucggagcucagaa

SEQ ID NO: 19900 - RNA, 20 nt, Artificial Sequence
  MKO10019900_A_Gid8
  gRNA
gguauggagugaaguuaacc

SEQ ID NO: 19901 - RNA, 20 nt, Artificial Sequence
  MKO10019901_A_Gid8
  gRNA
ucgagaguccacacccaagc

SEQ ID NO: 19902 - RNA, 20 nt, Artificial Sequence
  MKO10019902_A_Gid8
  gRNA
cuagguaguucaugaugagu

SEQ ID NO: 19903 - RNA, 20 nt, Artificial Sequence
  MKO10019903_A_Gif
  gRNA
cuuagcgaagcgcacugcga

SEQ ID NO: 19904 - RNA, 20 nt, Artificial Sequence
  MKO10019904_A_Gif
  gRNA
agugcgaggaucgccaaacc

SEQ ID NO: 19905 - RNA, 20 nt, Artificial Sequence
  MKO10019905_A_Gif
  gRNA
aguucuccaugagcgcuugu

SEQ ID NO: 19906 - RNA, 20 nt, Artificial Sequence
  MKO10019906_A_Gigyf1
  gRNA
agauuaccgcuaugggcgag

SEQ ID NO: 19907 - RNA, 20 nt, Artificial Sequence
  MKO10019907_A_Gigyf1
  gRNA
cucccgaggauuccuuccga

SEQ ID NO: 19908 - RNA, 20 nt, Artificial Sequence
  MKO10019908_A_Gigyf1
  gRNA
ccacgcugccaccacucgaa

SEQ ID NO: 19909 - RNA, 20 nt, Artificial Sequence
  MKO10019909_A_Gigyf2
  gRNA
gccgcuguccugcgauugac

SEQ ID NO: 19910 - RNA, 20 nt, Artificial Sequence
  MKO10019910_A_Gigyf2
  gRNA
cuccucguccugucaaucgc

SEQ ID NO: 19911 - RNA, 20 nt, Artificial Sequence
  MKO10019911_A_Gigyf2
  gRNA
aaauuagcagauuaucgaua

SEQ ID NO: 19912 - RNA, 20 nt, Artificial Sequence
  MKO10019912_A_Gimap1
  gRNA
cccgaauaaccgcuucaccg

SEQ ID NO: 19913 - RNA, 20 nt, Artificial Sequence
  MKO10019913_A_Gimap1
  gRNA
ggugauggcgcgcacugucg

SEQ ID NO: 19914 - RNA, 20 nt, Artificial Sequence
  MKO10019914_A_Gimap1
  gRNA
agagaugaggaagacgccua

SEQ ID NO: 19915 - RNA, 20 nt, Artificial Sequence
  MKO10019915_A_Gimap3
  gRNA
ccuccccauaggcaaaaagu

SEQ ID NO: 19916 - RNA, 20 nt, Artificial Sequence
  MKO10019916_A_Gimap3
  gRNA
caaccgcagccugcgcagcc

SEQ ID NO: 19917 - RNA, 20 nt, Artificial Sequence
  MKO10019917_A_Gimap3
  gRNA
acacuucagaauguuguaac

SEQ ID NO: 19918 - RNA, 20 nt, Artificial Sequence
  MKO10019918_A_Gimap4
  gRNA
ugaacaaacaguagcgauuc

SEQ ID NO: 19919 - RNA, 20 nt, Artificial Sequence
  MKO10019919_A_Gimap4
  gRNA
ugaaccccgcaccaccgcac

SEQ ID NO: 19920 - RNA, 20 nt, Artificial Sequence
  MKO10019920_A_Gimap4
  gRNA
gcuacaauggaaguccagug

SEQ ID NO: 19921 - RNA, 20 nt, Artificial Sequence
  MKO10019921_A_Gimap5
  gRNA
uuugcacagucaaguccugc

SEQ ID NO: 19922 - RNA, 20 nt, Artificial Sequence
  MKO10019922_A_Gimap5
  gRNA
ucauuaacuuguguauuagc

SEQ ID NO: 19923 - RNA, 20 nt, Artificial Sequence
  MKO10019923_A_Gimap5
  gRNA
uuccauaugugcucuucuga

SEQ ID NO: 19924 - RNA, 20 nt, Artificial Sequence
  MKO10019924_A_Gimap6
  gRNA
gguaggccgguacacugccg

SEQ ID NO: 19925 - RNA, 20 nt, Artificial Sequence
  MKO10019925_A_Gimap6
  gRNA
cacuggucgagcgcugauuu

SEQ ID NO: 19926 - RNA, 20 nt, Artificial Sequence
  MKO10019926_A_Gimap6
  gRNA
uucuauagaacaugagccga

SEQ ID NO: 19927 - RNA, 20 nt, Artificial Sequence
  MKO10019927_A_Gimap7
  gRNA
ucgcuccgcguccuuguaua

SEQ ID NO: 19928 - RNA, 20 nt, Artificial Sequence
  MKO10019928_A_Gimap7
  gRNA
cuucgacaccaagguaaaac

SEQ ID NO: 19929 - RNA, 20 nt, Artificial Sequence
  MKO10019929_A_Gimap7
  gRNA
ucugcaacugaaccgcuuca

SEQ ID NO: 19930 - RNA, 20 nt, Artificial Sequence
  MKO10019930_A_Gimap8
  gRNA
ccaucauucauccagacgcc

SEQ ID NO: 19931 - RNA, 20 nt, Artificial Sequence
  MKO10019931_A_Gimap8
  gRNA
caacaccacgcuuccccauc

SEQ ID NO: 19932 - RNA, 20 nt, Artificial Sequence
  MKO10019932_A_Gimap8
  gRNA
gauacgcaaucuucaacuac

SEQ ID NO: 19933 - RNA, 20 nt, Artificial Sequence
  MKO10019933_A_Gimap9
  gRNA
cuuguuguagucgacacucc

SEQ ID NO: 19934 - RNA, 20 nt, Artificial Sequence
  MKO10019934_A_Gimap9
  gRNA
aaucaaauugacgucucccg

SEQ ID NO: 19935 - RNA, 20 nt, Artificial Sequence
  MKO10019935_A_Gimap9
  gRNA
ccaaguaacgcuucccacac

SEQ ID NO: 19936 - RNA, 20 nt, Artificial Sequence
  MKO10019936_A_Gin1
  gRNA
ucuaaucgcagcuacgauuc

SEQ ID NO: 19937 - RNA, 20 nt, Artificial Sequence
  MKO10019937_A_Gin1
  gRNA
aaucguagcugcgauuagag

SEQ ID NO: 19938 - RNA, 20 nt, Artificial Sequence
  MKO10019938_A_Gin1
  gRNA
uacccacugcuugacgucau

SEQ ID NO: 19939 - RNA, 20 nt, Artificial Sequence
  MKO10019939_A_Ginm1
  gRNA
ugaggaucuuaguucucgag

SEQ ID NO: 19940 - RNA, 20 nt, Artificial Sequence
  MKO10019940_A_Ginm1
  gRNA
cuuaacauaaccuaugagcg

SEQ ID NO: 19941 - RNA, 20 nt, Artificial Sequence
  MKO10019941_A_Ginm1
  gRNA
auauaccuguccacgcucau

SEQ ID NO: 19942 - RNA, 20 nt, Artificial Sequence
  MKO10019942_A_Gins1
  gRNA
cuagguaugaccgguugcuu

SEQ ID NO: 19943 - RNA, 20 nt, Artificial Sequence
  MKO10019943_A_Gins1
  gRNA
gugcucuaauccgaagcaac

SEQ ID NO: 19944 - RNA, 20 nt, Artificial Sequence
  MKO10019944_A_Gins1
  gRNA
ugauaccaaccgucaaauuu

SEQ ID NO: 19945 - RNA, 20 nt, Artificial Sequence
  MKO10019945_A_Gins2
  gRNA
cuccgagagcacccagucgc

SEQ ID NO: 19946 - RNA, 20 nt, Artificial Sequence
  MKO10019946_A_Gins2
  gRNA
cuucaaccccggcuuacccg

SEQ ID NO: 19947 - RNA, 20 nt, Artificial Sequence
  MKO10019947_A_Gins2
  gRNA
agugcccagcccgcacuaca

SEQ ID NO: 19948 - RNA, 20 nt, Artificial Sequence
  MKO10019948_A_Gins3
  gRNA
cgagacgcccaugccgcgcc

SEQ ID NO: 19949 - RNA, 20 nt, Artificial Sequence
  MKO10019949_A_Gins3
  gRNA
guccgaggcguauuucccag

SEQ ID NO: 19950 - RNA, 20 nt, Artificial Sequence
  MKO10019950_A_Gins3
  gRNA
ucuccggacugucaaaaugc

SEQ ID NO: 19951 - RNA, 20 nt, Artificial Sequence
  MKO10019951_A_Gins4
  gRNA
ugagauugucgaaugcguca

SEQ ID NO: 19952 - RNA, 20 nt, Artificial Sequence
  MKO10019952_A_Gins4
  gRNA
uccucuccaucuccaugcga

SEQ ID NO: 19953 - RNA, 20 nt, Artificial Sequence
  MKO10019953_A_Gins4
  gRNA
gaaggucagcauccaucgca

SEQ ID NO: 19954 - RNA, 20 nt, Artificial Sequence
  MKO10019954_A_Gipc1
  gRNA
ggacccuccgucuccgaucc

SEQ ID NO: 19955 - RNA, 20 nt, Artificial Sequence
  MKO10019955_A_Gipc1
  gRNA
gcugggcugucggcauuacg

SEQ ID NO: 19956 - RNA, 20 nt, Artificial Sequence
  MKO10019956_A_Gipc1
  gRNA
ggccggcuacgccuucauua

SEQ ID NO: 19957 - RNA, 20 nt, Artificial Sequence
  MKO10019957_A_Gipc2
  gRNA
acccuccgucugagaucgaa

SEQ ID NO: 19958 - RNA, 20 nt, Artificial Sequence
  MKO10019958_A_Gipc2
  gRNA
gcccacgccguuauccguga

SEQ ID NO: 19959 - RNA, 20 nt, Artificial Sequence
  MKO10019959_A_Gipc2
  gRNA
ggccuuucgaucucagacgg

SEQ ID NO: 19960 - RNA, 20 nt, Artificial Sequence
  MKO10019960_A_Gipc3
  gRNA
cgcugccgcuuccacaucgc

SEQ ID NO: 19961 - RNA, 20 nt, Artificial Sequence
  MKO10019961_A_Gipc3
  gRNA
cagcauuaucaaccggauug

SEQ ID NO: 19962 - RNA, 20 nt, Artificial Sequence
  MKO10019962_A_Gipc3
  gRNA
agccggauacgccuucauca

SEQ ID NO: 19963 - RNA, 20 nt, Artificial Sequence
  MKO10019963_A_Gipr
  gRNA
cauaucgaaggaaccguuac

SEQ ID NO: 19964 - RNA, 20 nt, Artificial Sequence
  MKO10019964_A_Gipr
  gRNA
gcgcugguacagcucccccg

SEQ ID NO: 19965 - RNA, 20 nt, Artificial Sequence
  MKO10019965_A_Gipr
  gRNA
ccacgguauacaugaucugc

SEQ ID NO: 19966 - RNA, 20 nt, Artificial Sequence
  MKO10019966_A_Gip
  gRNA
gacaacaagacuucgugaac

SEQ ID NO: 19967 - RNA, 20 nt, Artificial Sequence
  MKO10019967_A_Gip
  gRNA
aaaguccccucugcguaccu

SEQ ID NO: 19968 - RNA, 20 nt, Artificial Sequence
  MKO10019968_A_Gip
  gRNA
aaacagagcucugccgacuc

SEQ ID NO: 19969 - RNA, 20 nt, Artificial Sequence
  MKO10019969_A_Git1
  gRNA
uucucaccuggcauagucga

SEQ ID NO: 19970 - RNA, 20 nt, Artificial Sequence
  MKO10019970_A_Git1
  gRNA
cugcacucaagugugcgaac

SEQ ID NO: 19971 - RNA, 20 nt, Artificial Sequence
  MKO10019971_A_Git1
  gRNA
cggccacuuugcacuugcgc

SEQ ID NO: 19972 - RNA, 20 nt, Artificial Sequence
  MKO10019972_A_Git2
  gRNA
gacgugugcgccgacugcaa

SEQ ID NO: 19973 - RNA, 20 nt, Artificial Sequence
  MKO10019973_A_Git2
  gRNA
ccaccgauugcccugccgcg

SEQ ID NO: 19974 - RNA, 20 nt, Artificial Sequence
  MKO10019974_A_Git2
  gRNA
aagcgggcaccaugucgaag

SEQ ID NO: 19975 - RNA, 20 nt, Artificial Sequence
  MKO10019975_A_Gja10
  gRNA
ucauccgagucaauauacca

SEQ ID NO: 19976 - RNA, 20 nt, Artificial Sequence
  MKO10019976_A_Gja10
  gRNA
gugucgcugcugaggacguc

SEQ ID NO: 19977 - RNA, 20 nt, Artificial Sequence
  MKO10019977_A_Gja10
  gRNA
aaaaucaugagggcacucga

SEQ ID NO: 19978 - RNA, 20 nt, Artificial Sequence
  MKO10019978_A_Gja1
  gRNA
ucgcugauccacgauagcua

SEQ ID NO: 19979 - RNA, 20 nt, Artificial Sequence
  MKO10019979_A_Gja1
  gRNA
ugcagguguagaccgcacuc

SEQ ID NO: 19980 - RNA, 20 nt, Artificial Sequence
  MKO10019980_A_Gja1
  gRNA
cucaaaguggcgcagaccga

SEQ ID NO: 19981 - RNA, 20 nt, Artificial Sequence
  MKO10019981_A_Gja3
  gRNA
ggucgcgagccaaugcguac

SEQ ID NO: 19982 - RNA, 20 nt, Artificial Sequence
  MKO10019982_A_Gja3
  gRNA
uacgcauuggcucgcgacca

SEQ ID NO: 19983 - RNA, 20 nt, Artificial Sequence
  MKO10019983_A_Gja3
  gRNA
ccuccacuacgcgaugaccg

SEQ ID NO: 19984 - RNA, 20 nt, Artificial Sequence
  MKO10019984_A_Gja4
  gRNA
accgcucuucccgccgagac

SEQ ID NO: 19985 - RNA, 20 nt, Artificial Sequence
  MKO10019985_A_Gja4
  gRNA
ccaggaacacucgaccgugg

SEQ ID NO: 19986 - RNA, 20 nt, Artificial Sequence
  MKO10019986_A_Gja4
  gRNA
ccuacauguagagcgggcac

SEQ ID NO: 19987 - RNA, 20 nt, Artificial Sequence
  MKO10019987_A_Gja5
  gRNA
ugacaaacggcgccuuagua

SEQ ID NO: 19988 - RNA, 20 nt, Artificial Sequence
  MKO10019988_A_Gja5
  gRNA
aagaagauccgacagcgcuu

SEQ ID NO: 19989 - RNA, 20 nt, Artificial Sequence
  MKO10019989_A_Gja5
  gRNA
uaaggcgccguuugucacua

SEQ ID NO: 19990 - RNA, 20 nt, Artificial Sequence
  MKO10019990_A_Gja6
  gRNA
gcacugcuaucgagucggcu

SEQ ID NO: 19991 - RNA, 20 nt, Artificial Sequence
  MKO10019991_A_Gja6
  gRNA
ccgacucgauagcagugccc

SEQ ID NO: 19992 - RNA, 20 nt, Artificial Sequence
  MKO10019992_A_Gja6
  gRNA
aggaagcaguccacccgacg

SEQ ID NO: 19993 - RNA, 20 nt, Artificial Sequence
  MKO10019993_A_Gja8
  gRNA
cgcgguacaccacguucgca

SEQ ID NO: 19994 - RNA, 20 nt, Artificial Sequence
  MKO10019994_A_Gja8
  gRNA
cacuccaucgcugauguacg

SEQ ID NO: 19995 - RNA, 20 nt, Artificial Sequence
  MKO10019995_A_Gja8
  gRNA
gcuucuccuccaugcgaacg

SEQ ID NO: 19996 - RNA, 20 nt, Artificial Sequence
  MKO10019996_A_Gjb1
  gRNA
ggccgaagcccgagcccuug

SEQ ID NO: 19997 - RNA, 20 nt, Artificial Sequence
  MKO10019997_A_Gjb1
  gRNA
caucugcauuauccucaacg

SEQ ID NO: 19998 - RNA, 20 nt, Artificial Sequence
  MKO10019998_A_Gjb1
  gRNA
acacuugaccagccgcacca

SEQ ID NO: 19999 - RNA, 20 nt, Artificial Sequence
  MKO10019999_A_Gjb2
  gRNA
uccguaucgaagggucccug

SEQ ID NO: 20000 - RNA, 20 nt, Artificial Sequence
  MKO10020000_A_Gjb2
  gRNA
cuuccgcaucaugauccucg

SEQ ID NO: 20001 - RNA, 20 nt, Artificial Sequence
  MKO10020001_A_Gjb2
  gRNA
accacagggacccuucgaua

SEQ ID NO: 20002 - RNA, 20 nt, Artificial Sequence
  MKO10020002_A_Gjb3
  gRNA
cgucacguguccgucuaugc

SEQ ID NO: 20003 - RNA, 20 nt, Artificial Sequence
  MKO10020003_A_Gjb3
  gRNA
uugcuacaucgcucggccca

SEQ ID NO: 20004 - RNA, 20 nt, Artificial Sequence
  MKO10020004_A_Gjb3
  gRNA
ccgagcgauguagcaaucca

SEQ ID NO: 20005 - RNA, 20 nt, Artificial Sequence
  MKO10020005_A_Gjb4
  gRNA
aggucuuccguccccggcgc

SEQ ID NO: 20006 - RNA, 20 nt, Artificial Sequence
  MKO10020006_A_Gjb4
  gRNA
aagcuuuccggcgccgggga

SEQ ID NO: 20007 - RNA, 20 nt, Artificial Sequence
  MKO10020007_A_Gjb4
  gRNA
ccuaucgugaagagcgagaa

SEQ ID NO: 20008 - RNA, 20 nt, Artificial Sequence
  MKO10020008_A_Gjb5
  gRNA
gguuaccuuuacccgaaucc

SEQ ID NO: 20009 - RNA, 20 nt, Artificial Sequence
  MKO10020009_A_Gjb5
  gRNA
caugcauguggccuaucgaa

SEQ ID NO: 20010 - RNA, 20 nt, Artificial Sequence
  MKO10020010_A_Gjb5
  gRNA
gaguccaccccgcuucuugc

SEQ ID NO: 20011 - RNA, 20 nt, Artificial Sequence
  MKO10020011_A_Gjb6
  gRNA
acugcccgaaaguuuauacg

SEQ ID NO: 20012 - RNA, 20 nt, Artificial Sequence
  MKO10020012_A_Gjb6
  gRNA
cuuguucacgccaccgauga

SEQ ID NO: 20013 - RNA, 20 nt, Artificial Sequence
  MKO10020013_A_Gjb6
  gRNA
acggcagaaggugcgcauug

SEQ ID NO: 20014 - RNA, 20 nt, Artificial Sequence
  MKO10020014_A_Gjc1
  gRNA
cgacgacgaauucgagagga

SEQ ID NO: 20015 - RNA, 20 nt, Artificial Sequence
  MKO10020015_A_Gjc1
  gRNA
gcaaacccuaugccaugcgu

SEQ ID NO: 20016 - RNA, 20 nt, Artificial Sequence
  MKO10020016_A_Gjc1
  gRNA
cauccucucgaauucgucgu

SEQ ID NO: 20017 - RNA, 20 nt, Artificial Sequence
  MKO10020017_A_Gjc2
  gRNA
cgcgacaguccgccgugcgc

SEQ ID NO: 20018 - RNA, 20 nt, Artificial Sequence
  MKO10020018_A_Gjc2
  gRNA
aaccggcagcgccacgucgg

SEQ ID NO: 20019 - RNA, 20 nt, Artificial Sequence
  MKO10020019_A_Gjc2
  gRNA
gcgcugcaggcguugcgcga

SEQ ID NO: 20020 - RNA, 20 nt, Artificial Sequence
  MKO10020020_A_Gjc3
  gRNA
ucaucauugccgaaaacccc

SEQ ID NO: 20021 - RNA, 20 nt, Artificial Sequence
  MKO10020021_A_Gjc3
  gRNA
cacaaccgaugaauugucag

SEQ ID NO: 20022 - RNA, 20 nt, Artificial Sequence
  MKO10020022_A_Gjc3
  gRNA
ugaauuuaccugcacuugau

SEQ ID NO: 20023 - RNA, 20 nt, Artificial Sequence
  MKO10020023_A_Gjd2
  gRNA
ccgccaagcagcgagaacgc

SEQ ID NO: 20024 - RNA, 20 nt, Artificial Sequence
  MKO10020024_A_Gjd2
  gRNA
guucucgcugcuuggcggau

SEQ ID NO: 20025 - RNA, 20 nt, Artificial Sequence
  MKO10020025_A_Gjd2
  gRNA
cagcagcacuccacuaugau

SEQ ID NO: 20026 - RNA, 20 nt, Artificial Sequence
  MKO10020026_A_Gjd3
  gRNA
cugcuacgaucgcgccuucc

SEQ ID NO: 20027 - RNA, 20 nt, Artificial Sequence
  MKO10020027_A_Gjd3
  gRNA
cuucgccgucgggcugcugu

SEQ ID NO: 20028 - RNA, 20 nt, Artificial Sequence
  MKO10020028_A_Gjd3
  gRNA
gcagcuacagucgccgcucg

SEQ ID NO: 20029 - RNA, 20 nt, Artificial Sequence
  MKO10020029_A_Gjd4
  gRNA
aaagaggucguagcaaacgu

SEQ ID NO: 20030 - RNA, 20 nt, Artificial Sequence
  MKO10020030_A_Gjd4
  gRNA
cugcagccagcuucgcaccg

SEQ ID NO: 20031 - RNA, 20 nt, Artificial Sequence
  MKO10020031_A_Gjd4
  gRNA
gauggucacguuacaguuua

SEQ ID NO: 20032 - RNA, 20 nt, Artificial Sequence
  MKO10020032_A_Gje1
  gRNA
cacauuuacugugaucacga

SEQ ID NO: 20033 - RNA, 20 nt, Artificial Sequence
  MKO10020033_A_Gje1
  gRNA
gccagaaugcgaacaccucc

SEQ ID NO: 20034 - RNA, 20 nt, Artificial Sequence
  MKO10020034_A_Gje1
  gRNA
aacuggccgaucacaguugg

SEQ ID NO: 20035 - RNA, 20 nt, Artificial Sequence
  MKO10020035_A_Gk2
  gRNA
agauuugucuacgaucuuga

SEQ ID NO: 20036 - RNA, 20 nt, Artificial Sequence
  MKO10020036_A_Gk2
  gRNA
gcucccagggccgucguuuc

SEQ ID NO: 20037 - RNA, 20 nt, Artificial Sequence
  MKO10020037_A_Gk2
  gRNA
cacgccgauagcuuuaaugu

SEQ ID NO: 20038 - RNA, 20 nt, Artificial Sequence
  MKO10020038_A_Gk5
  gRNA
ucaaucuuaagguggcaugc

SEQ ID NO: 20039 - RNA, 20 nt, Artificial Sequence
  MKO10020039_A_Gk5
  gRNA
gaaaauguuuacccucaacc

SEQ ID NO: 20040 - RNA, 20 nt, Artificial Sequence
  MKO10020040_A_Gk5
  gRNA
augccaccuuaagauugacc

SEQ ID NO: 20041 - RNA, 20 nt, Artificial Sequence
  MKO10020041_A_Gkap1
  gRNA
ucaacagcaacgccuucuca

SEQ ID NO: 20042 - RNA, 20 nt, Artificial Sequence
  MKO10020042_A_Gkap1
  gRNA
ucccgugacuccuucugugc

SEQ ID NO: 20043 - RNA, 20 nt, Artificial Sequence
  MKO10020043_A_Gkap1
  gRNA
guuugaagcugaccuugaga

SEQ ID NO: 20044 - RNA, 20 nt, Artificial Sequence
  MKO10020044_A_Gkn1
  gRNA
ccuucaggaccucgauacaa

SEQ ID NO: 20045 - RNA, 20 nt, Artificial Sequence
  MKO10020045_A_Gkn1
  gRNA
gugcuuucagauguucgucg

SEQ ID NO: 20046 - RNA, 20 nt, Artificial Sequence
  MKO10020046_A_Gkn1
  gRNA
agacuuacguaagcaaaacc

SEQ ID NO: 20047 - RNA, 20 nt, Artificial Sequence
  MKO10020047_A_Gkn2
  gRNA
ugcuugcauagcugucgaau

SEQ ID NO: 20048 - RNA, 20 nt, Artificial Sequence
  MKO10020048_A_Gkn2
  gRNA
acgguuccucuacgagaagc

SEQ ID NO: 20049 - RNA, 20 nt, Artificial Sequence
  MKO10020049_A_Gkn2
  gRNA
ucgacuccccagaguauacc

SEQ ID NO: 20050 - RNA, 20 nt, Artificial Sequence
  MKO10020050_A_Gkn3
  gRNA
cacuagcgacaguuauccuc

SEQ ID NO: 20051 - RNA, 20 nt, Artificial Sequence
  MKO10020051_A_Gkn3
  gRNA
caccucugagggcaucgaca

SEQ ID NO: 20052 - RNA, 20 nt, Artificial Sequence
  MKO10020052_A_Gkn3
  gRNA
cucaccgucagcgccagagc

SEQ ID NO: 20053 - RNA, 20 nt, Artificial Sequence
  MKO10020053_A_Gla
  gRNA
cuaaacucacguaauuugcg

SEQ ID NO: 20054 - RNA, 20 nt, Artificial Sequence
  MKO10020054_A_Gla
  gRNA
ugucugcgcaucaaugucau

SEQ ID NO: 20055 - RNA, 20 nt, Artificial Sequence
  MKO10020055_A_Gla
  gRNA
gauccccaacgcuuuccuag

SEQ ID NO: 20056 - RNA, 20 nt, Artificial Sequence
  MKO10020056_A_Glb1l2
  gRNA
auucgacuucuccgggaacc

SEQ ID NO: 20057 - RNA, 20 nt, Artificial Sequence
  MKO10020057_A_Glb1l2
  gRNA
agacgacauacucuaggucc

SEQ ID NO: 20058 - RNA, 20 nt, Artificial Sequence
  MKO10020058_A_Glb1l2
  gRNA
auggcuccaacaucagcgcc

SEQ ID NO: 20059 - RNA, 20 nt, Artificial Sequence
  MKO10020059_A_Glb1l3
  gRNA
uacacuacuuccgggugccc

SEQ ID NO: 20060 - RNA, 20 nt, Artificial Sequence
  MKO10020060_A_Glb1l3
  gRNA
gcaaaacccgauaggacagu

SEQ ID NO: 20061 - RNA, 20 nt, Artificial Sequence
  MKO10020061_A_Glb1l3
  gRNA
cuuacagcaagcaucguucc

SEQ ID NO: 20062 - RNA, 20 nt, Artificial Sequence
  MKO10020062_A_Glb1l
  gRNA
gcgguacucgaaaguagugc

SEQ ID NO: 20063 - RNA, 20 nt, Artificial Sequence
  MKO10020063_A_Glb1l
  gRNA
gcacuacuuucgaguaccgc

SEQ ID NO: 20064 - RNA, 20 nt, Artificial Sequence
  MKO10020064_A_Glb1l
  gRNA
aggguuucgaagcaaccaag

SEQ ID NO: 20065 - RNA, 20 nt, Artificial Sequence
  MKO10020065_A_Glb1
  gRNA
aggaccgaucauaaccgugc

SEQ ID NO: 20066 - RNA, 20 nt, Artificial Sequence
  MKO10020066_A_Glb1
  gRNA
gguaccugcacgguuaugau

SEQ ID NO: 20067 - RNA, 20 nt, Artificial Sequence
  MKO10020067_A_Glb1
  gRNA
gucuucacagguacgugccc

SEQ ID NO: 20068 - RNA, 20 nt, Artificial Sequence
  MKO10020068_A_Glcci1
  gRNA
caaagcagauugccaaacuu

SEQ ID NO: 20069 - RNA, 20 nt, Artificial Sequence
  MKO10020069_A_Glcci1
  gRNA
cacaucagcgcucugcauca

SEQ ID NO: 20070 - RNA, 20 nt, Artificial Sequence
  MKO10020070_A_Glcci1
  gRNA
aagugcugaucaacugaaag

SEQ ID NO: 20071 - RNA, 20 nt, Artificial Sequence
  MKO10020071_A_Glce
  gRNA
aucgaucauagccgucauac

SEQ ID NO: 20072 - RNA, 20 nt, Artificial Sequence
  MKO10020072_A_Glce
  gRNA
uuccaugccgcgcucguaca

SEQ ID NO: 20073 - RNA, 20 nt, Artificial Sequence
  MKO10020073_A_Glce
  gRNA
cuauugaagcccccaacaac

SEQ ID NO: 20074 - RNA, 20 nt, Artificial Sequence
  MKO10020074_A_Gldc
  gRNA
cuccaguaaguuccgcaaaa

SEQ ID NO: 20075 - RNA, 20 nt, Artificial Sequence
  MKO10020075_A_Gldc
  gRNA
guacacuccguaucagccag

SEQ ID NO: 20076 - RNA, 20 nt, Artificial Sequence
  MKO10020076_A_Gldc
  gRNA
aucgucugugggugacaacg

SEQ ID NO: 20077 - RNA, 20 nt, Artificial Sequence
  MKO10020077_A_Gldn
  gRNA
ccugguaacccgccggcucc

SEQ ID NO: 20078 - RNA, 20 nt, Artificial Sequence
  MKO10020078_A_Gldn
  gRNA
accugucaaaagcacgucau

SEQ ID NO: 20079 - RNA, 20 nt, Artificial Sequence
  MKO10020079_A_Gldn
  gRNA
gcuggugaacugggucuacc

SEQ ID NO: 20080 - RNA, 20 nt, Artificial Sequence
  MKO10020080_A_Gle1
  gRNA
ugugcgccaauucguacauu

SEQ ID NO: 20081 - RNA, 20 nt, Artificial Sequence
  MKO10020081_A_Gle1
  gRNA
aaccuuccacuuugaucgcc

SEQ ID NO: 20082 - RNA, 20 nt, Artificial Sequence
  MKO10020082_A_Gle1
  gRNA
agccuuaccuggguuccauu

SEQ ID NO: 20083 - RNA, 20 nt, Artificial Sequence
  MKO10020083_A_Glg1
  gRNA
agugauuaucgcuugaucug

SEQ ID NO: 20084 - RNA, 20 nt, Artificial Sequence
  MKO10020084_A_Glg1
  gRNA
gccucgaugauccaccaagc

SEQ ID NO: 20085 - RNA, 20 nt, Artificial Sequence
  MKO10020085_A_Glg1
  gRNA
aaaagcgcucccgaucaucu

SEQ ID NO: 20086 - RNA, 20 nt, Artificial Sequence
  MKO10020086_A_Gli1
  gRNA
ucgaccugcaaaccguaauc

SEQ ID NO: 20087 - RNA, 20 nt, Artificial Sequence
  MKO10020087_A_Gli1
  gRNA
gcugggugagguccggauua

SEQ ID NO: 20088 - RNA, 20 nt, Artificial Sequence
  MKO10020088_A_Gli1
  gRNA
cccaccuggcagguugcacg

SEQ ID NO: 20089 - RNA, 20 nt, Artificial Sequence
  MKO10020089_A_Gli2
  gRNA
ucgaccuacaacgcaugauu

SEQ ID NO: 20090 - RNA, 20 nt, Artificial Sequence
  MKO10020090_A_Gli2
  gRNA
agguccgaaucaugcguugu

SEQ ID NO: 20091 - RNA, 20 nt, Artificial Sequence
  MKO10020091_A_Gli2
  gRNA
ccccuacgugaacccccaua

SEQ ID NO: 20092 - RNA, 20 nt, Artificial Sequence
  MKO10020092_A_Gli3
  gRNA
auacgucgggcuacuagaua

SEQ ID NO: 20093 - RNA, 20 nt, Artificial Sequence
  MKO10020093_A_Gli3
  gRNA
ccucgacgucuagugaugag

SEQ ID NO: 20094 - RNA, 20 nt, Artificial Sequence
  MKO10020094_A_Gli3
  gRNA
gagcggauguaguccauaua

SEQ ID NO: 20095 - RNA, 20 nt, Artificial Sequence
  MKO10020095_A_Glipr1l1
  gRNA
uucguaucguuguuugauac

SEQ ID NO: 20096 - RNA, 20 nt, Artificial Sequence
  MKO10020096_A_Glipr1l1
  gRNA
caagagucuccucucgugua

SEQ ID NO: 20097 - RNA, 20 nt, Artificial Sequence
  MKO10020097_A_Glipr1l1
  gRNA
auagguaguuugggccaaaa

SEQ ID NO: 20098 - RNA, 20 nt, Artificial Sequence
  MKO10020098_A_Glipr1l2
  gRNA
caaaauugcccugcuugaua

SEQ ID NO: 20099 - RNA, 20 nt, Artificial Sequence
  MKO10020099_A_Glipr1l2
  gRNA
ucgccaauuucaguaaauac

SEQ ID NO: 20100 - RNA, 20 nt, Artificial Sequence
  MKO10020100_A_Glipr1l2
  gRNA
gugcuguuacuucgugugca

SEQ ID NO: 20101 - RNA, 20 nt, Artificial Sequence
  MKO10020101_A_Glipr1
  gRNA
aguuaacccacgacgagacc

SEQ ID NO: 20102 - RNA, 20 nt, Artificial Sequence
  MKO10020102_A_Glipr1
  gRNA
cgugagaccuggucucgucg

SEQ ID NO: 20103 - RNA, 20 nt, Artificial Sequence
  MKO10020103_A_Glipr1
  gRNA
ccagaggaaauuacccaacg

SEQ ID NO: 20104 - RNA, 20 nt, Artificial Sequence
  MKO10020104_A_Glipr2
  gRNA
ugaaggcccacaacgaguac

SEQ ID NO: 20105 - RNA, 20 nt, Artificial Sequence
  MKO10020105_A_Glipr2
  gRNA
agcuuuguaagaagcucaac

SEQ ID NO: 20106 - RNA, 20 nt, Artificial Sequence
  MKO10020106_A_Glipr2
  gRNA
gugcuugagaauucucgugc

SEQ ID NO: 20107 - RNA, 20 nt, Artificial Sequence
  MKO10020107_A_Glis1
  gRNA
accgcuugggagggcccccc

SEQ ID NO: 20108 - RNA, 20 nt, Artificial Sequence
  MKO10020108_A_Glis1
  gRNA
cugccgagccccaucgucca

SEQ ID NO: 20109 - RNA, 20 nt, Artificial Sequence
  MKO10020109_A_Glis1
  gRNA
gccuaccuaccgugucgagg

SEQ ID NO: 20110 - RNA, 20 nt, Artificial Sequence
  MKO10020110_A_Glis2
  gRNA
aagcguccguccaccuucuc

SEQ ID NO: 20111 - RNA, 20 nt, Artificial Sequence
  MKO10020111_A_Glis2
  gRNA
acaccauccaaauagcgaag

SEQ ID NO: 20112 - RNA, 20 nt, Artificial Sequence
  MKO10020112_A_Glis2
  gRNA
uaacaagagcuucucccgcc

SEQ ID NO: 20113 - RNA, 20 nt, Artificial Sequence
  MKO10020113_A_Glis3
  gRNA
uccguugauguaggcgacca

SEQ ID NO: 20114 - RNA, 20 nt, Artificial Sequence
  MKO10020114_A_Glis3
  gRNA
aguuuauaccgugcguugaa

SEQ ID NO: 20115 - RNA, 20 nt, Artificial Sequence
  MKO10020115_A_Glis3
  gRNA
cagugcaaguccauuggaaa

SEQ ID NO: 20116 - RNA, 20 nt, Artificial Sequence
  MKO10020116_A_Glmn
  gRNA
gaacucauugaagagcccuc

SEQ ID NO: 20117 - RNA, 20 nt, Artificial Sequence
  MKO10020117_A_Glmn
  gRNA
ccaccccauagacuuaauga

SEQ ID NO: 20118 - RNA, 20 nt, Artificial Sequence
  MKO10020118_A_Glmn
  gRNA
gcagaccaucauuaagucua

SEQ ID NO: 20119 - RNA, 20 nt, Artificial Sequence
  MKO10020119_A_Glo1
  gRNA
guacgcacugcgugagcuca

SEQ ID NO: 20120 - RNA, 20 nt, Artificial Sequence
  MKO10020120_A_Glo1
  gRNA
gcagacguaccaaauccacg

SEQ ID NO: 20121 - RNA, 20 nt, Artificial Sequence
  MKO10020121_A_Glo1
  gRNA
gcucuacuucuuagcuuaug

SEQ ID NO: 20122 - RNA, 20 nt, Artificial Sequence
  MKO10020122_A_Glod4
  gRNA
uuacuagguucuccgccaug

SEQ ID NO: 20123 - RNA, 20 nt, Artificial Sequence
  MKO10020123_A_Glod4
  gRNA
gcugggcuacgcugauaacc

SEQ ID NO: 20124 - RNA, 20 nt, Artificial Sequence
  MKO10020124_A_Glod4
  gRNA
uuguaguuaccugacugaga

SEQ ID NO: 20125 - RNA, 20 nt, Artificial Sequence
  MKO10020125_A_Glod5
  gRNA
ggaggugaucgagcgccuaa

SEQ ID NO: 20126 - RNA, 20 nt, Artificial Sequence
  MKO10020126_A_Glod5
  gRNA
auccaucuacuuccgagauc

SEQ ID NO: 20127 - RNA, 20 nt, Artificial Sequence
  MKO10020127_A_Glod5
  gRNA
ccaaaaauuuaacuuacacg

SEQ ID NO: 20128 - RNA, 20 nt, Artificial Sequence
  MKO10020128_A_Glp1r
  gRNA
uagacucuucacacuccgac

SEQ ID NO: 20129 - RNA, 20 nt, Artificial Sequence
  MKO10020129_A_Glp1r
  gRNA
ugggggcccauccggccagc

SEQ ID NO: 20130 - RNA, 20 nt, Artificial Sequence
  MKO10020130_A_Glp1r
  gRNA
ggaaacgcuggcacugccgc

SEQ ID NO: 20131 - RNA, 20 nt, Artificial Sequence
  MKO10020131_A_Glp2r
  gRNA
cauuugauaaguacgugugc

SEQ ID NO: 20132 - RNA, 20 nt, Artificial Sequence
  MKO10020132_A_Glp2r
  gRNA
gacuugcucgagaaaccuuc

SEQ ID NO: 20133 - RNA, 20 nt, Artificial Sequence
  MKO10020133_A_Glp2r
  gRNA
cuugcagcugauguacacug

SEQ ID NO: 20134 - RNA, 20 nt, Artificial Sequence
  MKO10020134_A_Glra1
  gRNA
gcaguggaacgacccccguc

SEQ ID NO: 20135 - RNA, 20 nt, Artificial Sequence
  MKO10020135_A_Glra1
  gRNA
ggacuucuggguaugacgcc

SEQ ID NO: 20136 - RNA, 20 nt, Artificial Sequence
  MKO10020136_A_Glra1
  gRNA
acuuccuggauaagcucaug

SEQ ID NO: 20137 - RNA, 20 nt, Artificial Sequence
  MKO10020137_A_Glra2
  gRNA
ccgcaacaacuuguugucag

SEQ ID NO: 20138 - RNA, 20 nt, Artificial Sequence
  MKO10020138_A_Glra2
  gRNA
ccucaauguuggauucgauu

SEQ ID NO: 20139 - RNA, 20 nt, Artificial Sequence
  MKO10020139_A_Glra2
  gRNA
auauugcaaguaacguuuac

SEQ ID NO: 20140 - RNA, 20 nt, Artificial Sequence
  MKO10020140_A_Glra3
  gRNA
uauucacuguaugcaagacg

SEQ ID NO: 20141 - RNA, 20 nt, Artificial Sequence
  MKO10020141_A_Glra3
  gRNA
cuccauugcagagacgacua

SEQ ID NO: 20142 - RNA, 20 nt, Artificial Sequence
  MKO10020142_A_Glra3
  gRNA
ucaaggucuaaugaaucguc

SEQ ID NO: 20143 - RNA, 20 nt, Artificial Sequence
  MKO10020143_A_Glra4
  gRNA
cauccaugcucgacucuauc

SEQ ID NO: 20144 - RNA, 20 nt, Artificial Sequence
  MKO10020144_A_Glra4
  gRNA
aagcuuaugggacgaacauc

SEQ ID NO: 20145 - RNA, 20 nt, Artificial Sequence
  MKO10020145_A_Glra4
  gRNA
gcgcaguaacuuguugucug

SEQ ID NO: 20146 - RNA, 20 nt, Artificial Sequence
  MKO10020146_A_Glrb
  gRNA
ugcuggucaguuaugauccc

SEQ ID NO: 20147 - RNA, 20 nt, Artificial Sequence
  MKO10020147_A_Glrb
  gRNA
caucccgaaagauaaacaac

SEQ ID NO: 20148 - RNA, 20 nt, Artificial Sequence
  MKO10020148_A_Glrb
  gRNA
auguugacuacuacaucaac

SEQ ID NO: 20149 - RNA, 20 nt, Artificial Sequence
  MKO10020149_A_Glrp1
  gRNA
ggccccguccagccuagagu

SEQ ID NO: 20150 - RNA, 20 nt, Artificial Sequence
  MKO10020150_A_Glrp1
  gRNA
gauguugcuaucaucaaaag

SEQ ID NO: 20151 - RNA, 20 nt, Artificial Sequence
  MKO10020151_A_Glrp1
  gRNA
auuucaaauaucaucaugcc

SEQ ID NO: 20152 - RNA, 20 nt, Artificial Sequence
  MKO10020152_A_Glrx2
  gRNA
gaaacagcacaucgucguuu

SEQ ID NO: 20153 - RNA, 20 nt, Artificial Sequence
  MKO10020153_A_Glrx2
  gRNA
ggcuauguccuggcgccgcg

SEQ ID NO: 20154 - RNA, 20 nt, Artificial Sequence
  MKO10020154_A_Glrx2
  gRNA
acgauuuauuggaggcgcag

SEQ ID NO: 20155 - RNA, 20 nt, Artificial Sequence
  MKO10020155_A_Glrx3
  gRNA
gauuuacaggucacuccuug

SEQ ID NO: 20156 - RNA, 20 nt, Artificial Sequence
  MKO10020156_A_Glrx3
  gRNA
uuaccacagcgugguucuug

SEQ ID NO: 20157 - RNA, 20 nt, Artificial Sequence
  MKO10020157_A_Glrx3
  gRNA
ucauccuuaccuugaagaac

SEQ ID NO: 20158 - RNA, 20 nt, Artificial Sequence
  MKO10020158_A_Glrx5
  gRNA
gcacgguguucgcgacuaug

SEQ ID NO: 20159 - RNA, 20 nt, Artificial Sequence
  MKO10020159_A_Glrx5
  gRNA
cuacaacgugcuggacgacc

SEQ ID NO: 20160 - RNA, 20 nt, Artificial Sequence
  MKO10020160_A_Glrx5
  gRNA
cccccacaaacucgccguug

SEQ ID NO: 20161 - RNA, 20 nt, Artificial Sequence
  MKO10020161_A_Glrx
  gRNA
uaaauaaucuugaaucgcac

SEQ ID NO: 20162 - RNA, 20 nt, Artificial Sequence
  MKO10020162_A_Glrx
  gRNA
ucuuuaccuaugaagacccg

SEQ ID NO: 20163 - RNA, 20 nt, Artificial Sequence
  MKO10020163_A_Glrx
  gRNA
cagguuccucgggucuucau

SEQ ID NO: 20164 - RNA, 20 nt, Artificial Sequence
  MKO10020164_A_Gls2
  gRNA
gucugacgucugcaguccag

SEQ ID NO: 20165 - RNA, 20 nt, Artificial Sequence
  MKO10020165_A_Gls2
  gRNA
gacgucagacccacggcucc

SEQ ID NO: 20166 - RNA, 20 nt, Artificial Sequence
  MKO10020166_A_Gls2
  gRNA
ccucaaauaugcgauccaca

SEQ ID NO: 20167 - RNA, 20 nt, Artificial Sequence
  MKO10020167_A_Gls
  gRNA
cucgcuguugccgaacgcgu

SEQ ID NO: 20168 - RNA, 20 nt, Artificial Sequence
  MKO10020168_A_Gls
  gRNA
ggcgguaugaugcggcugcg

SEQ ID NO: 20169 - RNA, 20 nt, Artificial Sequence
  MKO10020169_A_Gls
  gRNA
auauaacucaucgaugugug

SEQ ID NO: 20170 - RNA, 20 nt, Artificial Sequence
  MKO10020170_A_Glt1d1
  gRNA
ccaccaaagaugaccccgaa

SEQ ID NO: 20171 - RNA, 20 nt, Artificial Sequence
  MKO10020171_A_Glt1d1
  gRNA
cuagcucuucaccucuaccg

SEQ ID NO: 20172 - RNA, 20 nt, Artificial Sequence
  MKO10020172_A_Glt1d1
  gRNA
guuugcuguggcuuucaccg

SEQ ID NO: 20173 - RNA, 20 nt, Artificial Sequence
  MKO10020173_A_Glt25d1
  gRNA
uccuggaugcagccuuacgc

SEQ ID NO: 20174 - RNA, 20 nt, Artificial Sequence
  MKO10020174_A_Glt25d1
  gRNA
ccauccgaaaacgagaccgc

SEQ ID NO: 20175 - RNA, 20 nt, Artificial Sequence
  MKO10020175_A_Glt25d1
  gRNA
caccagccacucucgaagua

SEQ ID NO: 20176 - RNA, 20 nt, Artificial Sequence
  MKO10020176_A_Glt28d2
  gRNA
cgacgaccucaucgcucgag

SEQ ID NO: 20177 - RNA, 20 nt, Artificial Sequence
  MKO10020177_A_Glt28d2
  gRNA
gggcaaccacucgagcgaug

SEQ ID NO: 20178 - RNA, 20 nt, Artificial Sequence
  MKO10020178_A_Glt28d2
  gRNA
gguuguaacccagauucuug

SEQ ID NO: 20179 - RNA, 20 nt, Artificial Sequence
  MKO10020179_A_Glt6d1
  gRNA
uagaagaucacucgauagcc

SEQ ID NO: 20180 - RNA, 20 nt, Artificial Sequence
  MKO10020180_A_Glt6d1
  gRNA
ggugcgucauaaggugucua

SEQ ID NO: 20181 - RNA, 20 nt, Artificial Sequence
  MKO10020181_A_Glt6d1
  gRNA
ucucagacugguuuaacccc

SEQ ID NO: 20182 - RNA, 20 nt, Artificial Sequence
  MKO10020182_A_Glt8d1
  gRNA
agcacuggcgacaaagucua

SEQ ID NO: 20183 - RNA, 20 nt, Artificial Sequence
  MKO10020183_A_Glt8d1
  gRNA
cugguuucauggacuccccc

SEQ ID NO: 20184 - RNA, 20 nt, Artificial Sequence
  MKO10020184_A_Glt8d1
  gRNA
uuaacaaacugcucaagcug

SEQ ID NO: 20185 - RNA, 20 nt, Artificial Sequence
  MKO10020185_A_Glt8d2
  gRNA
cguugauuccgagucccccg

SEQ ID NO: 20186 - RNA, 20 nt, Artificial Sequence
  MKO10020186_A_Glt8d2
  gRNA
uaaccuuguguucuacguag

SEQ ID NO: 20187 - RNA, 20 nt, Artificial Sequence
  MKO10020187_A_Glt8d2
  gRNA
agauuagaccagacucaucg

SEQ ID NO: 20188 - RNA, 20 nt, Artificial Sequence
  MKO10020188_A_Gltpd1
  gRNA
cuacgaggugagcaacaagc

SEQ ID NO: 20189 - RNA, 20 nt, Artificial Sequence
  MKO10020189_A_Gltpd1
  gRNA
ugaaugagaagacggccccc

SEQ ID NO: 20190 - RNA, 20 nt, Artificial Sequence
  MKO10020190_A_Gltpd1
  gRNA
uuucaaccuuaaagucgucc

SEQ ID NO: 20191 - RNA, 20 nt, Artificial Sequence
  MKO10020191_A_Gltpd2
  gRNA
uguugcaucgcgcgcugcgc

SEQ ID NO: 20192 - RNA, 20 nt, Artificial Sequence
  MKO10020192_A_Gltpd2
  gRNA
ccgcacugcgugcccgcauc

SEQ ID NO: 20193 - RNA, 20 nt, Artificial Sequence
  MKO10020193_A_Gltpd2
  gRNA
uaacagcguuaagauagcga

SEQ ID NO: 20194 - RNA, 20 nt, Artificial Sequence
  MKO10020194_A_Gltp
  gRNA
cauccgagucaacgccaaca

SEQ ID NO: 20195 - RNA, 20 nt, Artificial Sequence
  MKO10020195_A_Gltp
  gRNA
uugaggaagucggacuugua

SEQ ID NO: 20196 - RNA, 20 nt, Artificial Sequence
  MKO10020196_A_Gltp
  gRNA
caugucguagauggcgucaa

SEQ ID NO: 20197 - RNA, 20 nt, Artificial Sequence
  MKO10020197_A_Gltscr1l
  gRNA
ugggacacacugacgggcgc

SEQ ID NO: 20198 - RNA, 20 nt, Artificial Sequence
  MKO10020198_A_Gltscr1l
  gRNA
agcgaugaugugacgaacgc

SEQ ID NO: 20199 - RNA, 20 nt, Artificial Sequence
  MKO10020199_A_Gltscr1l
  gRNA
ccagaauaccgccguccagc

SEQ ID NO: 20200 - RNA, 20 nt, Artificial Sequence
  MKO10020200_A_Gltscr1
  gRNA
cuugggcuggauaggcguag

SEQ ID NO: 20201 - RNA, 20 nt, Artificial Sequence
  MKO10020201_A_Gltscr1
  gRNA
caccgaguucccguugagug

SEQ ID NO: 20202 - RNA, 20 nt, Artificial Sequence
  MKO10020202_A_Gltscr1
  gRNA
aggcggggcgcugacuauga

SEQ ID NO: 20203 - RNA, 20 nt, Artificial Sequence
  MKO10020203_A_Gltscr2
  gRNA
acucagcauccucgcacauc

SEQ ID NO: 20204 - RNA, 20 nt, Artificial Sequence
  MKO10020204_A_Gltscr2
  gRNA
caaagcagggcgaacugccc

SEQ ID NO: 20205 - RNA, 20 nt, Artificial Sequence
  MKO10020205_A_Gltscr2
  gRNA
aggacucacucuuugggagc

SEQ ID NO: 20206 - RNA, 20 nt, Artificial Sequence
  MKO10020206_A_Glud1
  gRNA
gauacucacauagugcccua

SEQ ID NO: 20207 - RNA, 20 nt, Artificial Sequence
  MKO10020207_A_Glud1
  gRNA
ggcauaggugucagcgaucc

SEQ ID NO: 20208 - RNA, 20 nt, Artificial Sequence
  MKO10020208_A_Glud1
  gRNA
agcgcacuuguaugucauua

SEQ ID NO: 20209 - RNA, 20 nt, Artificial Sequence
  MKO10020209_A_Glul
  gRNA
ccuucaggcccguauuacug

SEQ ID NO: 20210 - RNA, 20 nt, Artificial Sequence
  MKO10020210_A_Glul
  gRNA
ugcggagguuaugccugccc

SEQ ID NO: 20211 - RNA, 20 nt, Artificial Sequence
  MKO10020211_A_Glul
  gRNA
ugggacguaccuuggggucc

SEQ ID NO: 20212 - RNA, 20 nt, Artificial Sequence
  MKO10020212_A_Glyaul3
  gRNA
ugagauuggccaaguaccgc

SEQ ID NO: 20213 - RNA, 20 nt, Artificial Sequence
  MKO10020213_A_Glyaul3
  gRNA
ccgacugguggcccucacgc

SEQ ID NO: 20214 - RNA, 20 nt, Artificial Sequence
  MKO10020214_A_Glyaul3
  gRNA
gcagugaugaacauaaaucg

SEQ ID NO: 20215 - RNA, 20 nt, Artificial Sequence
  MKO10020215_A_Glyau
  gRNA
aaccacgcuuugucauaauc

SEQ ID NO: 20216 - RNA, 20 nt, Artificial Sequence
  MKO10020216_A_Glyau
  gRNA
gguuguccgcccucaagaac

SEQ ID NO: 20217 - RNA, 20 nt, Artificial Sequence
  MKO10020217_A_Glyau
  gRNA
gaccagauuaugacaaagcg

SEQ ID NO: 20218 - RNA, 20 nt, Artificial Sequence
  MKO10020218_A_Glycam1
  gRNA
ucaugacuucgugauacgac

SEQ ID NO: 20219 - RNA, 20 nt, Artificial Sequence
  MKO10020219_A_Glycam1
  gRNA
acccgcuccugagcccaucc

SEQ ID NO: 20220 - RNA, 20 nt, Artificial Sequence
  MKO10020220_A_Glycam1
  gRNA
ucccaccagcuacaccagug

SEQ ID NO: 20221 - RNA, 20 nt, Artificial Sequence
  MKO10020221_A_Glycuk
  gRNA
cgagccgcuauggaacaugc

SEQ ID NO: 20222 - RNA, 20 nt, Artificial Sequence
  MKO10020222_A_Glycuk
  gRNA
gcgggaaaaccucuaccuag

SEQ ID NO: 20223 - RNA, 20 nt, Artificial Sequence
  MKO10020223_A_Glycuk
  gRNA
cuacgggcugcuagcccggg

SEQ ID NO: 20224 - RNA, 20 nt, Artificial Sequence
  MKO10020224_A_Glyr1
  gRNA
uagcuguuccacuuugaucc

SEQ ID NO: 20225 - RNA, 20 nt, Artificial Sequence
  MKO10020225_A_Glyr1
  gRNA
uacuagugccuggaucaaag

SEQ ID NO: 20226 - RNA, 20 nt, Artificial Sequence
  MKO10020226_A_Glyr1
  gRNA
guauccucccuggccaggaa

SEQ ID NO: 20227 - RNA, 20 nt, Artificial Sequence
  MKO10020227_A_Gm10024
  gRNA
acaggucugcagacuacagu

SEQ ID NO: 20228 - RNA, 20 nt, Artificial Sequence
  MKO10020228_A_Gm10024
  gRNA
gcugugugccuguaagcugc

SEQ ID NO: 20229 - RNA, 20 nt, Artificial Sequence
  MKO10020229_A_Gm10024
  gRNA
gcagccuccagaugacugac

SEQ ID NO: 20230 - RNA, 20 nt, Artificial Sequence
  MKO10020230_A_Gm10057
  gRNA
aucaacucaucguugauacu

SEQ ID NO: 20231 - RNA, 20 nt, Artificial Sequence
  MKO10020231_A_Gm10057
  gRNA
cuacagauuuaucaaugaga

SEQ ID NO: 20232 - RNA, 20 nt, Artificial Sequence
  MKO10020232_A_Gm10057
  gRNA
uaucacuucacgcaucuaga

SEQ ID NO: 20233 - RNA, 20 nt, Artificial Sequence
  MKO10020233_A_Gm10058
  gRNA
auaguaaagaggccagcauu

SEQ ID NO: 20234 - RNA, 20 nt, Artificial Sequence
  MKO10020234_A_Gm10058
  gRNA
ucuucaucugcuucuacgug

SEQ ID NO: 20235 - RNA, 20 nt, Artificial Sequence
  MKO10020235_A_Gm10058
  gRNA
agaugaacaagacaguaugu

SEQ ID NO: 20236 - RNA, 20 nt, Artificial Sequence
  MKO10020236_A_Gm10081
  gRNA
ccugcuugagaaguucuucg

SEQ ID NO: 20237 - RNA, 20 nt, Artificial Sequence
  MKO10020237_A_Gm10081
  gRNA
auuacucuagcaccaugaca

SEQ ID NO: 20238 - RNA, 20 nt, Artificial Sequence
  MKO10020238_A_Gm10081
  gRNA
uaaucccugauccauaaaag

SEQ ID NO: 20239 - RNA, 20 nt, Artificial Sequence
  MKO10020239_A_Gm10094
  gRNA
caggucuucucgcggucgau

SEQ ID NO: 20240 - RNA, 20 nt, Artificial Sequence
  MKO10020240_A_Gm10094
  gRNA
aagaccuggauaucgaguua

SEQ ID NO: 20241 - RNA, 20 nt, Artificial Sequence
  MKO10020241_A_Gm10094
  gRNA
aucuccuuaacucgauaucc

SEQ ID NO: 20242 - RNA, 20 nt, Artificial Sequence
  MKO10020242_A_Gm10096
  gRNA
auaguaaagaggccagcauu

SEQ ID NO: 20243 - RNA, 20 nt, Artificial Sequence
  MKO10020243_A_Gm10096
  gRNA
ucuucaucugcuucuacgug

SEQ ID NO: 20244 - RNA, 20 nt, Artificial Sequence
  MKO10020244_A_Gm10096
  gRNA
agaugaacaagacaguaugu

SEQ ID NO: 20245 - RNA, 20 nt, Artificial Sequence
  MKO10020245_A_Gm10100
  gRNA
agguaacaggccugcagacc

SEQ ID NO: 20246 - RNA, 20 nt, Artificial Sequence
  MKO10020246_A_Gm10100
  gRNA
ugucacaccagcugcuccuc

SEQ ID NO: 20247 - RNA, 20 nt, Artificial Sequence
  MKO10020247_A_Gm10100
  gRNA
ccagcccuccugcccuaccc

SEQ ID NO: 20248 - RNA, 20 nt, Artificial Sequence
  MKO10020248_A_Gm10104
  gRNA
caugaagagcagacccuucu

SEQ ID NO: 20249 - RNA, 20 nt, Artificial Sequence
  MKO10020249_A_Gm10104
  gRNA
ccucucugcccuuguccugc

SEQ ID NO: 20250 - RNA, 20 nt, Artificial Sequence
  MKO10020250_A_Gm10104
  gRNA
aguuaaaaaaagauuucugc

SEQ ID NO: 20251 - RNA, 20 nt, Artificial Sequence
  MKO10020251_A_Gm10142
  gRNA
cauuccuguuagauaccaag

SEQ ID NO: 20252 - RNA, 20 nt, Artificial Sequence
  MKO10020252_A_Gm10142
  gRNA
ccagcccuccugcccuaccu

SEQ ID NO: 20253 - RNA, 20 nt, Artificial Sequence
  MKO10020253_A_Gm10142
  gRNA
ggagggggccacacacacag

SEQ ID NO: 20254 - RNA, 20 nt, Artificial Sequence
  MKO10020254_A_Gm10147
  gRNA
auaguaaagaggccagcauu

SEQ ID NO: 20255 - RNA, 20 nt, Artificial Sequence
  MKO10020255_A_Gm10147
  gRNA
ucuucaucugcuucuacgug

SEQ ID NO: 20256 - RNA, 20 nt, Artificial Sequence
  MKO10020256_A_Gm10147
  gRNA
agaugaacaagacaguaugu

SEQ ID NO: 20257 - RNA, 20 nt, Artificial Sequence
  MKO10020257_A_Gm101
  gRNA
uaauaguagcgccacucauc

SEQ ID NO: 20258 - RNA, 20 nt, Artificial Sequence
  MKO10020258_A_Gm101
  gRNA
ugggaacucaccuuucuccg

SEQ ID NO: 20259 - RNA, 20 nt, Artificial Sequence
  MKO10020259_A_Gm101
  gRNA
cugcauccgcauucacugua

SEQ ID NO: 20260 - RNA, 20 nt, Artificial Sequence
  MKO10020260_A_Gm10220
  gRNA
gguagggccuauucccagga

SEQ ID NO: 20261 - RNA, 20 nt, Artificial Sequence
  MKO10020261_A_Gm10220
  gRNA
cucagaagcugcaagaaagc

SEQ ID NO: 20262 - RNA, 20 nt, Artificial Sequence
  MKO10020262_A_Gm10220
  gRNA
ucacagacagacaacauccc

SEQ ID NO: 20263 - RNA, 20 nt, Artificial Sequence
  MKO10020263_A_Gm10228
  gRNA
uguggcuauggauguggcuc

SEQ ID NO: 20264 - RNA, 20 nt, Artificial Sequence
  MKO10020264_A_Gm10228
  gRNA
agcaccauguguggcuacua

SEQ ID NO: 20265 - RNA, 20 nt, Artificial Sequence
  MKO10020265_A_Gm10228
  gRNA
cauagccacagcccagucca

SEQ ID NO: 20266 - RNA, 20 nt, Artificial Sequence
  MKO10020266_A_Gm10229
  gRNA
ugcgguucuggcuauggauc

SEQ ID NO: 20267 - RNA, 20 nt, Artificial Sequence
  MKO10020267_A_Gm10229
  gRNA
cauagccacagcccagucca

SEQ ID NO: 20268 - RNA, 20 nt, Artificial Sequence
  MKO10020268_A_Gm10229
  gRNA
agcaccauguguggcuacua

SEQ ID NO: 20269 - RNA, 20 nt, Artificial Sequence
  MKO10020269_A_Gm10230
  gRNA
auaguaaagaggccagcauu

SEQ ID NO: 20270 - RNA, 20 nt, Artificial Sequence
  MKO10020270_A_Gm10230
  gRNA
ucuucaucugcuucuacgug

SEQ ID NO: 20271 - RNA, 20 nt, Artificial Sequence
  MKO10020271_A_Gm10230
  gRNA
agaugaacaagacaguaugu

SEQ ID NO: 20272 - RNA, 20 nt, Artificial Sequence
  MKO10020272_A_Gm10256
  gRNA
aaagaauuaccacgugcuac

SEQ ID NO: 20273 - RNA, 20 nt, Artificial Sequence
  MKO10020273_A_Gm10256
  gRNA
auggcagaaacugaucagcc

SEQ ID NO: 20274 - RNA, 20 nt, Artificial Sequence
  MKO10020274_A_Gm10256
  gRNA
cagcauucuuagcaucugca

SEQ ID NO: 20275 - RNA, 20 nt, Artificial Sequence
  MKO10020275_A_Gm10267
  gRNA
uuuccagucugugcaaccaa

SEQ ID NO: 20276 - RNA, 20 nt, Artificial Sequence
  MKO10020276_A_Gm10267
  gRNA
acagacuggaaaauacucuc

SEQ ID NO: 20277 - RNA, 20 nt, Artificial Sequence
  MKO10020277_A_Gm10267
  gRNA
ucauuuauuaugucacaucu

SEQ ID NO: 20278 - RNA, 20 nt, Artificial Sequence
  MKO10020278_A_Gm10318
  gRNA
gauaguucaagccaguguau

SEQ ID NO: 20279 - RNA, 20 nt, Artificial Sequence
  MKO10020279_A_Gm10318
  gRNA
ccccaauauguccuauacac

SEQ ID NO: 20280 - RNA, 20 nt, Artificial Sequence
  MKO10020280_A_Gm10318
  gRNA
ugauguugugaacugccgaa

SEQ ID NO: 20281 - RNA, 20 nt, Artificial Sequence
  MKO10020281_A_Gm10324
  gRNA
cuaaaucucagaacuuccug

SEQ ID NO: 20282 - RNA, 20 nt, Artificial Sequence
  MKO10020282_A_Gm10324
  gRNA
gccuuucuacaagaucgcug

SEQ ID NO: 20283 - RNA, 20 nt, Artificial Sequence
  MKO10020283_A_Gm10324
  gRNA
cagucuuaccuauagaagua

SEQ ID NO: 20284 - RNA, 20 nt, Artificial Sequence
  MKO10020284_A_Gm10334
  gRNA
gggaacagaauucucuuggc

SEQ ID NO: 20285 - RNA, 20 nt, Artificial Sequence
  MKO10020285_A_Gm10334
  gRNA
cacucuaguugccuuccccg

SEQ ID NO: 20286 - RNA, 20 nt, Artificial Sequence
  MKO10020286_A_Gm10334
  gRNA
cagccgcauccaagugagau

SEQ ID NO: 20287 - RNA, 20 nt, Artificial Sequence
  MKO10020287_A_Gm10352
  gRNA
aaagaauuaccacgugcuac

SEQ ID NO: 20288 - RNA, 20 nt, Artificial Sequence
  MKO10020288_A_Gm10352
  gRNA
auggcagaaacugaucagcc

SEQ ID NO: 20289 - RNA, 20 nt, Artificial Sequence
  MKO10020289_A_Gm10352
  gRNA
cagcauucuuagcaucugca

SEQ ID NO: 20290 - RNA, 20 nt, Artificial Sequence
  MKO10020290_A_Gm10354
  gRNA
caaagagauccagcucacua

SEQ ID NO: 20291 - RNA, 20 nt, Artificial Sequence
  MKO10020291_A_Gm10354
  gRNA
uccuugcucuccugcugcaa

SEQ ID NO: 20292 - RNA, 20 nt, Artificial Sequence
  MKO10020292_A_Gm10354
  gRNA
uugucuccuccauagugagc

SEQ ID NO: 20293 - RNA, 20 nt, Artificial Sequence
  MKO10020293_A_Gm10375
  gRNA
accuacagggucauuuagga

SEQ ID NO: 20294 - RNA, 20 nt, Artificial Sequence
  MKO10020294_A_Gm10375
  gRNA
gucauucaaauccuuguacu

SEQ ID NO: 20295 - RNA, 20 nt, Artificial Sequence
  MKO10020295_A_Gm10375
  gRNA
ugaccugaagagaauguccc

SEQ ID NO: 20296 - RNA, 20 nt, Artificial Sequence
  MKO10020296_A_Gm10377
  gRNA
accuacagggucauuuagga

SEQ ID NO: 20297 - RNA, 20 nt, Artificial Sequence
  MKO10020297_A_Gm10377
  gRNA
gucauucaaauccuuguacu

SEQ ID NO: 20298 - RNA, 20 nt, Artificial Sequence
  MKO10020298_A_Gm10377
  gRNA
ugaccugaagagaauguccc

SEQ ID NO: 20299 - RNA, 20 nt, Artificial Sequence
  MKO10020299_A_Gm10406
  gRNA
ggcuggcuauaaguguccug

SEQ ID NO: 20300 - RNA, 20 nt, Artificial Sequence
  MKO10020300_A_Gm10406
  gRNA
ugaacuagaagaacugaaau

SEQ ID NO: 20301 - RNA, 20 nt, Artificial Sequence
  MKO10020301_A_Gm10406
  gRNA
ucaaauccucauacauguaa

SEQ ID NO: 20302 - RNA, 20 nt, Artificial Sequence
  MKO10020302_A_Gm10408
  gRNA
ccucauauauguaaaguucc

SEQ ID NO: 20303 - RNA, 20 nt, Artificial Sequence
  MKO10020303_A_Gm10408
  gRNA
ugaacuagaagaacugaaau

SEQ ID NO: 20304 - RNA, 20 nt, Artificial Sequence
  MKO10020304_A_Gm10408
  gRNA
guuaucuucuaucaguuccu

SEQ ID NO: 20305 - RNA, 20 nt, Artificial Sequence
  MKO10020305_A_Gm10413
  gRNA
ucaaauccucauacauguaa

SEQ ID NO: 20306 - RNA, 20 nt, Artificial Sequence
  MKO10020306_A_Gm10413
  gRNA
aagaacugaaauuagauaug

SEQ ID NO: 20307 - RNA, 20 nt, Artificial Sequence
  MKO10020307_A_Gm10413
  gRNA
acaacaugagaagacaaugu

SEQ ID NO: 20308 - RNA, 20 nt, Artificial Sequence
  MKO10020308_A_Gm10436
  gRNA
cuuaucauaguuccacaaaa

SEQ ID NO: 20309 - RNA, 20 nt, Artificial Sequence
  MKO10020309_A_Gm10436
  gRNA
uucagaaucacccaaaguga

SEQ ID NO: 20310 - RNA, 20 nt, Artificial Sequence
  MKO10020310_A_Gm10436
  gRNA
caucauuuauguagaguuuc

SEQ ID NO: 20311 - RNA, 20 nt, Artificial Sequence
  MKO10020311_A_Gm10439
  gRNA
gaagaucacguagucgauuc

SEQ ID NO: 20312 - RNA, 20 nt, Artificial Sequence
  MKO10020312_A_Gm10439
  gRNA
uguuaucagaucuccaugau

SEQ ID NO: 20313 - RNA, 20 nt, Artificial Sequence
  MKO10020313_A_Gm10439
  gRNA
gauugucugcaauaagagaa

SEQ ID NO: 20314 - RNA, 20 nt, Artificial Sequence
  MKO10020314_A_Gm1045
  gRNA
caagggaucagucuaccucg

SEQ ID NO: 20315 - RNA, 20 nt, Artificial Sequence
  MKO10020315_A_Gm1045
  gRNA
acaaccgccgcuuccaguuc

SEQ ID NO: 20316 - RNA, 20 nt, Artificial Sequence
  MKO10020316_A_Gm1045
  gRNA
caaccagcugaccaguaacc

SEQ ID NO: 20317 - RNA, 20 nt, Artificial Sequence
  MKO10020317_A_Gm10471
  gRNA
cuaccgcucuaguggcaagu

SEQ ID NO: 20318 - RNA, 20 nt, Artificial Sequence
  MKO10020318_A_Gm10471
  gRNA
ugcuagacuacagggcccua

SEQ ID NO: 20319 - RNA, 20 nt, Artificial Sequence
  MKO10020319_A_Gm10471
  gRNA
aagcaaaaagcaguuugaga

SEQ ID NO: 20320 - RNA, 20 nt, Artificial Sequence
  MKO10020320_A_Gm10486
  gRNA
ucuucaucugcuucuacgug

SEQ ID NO: 20321 - RNA, 20 nt, Artificial Sequence
  MKO10020321_A_Gm10486
  gRNA
auaguaaagaggccagcauu

SEQ ID NO: 20322 - RNA, 20 nt, Artificial Sequence
  MKO10020322_A_Gm10486
  gRNA
agaugaacaagacaguaugu

SEQ ID NO: 20323 - RNA, 20 nt, Artificial Sequence
  MKO10020323_A_Gm10487
  gRNA
auaguaaagaggccagcauu

SEQ ID NO: 20324 - RNA, 20 nt, Artificial Sequence
  MKO10020324_A_Gm10487
  gRNA
ucuucaucugcuucuacgug

SEQ ID NO: 20325 - RNA, 20 nt, Artificial Sequence
  MKO10020325_A_Gm10487
  gRNA
agaugaacaagacaguaugu

SEQ ID NO: 20326 - RNA, 20 nt, Artificial Sequence
  MKO10020326_A_Gm10488
  gRNA
ucuucaucugcuucuacgug

SEQ ID NO: 20327 - RNA, 20 nt, Artificial Sequence
  MKO10020327_A_Gm10488
  gRNA
auaguaaagaggccagcauu

SEQ ID NO: 20328 - RNA, 20 nt, Artificial Sequence
  MKO10020328_A_Gm10488
  gRNA
agaugaacaagacaguaugu

SEQ ID NO: 20329 - RNA, 20 nt, Artificial Sequence
  MKO10020329_A_Gm10591
  gRNA
cuccuugguaccuugggucc

SEQ ID NO: 20330 - RNA, 20 nt, Artificial Sequence
  MKO10020330_A_Gm10591
  gRNA
gacucugagccuccuuagcc

SEQ ID NO: 20331 - RNA, 20 nt, Artificial Sequence
  MKO10020331_A_Gm10591
  gRNA
agcgcacucacaggauugcc

SEQ ID NO: 20332 - RNA, 20 nt, Artificial Sequence
  MKO10020332_A_Gm10639
  gRNA
uugcagguguugaagggcca

SEQ ID NO: 20333 - RNA, 20 nt, Artificial Sequence
  MKO10020333_A_Gm10639
  gRNA
aaaagaagccaagacugccu

SEQ ID NO: 20334 - RNA, 20 nt, Artificial Sequence
  MKO10020334_A_Gm10639
  gRNA
gacuccuuucccucugcuga

SEQ ID NO: 20335 - RNA, 20 nt, Artificial Sequence
  MKO10020335_A_Gm10662
  gRNA
agagggucugaugauggagc

SEQ ID NO: 20336 - RNA, 20 nt, Artificial Sequence
  MKO10020336_A_Gm10662
  gRNA
cuucuaugugaugacuguca

SEQ ID NO: 20337 - RNA, 20 nt, Artificial Sequence
  MKO10020337_A_Gm10662
  gRNA
acuagaucgcaucaucaacg

SEQ ID NO: 20338 - RNA, 20 nt, Artificial Sequence
  MKO10020338_A_Gm10665
  gRNA
gcccucuccaugucuguucg

SEQ ID NO: 20339 - RNA, 20 nt, Artificial Sequence
  MKO10020339_A_Gm10665
  gRNA
cagagcaagugucccaaauu

SEQ ID NO: 20340 - RNA, 20 nt, Artificial Sequence
  MKO10020340_A_Gm10665
  gRNA
gaccaugaugcucaugaaug

SEQ ID NO: 20341 - RNA, 20 nt, Artificial Sequence
  MKO10020341_A_Gm10666
  gRNA
gcccucuccaugucuguucg

SEQ ID NO: 20342 - RNA, 20 nt, Artificial Sequence
  MKO10020342_A_Gm10666
  gRNA
cagagcaagugucccaaauu

SEQ ID NO: 20343 - RNA, 20 nt, Artificial Sequence
  MKO10020343_A_Gm10666
  gRNA
gaccaugaugcucaugaaug

SEQ ID NO: 20344 - RNA, 20 nt, Artificial Sequence
  MKO10020344_A_Gm10670
  gRNA
gcccucuccaugucuguucg

SEQ ID NO: 20345 - RNA, 20 nt, Artificial Sequence
  MKO10020345_A_Gm10670
  gRNA
cagagcaagugucccaaauu

SEQ ID NO: 20346 - RNA, 20 nt, Artificial Sequence
  MKO10020346_A_Gm10670
  gRNA
gaccaugaugcucaugaaug

SEQ ID NO: 20347 - RNA, 20 nt, Artificial Sequence
  MKO10020347_A_Gm10681
  gRNA
cuguguugaccaugccuggg

SEQ ID NO: 20348 - RNA, 20 nt, Artificial Sequence
  MKO10020348_A_Gm10681
  gRNA
agcugccuggugacaggagc

SEQ ID NO: 20349 - RNA, 20 nt, Artificial Sequence
  MKO10020349_A_Gm10681
  gRNA
agagcugcagacaaagacca

SEQ ID NO: 20350 - RNA, 20 nt, Artificial Sequence
  MKO10020350_A_Gm10696
  gRNA
agaaauaucaaaguauggag

SEQ ID NO: 20351 - RNA, 20 nt, Artificial Sequence
  MKO10020351_A_Gm10696
  gRNA
ucuucagcugcugugugcug

SEQ ID NO: 20352 - RNA, 20 nt, Artificial Sequence
  MKO10020352_A_Gm10696
  gRNA
cacacagcagcugaagacuc

SEQ ID NO: 20353 - RNA, 20 nt, Artificial Sequence
  MKO10020353_A_Gm10697
  gRNA
agcagaaaugucagaggaca

SEQ ID NO: 20354 - RNA, 20 nt, Artificial Sequence
  MKO10020354_A_Gm10697
  gRNA
gaaugcuucagccaaccaag

SEQ ID NO: 20355 - RNA, 20 nt, Artificial Sequence
  MKO10020355_A_Gm10697
  gRNA
auccaggucauggaucucag

SEQ ID NO: 20356 - RNA, 20 nt, Artificial Sequence
  MKO10020356_A_Gm10767
  gRNA
gcaagcagauucacgaaaga

SEQ ID NO: 20357 - RNA, 20 nt, Artificial Sequence
  MKO10020357_A_Gm10767
  gRNA
auccaugccacugauuugac

SEQ ID NO: 20358 - RNA, 20 nt, Artificial Sequence
  MKO10020358_A_Gm10767
  gRNA
aaggauggccaacugacaac

SEQ ID NO: 20359 - RNA, 20 nt, Artificial Sequence
  MKO10020359_A_Gm10778
  gRNA
cuaaaaagcucaucuuacac

SEQ ID NO: 20360 - RNA, 20 nt, Artificial Sequence
  MKO10020360_A_Gm10778
  gRNA
agcagguguuugcuacuugc

SEQ ID NO: 20361 - RNA, 20 nt, Artificial Sequence
  MKO10020361_A_Gm10778
  gRNA
uauucuuaccuauagcagug

SEQ ID NO: 20362 - RNA, 20 nt, Artificial Sequence
  MKO10020362_A_Gm10921
  gRNA
aaaucugaucauuaagaaug

SEQ ID NO: 20363 - RNA, 20 nt, Artificial Sequence
  MKO10020363_A_Gm10921
  gRNA
caaccacuguuguuuguaaa

SEQ ID NO: 20364 - RNA, 20 nt, Artificial Sequence
  MKO10020364_A_Gm10921
  gRNA
aucuuguucaagaauaguug

SEQ ID NO: 20365 - RNA, 20 nt, Artificial Sequence
  MKO10020365_A_Gm10922
  gRNA
caaccacuguuguuuguaaa

SEQ ID NO: 20366 - RNA, 20 nt, Artificial Sequence
  MKO10020366_A_Gm10922
  gRNA
acuuggagagaaucacacca

SEQ ID NO: 20367 - RNA, 20 nt, Artificial Sequence
  MKO10020367_A_Gm10922
  gRNA
aucuuguucaagaauaguug

SEQ ID NO: 20368 - RNA, 20 nt, Artificial Sequence
  MKO10020368_A_Gm1110
  gRNA
uugcugauaaaccgaaaagu

SEQ ID NO: 20369 - RNA, 20 nt, Artificial Sequence
  MKO10020369_A_Gm1110
  gRNA
aaccuccacgagccggcagu

SEQ ID NO: 20370 - RNA, 20 nt, Artificial Sequence
  MKO10020370_A_Gm1110
  gRNA
gucuucagccuuaugugcga

SEQ ID NO: 20371 - RNA, 20 nt, Artificial Sequence
  MKO10020371_A_Gm11127
  gRNA
gccagguccccacacaaucc

SEQ ID NO: 20372 - RNA, 20 nt, Artificial Sequence
  MKO10020372_A_Gm11127
  gRNA
ggagccucgguucaccgccg

SEQ ID NO: 20373 - RNA, 20 nt, Artificial Sequence
  MKO10020373_A_Gm11127
  gRNA
aaugauuaccauguuagagu

SEQ ID NO: 20374 - RNA, 20 nt, Artificial Sequence
  MKO10020374_A_Gm11128
  gRNA
gguccccuucccgagaagug

SEQ ID NO: 20375 - RNA, 20 nt, Artificial Sequence
  MKO10020375_A_Gm11128
  gRNA
uaaaguauagccucacuucu

SEQ ID NO: 20376 - RNA, 20 nt, Artificial Sequence
  MKO10020376_A_Gm11128
  gRNA
uuaucauauccgaaaauacc

SEQ ID NO: 20377 - RNA, 20 nt, Artificial Sequence
  MKO10020377_A_Gm11236
  gRNA
ucugaauaccugaggaacuu

SEQ ID NO: 20378 - RNA, 20 nt, Artificial Sequence
  MKO10020378_A_Gm11236
  gRNA
gaaaugacaaagaagccaau

SEQ ID NO: 20379 - RNA, 20 nt, Artificial Sequence
  MKO10020379_A_Gm11236
  gRNA
caccuggcacauagccuccc

SEQ ID NO: 20380 - RNA, 20 nt, Artificial Sequence
  MKO10020380_A_Gm11237
  gRNA
ucugaauaccugaggaacuu

SEQ ID NO: 20381 - RNA, 20 nt, Artificial Sequence
  MKO10020381_A_Gm11237
  gRNA
gaaaugacaaagaagccaau

SEQ ID NO: 20382 - RNA, 20 nt, Artificial Sequence
  MKO10020382_A_Gm11237
  gRNA
caccuggcacauagccuccc

SEQ ID NO: 20383 - RNA, 20 nt, Artificial Sequence
  MKO10020383_A_Gm1123
  gRNA
aaggaccguugaacaucgag

SEQ ID NO: 20384 - RNA, 20 nt, Artificial Sequence
  MKO10020384_A_Gm1123
  gRNA
cgaagccacucgauguucaa

SEQ ID NO: 20385 - RNA, 20 nt, Artificial Sequence
  MKO10020385_A_Gm1123
  gRNA
gacgucuauccagaucuaaa

SEQ ID NO: 20386 - RNA, 20 nt, Artificial Sequence
  MKO10020386_A_Gm1140
  gRNA
caauauagcagagcagcccg

SEQ ID NO: 20387 - RNA, 20 nt, Artificial Sequence
  MKO10020387_A_Gm1140
  gRNA
aucacugaucucgaucacca

SEQ ID NO: 20388 - RNA, 20 nt, Artificial Sequence
  MKO10020388_A_Gm1140
  gRNA
uagggaaucuguucagaaga

SEQ ID NO: 20389 - RNA, 20 nt, Artificial Sequence
  MKO10020389_A_Gm11435
  gRNA
gggagucaaaaucguuguuu

SEQ ID NO: 20390 - RNA, 20 nt, Artificial Sequence
  MKO10020390_A_Gm11435
  gRNA
cacccucaaugagcaacgca

SEQ ID NO: 20391 - RNA, 20 nt, Artificial Sequence
  MKO10020391_A_Gm11435
  gRNA
ccaccaaagacccccugaag

SEQ ID NO: 20392 - RNA, 20 nt, Artificial Sequence
  MKO10020392_A_Gm11437
  gRNA
aucagccgauagcuacccug

SEQ ID NO: 20393 - RNA, 20 nt, Artificial Sequence
  MKO10020393_A_Gm11437
  gRNA
caucuuugaagucccgugcc

SEQ ID NO: 20394 - RNA, 20 nt, Artificial Sequence
  MKO10020394_A_Gm11437
  gRNA
accgugcauugugagauccc

SEQ ID NO: 20395 - RNA, 20 nt, Artificial Sequence
  MKO10020395_A_Gm11487
  gRNA
aucuucacuccacucuuagu

SEQ ID NO: 20396 - RNA, 20 nt, Artificial Sequence
  MKO10020396_A_Gm11487
  gRNA
ugaucucucccuacuaagag

SEQ ID NO: 20397 - RNA, 20 nt, Artificial Sequence
  MKO10020397_A_Gm11487
  gRNA
aaugcagagggaaugugcau

SEQ ID NO: 20398 - RNA, 20 nt, Artificial Sequence
  MKO10020398_A_Gm11541
  gRNA
guaagaccacgaauugcauc

SEQ ID NO: 20399 - RNA, 20 nt, Artificial Sequence
  MKO10020399_A_Gm11541
  gRNA
uucacggccuaggcaagaac

SEQ ID NO: 20400 - RNA, 20 nt, Artificial Sequence
  MKO10020400_A_Gm11541
  gRNA
ggauggauggcacgcagugg

SEQ ID NO: 20401 - RNA, 20 nt, Artificial Sequence
  MKO10020401_A_Gm11544
  gRNA
accgcccuccauugcuccgc

SEQ ID NO: 20402 - RNA, 20 nt, Artificial Sequence
  MKO10020402_A_Gm11544
  gRNA
ggauuguggaccucauccug

SEQ ID NO: 20403 - RNA, 20 nt, Artificial Sequence
  MKO10020403_A_Gm11544
  gRNA
ugaucuccaucccacacuua

SEQ ID NO: 20404 - RNA, 20 nt, Artificial Sequence
  MKO10020404_A_Gm11545
  gRNA
gaucucucuacauccacgac

SEQ ID NO: 20405 - RNA, 20 nt, Artificial Sequence
  MKO10020405_A_Gm11545
  gRNA
ggagcaacggagggcaacga

SEQ ID NO: 20406 - RNA, 20 nt, Artificial Sequence
  MKO10020406_A_Gm11545
  gRNA
acagggauuccaacuagauu

SEQ ID NO: 20407 - RNA, 20 nt, Artificial Sequence
  MKO10020407_A_Gm11554
  gRNA
acaacagccugggcggcugc

SEQ ID NO: 20408 - RNA, 20 nt, Artificial Sequence
  MKO10020408_A_Gm11554
  gRNA
accauggucagcuccugcug

SEQ ID NO: 20409 - RNA, 20 nt, Artificial Sequence
  MKO10020409_A_Gm11554
  gRNA
gcagcaagaaccacuagaac

SEQ ID NO: 20410 - RNA, 20 nt, Artificial Sequence
  MKO10020410_A_Gm11559
  gRNA
guaaguugaucaacagccac

SEQ ID NO: 20411 - RNA, 20 nt, Artificial Sequence
  MKO10020411_A_Gm11559
  gRNA
agcccagcugcugucagccc

SEQ ID NO: 20412 - RNA, 20 nt, Artificial Sequence
  MKO10020412_A_Gm11559
  gRNA
gcugccagcccaccugcugc

SEQ ID NO: 20413 - RNA, 20 nt, Artificial Sequence
  MKO10020413_A_Gm11562
  gRNA
accaugacaggcuccugcug

SEQ ID NO: 20414 - RNA, 20 nt, Artificial Sequence
  MKO10020414_A_Gm11562
  gRNA
gcucagcagcagguguugca

SEQ ID NO: 20415 - RNA, 20 nt, Artificial Sequence
  MKO10020415_A_Gm11562
  gRNA
ccuggugcaguggggcacac

SEQ ID NO: 20416 - RNA, 20 nt, Artificial Sequence
  MKO10020416_A_Gm11563
  gRNA
caagaaaguucucagcagca

SEQ ID NO: 20417 - RNA, 20 nt, Artificial Sequence
  MKO10020417_A_Gm11563
  gRNA
acaacagcuggagcuaccac

SEQ ID NO: 20418 - RNA, 20 nt, Artificial Sequence
  MKO10020418_A_Gm11563
  gRNA
gcagcuggggcggcaacagc

SEQ ID NO: 20419 - RNA, 20 nt, Artificial Sequence
  MKO10020419_A_Gm11564
  gRNA
ucuauauauggaauguugcu

SEQ ID NO: 20420 - RNA, 20 nt, Artificial Sequence
  MKO10020420_A_Gm11564
  gRNA
acaacuagagauacagcagc

SEQ ID NO: 20421 - RNA, 20 nt, Artificial Sequence
  MKO10020421_A_Gm11564
  gRNA
caagaacaacuagagcaagu

SEQ ID NO: 20422 - RNA, 20 nt, Artificial Sequence
  MKO10020422_A_Gm11565
  gRNA
ugaugaccagcucccaaaaa

SEQ ID NO: 20423 - RNA, 20 nt, Artificial Sequence
  MKO10020423_A_Gm11565
  gRNA
ggggcugcuguugacagucu

SEQ ID NO: 20424 - RNA, 20 nt, Artificial Sequence
  MKO10020424_A_Gm11565
  gRNA
ucaucugcugcgccccuagu

SEQ ID NO: 20425 - RNA, 20 nt, Artificial Sequence
  MKO10020425_A_Gm11567
  gRNA
agaguuaucaacagcaagau

SEQ ID NO: 20426 - RNA, 20 nt, Artificial Sequence
  MKO10020426_A_Gm11567
  gRNA
agcaguuagacccacagccu

SEQ ID NO: 20427 - RNA, 20 nt, Artificial Sequence
  MKO10020427_A_Gm11567
  gRNA
ccaacaugugucugugugcc

SEQ ID NO: 20428 - RNA, 20 nt, Artificial Sequence
  MKO10020428_A_Gm11568
  gRNA
guaaguuaaucaacagccac

SEQ ID NO: 20429 - RNA, 20 nt, Artificial Sequence
  MKO10020429_A_Gm11568
  gRNA
ucuccagcugcugucagccc

SEQ ID NO: 20430 - RNA, 20 nt, Artificial Sequence
  MKO10020430_A_Gm11568
  gRNA
cagcacagauugaggcagaa

SEQ ID NO: 20431 - RNA, 20 nt, Artificial Sequence
  MKO10020431_A_Gm11569
  gRNA
acaacagccugggcggcagc

SEQ ID NO: 20432 - RNA, 20 nt, Artificial Sequence
  MKO10020432_A_Gm11569
  gRNA
accauggucagcuccugcug

SEQ ID NO: 20433 - RNA, 20 nt, Artificial Sequence
  MKO10020433_A_Gm11569
  gRNA
gcagcaagaaccacuagaac

SEQ ID NO: 20434 - RNA, 20 nt, Artificial Sequence
  MKO10020434_A_Gm11570
  gRNA
ggacugguuucacagccgac

SEQ ID NO: 20435 - RNA, 20 nt, Artificial Sequence
  MKO10020435_A_Gm11570
  gRNA
ccaaccugcuugcugccguc

SEQ ID NO: 20436 - RNA, 20 nt, Artificial Sequence
  MKO10020436_A_Gm11570
  gRNA
caacugcucacggaacacga

SEQ ID NO: 20437 - RNA, 20 nt, Artificial Sequence
  MKO10020437_A_Gm11595
  gRNA
acaggucgggcggcagcaac

SEQ ID NO: 20438 - RNA, 20 nt, Artificial Sequence
  MKO10020438_A_Gm11595
  gRNA
cagcuagaaaugcagcaaga

SEQ ID NO: 20439 - RNA, 20 nt, Artificial Sequence
  MKO10020439_A_Gm11595
  gRNA
acaggugguucugcagcaag

SEQ ID NO: 20440 - RNA, 20 nt, Artificial Sequence
  MKO10020440_A_Gm11596
  gRNA
gcagcaguuagaaacgcagc

SEQ ID NO: 20441 - RNA, 20 nt, Artificial Sequence
  MKO10020441_A_Gm11596
  gRNA
gcugcguuucuaacugcugc

SEQ ID NO: 20442 - RNA, 20 nt, Artificial Sequence
  MKO10020442_A_Gm11596
  gRNA
aucacagcaggggcggcagc

SEQ ID NO: 20443 - RNA, 20 nt, Artificial Sequence
  MKO10020443_A_Gm11710
  gRNA
aaccguggaugucagaacug

SEQ ID NO: 20444 - RNA, 20 nt, Artificial Sequence
  MKO10020444_A_Gm11710
  gRNA
cugcucauccucuuccuccc

SEQ ID NO: 20445 - RNA, 20 nt, Artificial Sequence
  MKO10020445_A_Gm11710
  gRNA
gcuacuuaccugggaggaag

SEQ ID NO: 20446 - RNA, 20 nt, Artificial Sequence
  MKO10020446_A_Gm11711
  gRNA
cugcucauccucuuccuccc

SEQ ID NO: 20447 - RNA, 20 nt, Artificial Sequence
  MKO10020447_A_Gm11711
  gRNA
gcuacuuaccugggaggaag

SEQ ID NO: 20448 - RNA, 20 nt, Artificial Sequence
  MKO10020448_A_Gm11711
  gRNA
guucacguuaacuuuaaaca

SEQ ID NO: 20449 - RNA, 20 nt, Artificial Sequence
  MKO10020449_A_Gm11744
  gRNA
ccguagauuuaccaaccgag

SEQ ID NO: 20450 - RNA, 20 nt, Artificial Sequence
  MKO10020450_A_Gm11744
  gRNA
aaaucuacggcgccacagca

SEQ ID NO: 20451 - RNA, 20 nt, Artificial Sequence
  MKO10020451_A_Gm11744
  gRNA
uucaccugccgguagauuga

SEQ ID NO: 20452 - RNA, 20 nt, Artificial Sequence
  MKO10020452_A_Gm11757
  gRNA
auaaccgcguccaaagugug

SEQ ID NO: 20453 - RNA, 20 nt, Artificial Sequence
  MKO10020453_A_Gm11757
  gRNA
ucugaauaccugaggaacuu

SEQ ID NO: 20454 - RNA, 20 nt, Artificial Sequence
  MKO10020454_A_Gm11757
  gRNA
cagguccgugugauagcccg

SEQ ID NO: 20455 - RNA, 20 nt, Artificial Sequence
  MKO10020455_A_Gm11758
  gRNA
auaaccgcguccaaagugug

SEQ ID NO: 20456 - RNA, 20 nt, Artificial Sequence
  MKO10020456_A_Gm11758
  gRNA
ucugaauaccugaggaacuu

SEQ ID NO: 20457 - RNA, 20 nt, Artificial Sequence
  MKO10020457_A_Gm11758
  gRNA
cagguccgugugauagcccg

SEQ ID NO: 20458 - RNA, 20 nt, Artificial Sequence
  MKO10020458_A_Gm11780
  gRNA
ggcggggcuccgucguugua

SEQ ID NO: 20459 - RNA, 20 nt, Artificial Sequence
  MKO10020459_A_Gm11780
  gRNA
agcacuaccggccuaaauug

SEQ ID NO: 20460 - RNA, 20 nt, Artificial Sequence
  MKO10020460_A_Gm11780
  gRNA
cuagaucugccauacaacga

SEQ ID NO: 20461 - RNA, 20 nt, Artificial Sequence
  MKO10020461_A_Gm11837
  gRNA
acucaacaguguaagacgaa

SEQ ID NO: 20462 - RNA, 20 nt, Artificial Sequence
  MKO10020462_A_Gm11837
  gRNA
caccagucuccaguuaaaaa

SEQ ID NO: 20463 - RNA, 20 nt, Artificial Sequence
  MKO10020463_A_Gm11837
  gRNA
uauuaaaguauggaaccuca

SEQ ID NO: 20464 - RNA, 20 nt, Artificial Sequence
  MKO10020464_A_Gm11937
  gRNA
accaugacaggcuccugcug

SEQ ID NO: 20465 - RNA, 20 nt, Artificial Sequence
  MKO10020465_A_Gm11937
  gRNA
gcucagcagcagguguugca

SEQ ID NO: 20466 - RNA, 20 nt, Artificial Sequence
  MKO10020466_A_Gm11937
  gRNA
ccuggugcaguggggcacac

SEQ ID NO: 20467 - RNA, 20 nt, Artificial Sequence
  MKO10020467_A_Gm11938
  gRNA
ccugugugccccauugcacc

SEQ ID NO: 20468 - RNA, 20 nt, Artificial Sequence
  MKO10020468_A_Gm11938
  gRNA
gcggcgacagggcucacaga

SEQ ID NO: 20469 - RNA, 20 nt, Artificial Sequence
  MKO10020469_A_Gm11938
  gRNA
aguccugcagguggugcgac

SEQ ID NO: 20470 - RNA, 20 nt, Artificial Sequence
  MKO10020470_A_Gm11992
  gRNA
ugaagaauucaaccccgauc

SEQ ID NO: 20471 - RNA, 20 nt, Artificial Sequence
  MKO10020471_A_Gm11992
  gRNA
ugauccaguaccuccgagca

SEQ ID NO: 20472 - RNA, 20 nt, Artificial Sequence
  MKO10020472_A_Gm11992
  gRNA
augugaauuugccccgugcu

SEQ ID NO: 20473 - RNA, 20 nt, Artificial Sequence
  MKO10020473_A_Gm12169
  gRNA
aaaugcguccuugacaaucg

SEQ ID NO: 20474 - RNA, 20 nt, Artificial Sequence
  MKO10020474_A_Gm12169
  gRNA
agucacucacguaugauggu

SEQ ID NO: 20475 - RNA, 20 nt, Artificial Sequence
  MKO10020475_A_Gm12169
  gRNA
gcucgcaaggaucagcagug

SEQ ID NO: 20476 - RNA, 20 nt, Artificial Sequence
  MKO10020476_A_Gm12171
  gRNA
auggccccucaaugcgcaac

SEQ ID NO: 20477 - RNA, 20 nt, Artificial Sequence
  MKO10020477_A_Gm12171
  gRNA
caacuuccaguugcgcauug

SEQ ID NO: 20478 - RNA, 20 nt, Artificial Sequence
  MKO10020478_A_Gm12171
  gRNA
gcaaggugaagacgucacug

SEQ ID NO: 20479 - RNA, 20 nt, Artificial Sequence
  MKO10020479_A_Gm12185
  gRNA
ucagauaacggcucaacuuu

SEQ ID NO: 20480 - RNA, 20 nt, Artificial Sequence
  MKO10020480_A_Gm12185
  gRNA
auccucuagggaugauucaa

SEQ ID NO: 20481 - RNA, 20 nt, Artificial Sequence
  MKO10020481_A_Gm12185
  gRNA
gcuacaugccagacuuccac

SEQ ID NO: 20482 - RNA, 20 nt, Artificial Sequence
  MKO10020482_A_Gm12250
  gRNA
uagcaaacgccggucuguac

SEQ ID NO: 20483 - RNA, 20 nt, Artificial Sequence
  MKO10020483_A_Gm12250
  gRNA
uucuucuaaacccgaugcaa

SEQ ID NO: 20484 - RNA, 20 nt, Artificial Sequence
  MKO10020484_A_Gm12250
  gRNA
ccccugucacagcgauguuc

SEQ ID NO: 20485 - RNA, 20 nt, Artificial Sequence
  MKO10020485_A_Gm12253
  gRNA
agcacgugugaauccucuaa

SEQ ID NO: 20486 - RNA, 20 nt, Artificial Sequence
  MKO10020486_A_Gm12253
  gRNA
gauucacacgugcuugaauu

SEQ ID NO: 20487 - RNA, 20 nt, Artificial Sequence
  MKO10020487_A_Gm12253
  gRNA
acuagaauucucgguaacag

SEQ ID NO: 20488 - RNA, 20 nt, Artificial Sequence
  MKO10020488_A_Gm12429
  gRNA
caaacccaccaguguaucuc

SEQ ID NO: 20489 - RNA, 20 nt, Artificial Sequence
  MKO10020489_A_Gm12429
  gRNA
cuccaaaagccuuaauacuu

SEQ ID NO: 20490 - RNA, 20 nt, Artificial Sequence
  MKO10020490_A_Gm12429
  gRNA
cucugcaccucaucagcaug

SEQ ID NO: 20491 - RNA, 20 nt, Artificial Sequence
  MKO10020491_A_Gm12597
  gRNA
ccuacaagagcugacccagc

SEQ ID NO: 20492 - RNA, 20 nt, Artificial Sequence
  MKO10020492_A_Gm12597
  gRNA
ccugcugggucagcucuugu

SEQ ID NO: 20493 - RNA, 20 nt, Artificial Sequence
  MKO10020493_A_Gm12597
  gRNA
cagggauggcuugagcauuc

SEQ ID NO: 20494 - RNA, 20 nt, Artificial Sequence
  MKO10020494_A_Gm12657
  gRNA
augcuauaaacaccauuuag

SEQ ID NO: 20495 - RNA, 20 nt, Artificial Sequence
  MKO10020495_A_Gm12657
  gRNA
cagcagaacacuuucugccc

SEQ ID NO: 20496 - RNA, 20 nt, Artificial Sequence
  MKO10020496_A_Gm12657
  gRNA
aguuaccacccguggauuug

SEQ ID NO: 20497 - RNA, 20 nt, Artificial Sequence
  MKO10020497_A_Gm12695
  gRNA
aggagcuugacuguuaguag

SEQ ID NO: 20498 - RNA, 20 nt, Artificial Sequence
  MKO10020498_A_Gm12695
  gRNA
cuuucagguaaauuauggag

SEQ ID NO: 20499 - RNA, 20 nt, Artificial Sequence
  MKO10020499_A_Gm12695
  gRNA
cccauugagcuccaauuugu

SEQ ID NO: 20500 - RNA, 20 nt, Artificial Sequence
  MKO10020500_A_Gm12789
  gRNA
auuucuagaaaaccaccgag

SEQ ID NO: 20501 - RNA, 20 nt, Artificial Sequence
  MKO10020501_A_Gm12789
  gRNA
gugacuaccuucacaccucu

SEQ ID NO: 20502 - RNA, 20 nt, Artificial Sequence
  MKO10020502_A_Gm12789
  gRNA
ccccguccagugccagcugc

SEQ ID NO: 20503 - RNA, 20 nt, Artificial Sequence
  MKO10020503_A_Gm12794
  gRNA
guauggacugggaaaaacga

SEQ ID NO: 20504 - RNA, 20 nt, Artificial Sequence
  MKO10020504_A_Gm12794
  gRNA
acguaccuaaauaugcacug

SEQ ID NO: 20505 - RNA, 20 nt, Artificial Sequence
  MKO10020505_A_Gm12794
  gRNA
acuggacgagguggugaaga

SEQ ID NO: 20506 - RNA, 20 nt, Artificial Sequence
  MKO10020506_A_Gm12886
  gRNA
guuagagaucgcugcaaucg

SEQ ID NO: 20507 - RNA, 20 nt, Artificial Sequence
  MKO10020507_A_Gm12886
  gRNA
augcccuaagaauguagcca

SEQ ID NO: 20508 - RNA, 20 nt, Artificial Sequence
  MKO10020508_A_Gm12886
  gRNA
ccuguugcagucuugagcac

SEQ ID NO: 20509 - RNA, 20 nt, Artificial Sequence
  MKO10020509_A_Gm12887
  gRNA
ccuacuugaaucuugaucac

SEQ ID NO: 20510 - RNA, 20 nt, Artificial Sequence
  MKO10020510_A_Gm12887
  gRNA
ccagugaucaagauucaagu

SEQ ID NO: 20511 - RNA, 20 nt, Artificial Sequence
  MKO10020511_A_Gm12887
  gRNA
guuagaugucauuguaaucg

SEQ ID NO: 20512 - RNA, 20 nt, Artificial Sequence
  MKO10020512_A_Gm12888
  gRNA
guuagacauccuuaugaucg

SEQ ID NO: 20513 - RNA, 20 nt, Artificial Sequence
  MKO10020513_A_Gm12888
  gRNA
ccauugcacaagacuacagu

SEQ ID NO: 20514 - RNA, 20 nt, Artificial Sequence
  MKO10020514_A_Gm12888
  gRNA
ccuacuguagucuugugcaa

SEQ ID NO: 20515 - RNA, 20 nt, Artificial Sequence
  MKO10020515_A_Gm128
  gRNA
accccgaccgcuaccacgau

SEQ ID NO: 20516 - RNA, 20 nt, Artificial Sequence
  MKO10020516_A_Gm128
  gRNA
gaaguuccggcacuaccggg

SEQ ID NO: 20517 - RNA, 20 nt, Artificial Sequence
  MKO10020517_A_Gm128
  gRNA
cccagguagaaagaauccag

SEQ ID NO: 20518 - RNA, 20 nt, Artificial Sequence
  MKO10020518_A_Gm12942
  gRNA
cgucuucuucgcgcucaccg

SEQ ID NO: 20519 - RNA, 20 nt, Artificial Sequence
  MKO10020519_A_Gm12942
  gRNA
cgggcgcugcuaugucguuc

SEQ ID NO: 20520 - RNA, 20 nt, Artificial Sequence
  MKO10020520_A_Gm12942
  gRNA
ccacuucuuagcucguacua

SEQ ID NO: 20521 - RNA, 20 nt, Artificial Sequence
  MKO10020521_A_Gm129
  gRNA
aggggcauaccuugcuuauc

SEQ ID NO: 20522 - RNA, 20 nt, Artificial Sequence
  MKO10020522_A_Gm129
  gRNA
uuucacagagaacguuaucu

SEQ ID NO: 20523 - RNA, 20 nt, Artificial Sequence
  MKO10020523_A_Gm129
  gRNA
ccaucuugaguccguucagu

SEQ ID NO: 20524 - RNA, 20 nt, Artificial Sequence
  MKO10020524_A_Gm12
  gRNA
ccgggcgccgcgucucaucu

SEQ ID NO: 20525 - RNA, 20 nt, Artificial Sequence
  MKO10020525_A_Gm12
  gRNA
gugucguuggggauaccguu

SEQ ID NO: 20526 - RNA, 20 nt, Artificial Sequence
  MKO10020526_A_Gm12
  gRNA
uugugacacgagugccagcc

SEQ ID NO: 20527 - RNA, 20 nt, Artificial Sequence
  MKO10020527_A_Gm13011
  gRNA
ccccagcaauaacaucgcuc

SEQ ID NO: 20528 - RNA, 20 nt, Artificial Sequence
  MKO10020528_A_Gm13011
  gRNA
gcaggccuuaucucaacuac

SEQ ID NO: 20529 - RNA, 20 nt, Artificial Sequence
  MKO10020529_A_Gm13011
  gRNA
auggaacuuacaugaugcag

SEQ ID NO: 20530 - RNA, 20 nt, Artificial Sequence
  MKO10020530_A_Gm13023
  gRNA
gcaguauaucuagucccuca

SEQ ID NO: 20531 - RNA, 20 nt, Artificial Sequence
  MKO10020531_A_Gm13023
  gRNA
ugggugcuacauuuaugacc

SEQ ID NO: 20532 - RNA, 20 nt, Artificial Sequence
  MKO10020532_A_Gm13023
  gRNA
ugccugaauauggugaucug

SEQ ID NO: 20533 - RNA, 20 nt, Artificial Sequence
  MKO10020533_A_Gm13040
  gRNA
auagaugcggauuucugauc

SEQ ID NO: 20534 - RNA, 20 nt, Artificial Sequence
  MKO10020534_A_Gm13040
  gRNA
gcuugcaauauugucauguc

SEQ ID NO: 20535 - RNA, 20 nt, Artificial Sequence
  MKO10020535_A_Gm13040
  gRNA
auucauuguacagauucauc

SEQ ID NO: 20536 - RNA, 20 nt, Artificial Sequence
  MKO10020536_A_Gm13043
  gRNA
gcuugcaauauugucauguc

SEQ ID NO: 20537 - RNA, 20 nt, Artificial Sequence
  MKO10020537_A_Gm13043
  gRNA
auucaucaggaugagcuucc

SEQ ID NO: 20538 - RNA, 20 nt, Artificial Sequence
  MKO10020538_A_Gm13043
  gRNA
acacgagcaauucauucaug

SEQ ID NO: 20539 - RNA, 20 nt, Artificial Sequence
  MKO10020539_A_Gm13051
  gRNA
aacaagaaugaguguguguc

SEQ ID NO: 20540 - RNA, 20 nt, Artificial Sequence
  MKO10020540_A_Gm13051
  gRNA
uuccuccagugagaagucca

SEQ ID NO: 20541 - RNA, 20 nt, Artificial Sequence
  MKO10020541_A_Gm13051
  gRNA
acagggucuguuaacuuuca

SEQ ID NO: 20542 - RNA, 20 nt, Artificial Sequence
  MKO10020542_A_Gm13057
  gRNA
auagaugcggauuucugauc

SEQ ID NO: 20543 - RNA, 20 nt, Artificial Sequence
  MKO10020543_A_Gm13057
  gRNA
gcuugcaauauugucauguc

SEQ ID NO: 20544 - RNA, 20 nt, Artificial Sequence
  MKO10020544_A_Gm13057
  gRNA
auucauuguacagauucauc

SEQ ID NO: 20545 - RNA, 20 nt, Artificial Sequence
  MKO10020545_A_Gm13078
  gRNA
caccaagggcuagugaugca

SEQ ID NO: 20546 - RNA, 20 nt, Artificial Sequence
  MKO10020546_A_Gm13078
  gRNA
aucuucaucagggaucccac

SEQ ID NO: 20547 - RNA, 20 nt, Artificial Sequence
  MKO10020547_A_Gm13078
  gRNA
caaagcuucagaacauccag

SEQ ID NO: 20548 - RNA, 20 nt, Artificial Sequence
  MKO10020548_A_Gm13083
  gRNA
uuucucucuaggugcuuuaa

SEQ ID NO: 20549 - RNA, 20 nt, Artificial Sequence
  MKO10020549_A_Gm13083
  gRNA
ccugaugaagauaccucacc

SEQ ID NO: 20550 - RNA, 20 nt, Artificial Sequence
  MKO10020550_A_Gm13083
  gRNA
gaaugcagugaguaauagca

SEQ ID NO: 20551 - RNA, 20 nt, Artificial Sequence
  MKO10020551_A_Gm13084
  gRNA
uagcaauacagcgucuacug

SEQ ID NO: 20552 - RNA, 20 nt, Artificial Sequence
  MKO10020552_A_Gm13084
  gRNA
gcuggaucccaugaagucga

SEQ ID NO: 20553 - RNA, 20 nt, Artificial Sequence
  MKO10020553_A_Gm13084
  gRNA
cuacucgccacccacucuga

SEQ ID NO: 20554 - RNA, 20 nt, Artificial Sequence
  MKO10020554_A_Gm13088
  gRNA
auagcucagcugugucaacu

SEQ ID NO: 20555 - RNA, 20 nt, Artificial Sequence
  MKO10020555_A_Gm13088
  gRNA
uaagaaacgccagaucuucu

SEQ ID NO: 20556 - RNA, 20 nt, Artificial Sequence
  MKO10020556_A_Gm13088
  gRNA
acagaagcauccuaauugug

SEQ ID NO: 20557 - RNA, 20 nt, Artificial Sequence
  MKO10020557_A_Gm13102
  gRNA
cucucaaaguagaccugcuu

SEQ ID NO: 20558 - RNA, 20 nt, Artificial Sequence
  MKO10020558_A_Gm13102
  gRNA
uuugugacaucagcaaauca

SEQ ID NO: 20559 - RNA, 20 nt, Artificial Sequence
  MKO10020559_A_Gm13102
  gRNA
gaaagcuacaaugagcuuca

SEQ ID NO: 20560 - RNA, 20 nt, Artificial Sequence
  MKO10020560_A_Gm13103
  gRNA
cugagcuaugagauguaucc

SEQ ID NO: 20561 - RNA, 20 nt, Artificial Sequence
  MKO10020561_A_Gm13103
  gRNA
gauacaucucauagcucagc

SEQ ID NO: 20562 - RNA, 20 nt, Artificial Sequence
  MKO10020562_A_Gm13103
  gRNA
uaagaaacgccagaucuugu

SEQ ID NO: 20563 - RNA, 20 nt, Artificial Sequence
  MKO10020563_A_Gm13119
  gRNA
gcugugugaaauugcagauu

SEQ ID NO: 20564 - RNA, 20 nt, Artificial Sequence
  MKO10020564_A_Gm13119
  gRNA
cagucuccagcaucucgccc

SEQ ID NO: 20565 - RNA, 20 nt, Artificial Sequence
  MKO10020565_A_Gm13119
  gRNA
acuugcagagagccauugac

SEQ ID NO: 20566 - RNA, 20 nt, Artificial Sequence
  MKO10020566_A_Gm13124
  gRNA
aaauugacccccuggacgac

SEQ ID NO: 20567 - RNA, 20 nt, Artificial Sequence
  MKO10020567_A_Gm13124
  gRNA
ggcugcggccauuauugcuc

SEQ ID NO: 20568 - RNA, 20 nt, Artificial Sequence
  MKO10020568_A_Gm13124
  gRNA
gucuccccaggggaauguac

SEQ ID NO: 20569 - RNA, 20 nt, Artificial Sequence
  MKO10020569_A_Gm13125
  gRNA
cuccuuacuugcgccaaaug

SEQ ID NO: 20570 - RNA, 20 nt, Artificial Sequence
  MKO10020570_A_Gm13125
  gRNA
guuuacgcaaguuccucauu

SEQ ID NO: 20571 - RNA, 20 nt, Artificial Sequence
  MKO10020571_A_Gm13125
  gRNA
cuguugaagcaagccuacga

SEQ ID NO: 20572 - RNA, 20 nt, Artificial Sequence
  MKO10020572_A_Gm13128
  gRNA
ugugauacacguuguaucua

SEQ ID NO: 20573 - RNA, 20 nt, Artificial Sequence
  MKO10020573_A_Gm13128
  gRNA
gcugauagauaaacccaacu

SEQ ID NO: 20574 - RNA, 20 nt, Artificial Sequence
  MKO10020574_A_Gm13128
  gRNA
uggagcauuagaagugucca

SEQ ID NO: 20575 - RNA, 20 nt, Artificial Sequence
  MKO10020575_A_Gm13139
  gRNA
aacaagaaugaguguguguc

SEQ ID NO: 20576 - RNA, 20 nt, Artificial Sequence
  MKO10020576_A_Gm13139
  gRNA
uuccuccagugagaagucca

SEQ ID NO: 20577 - RNA, 20 nt, Artificial Sequence
  MKO10020577_A_Gm13139
  gRNA
acagggucuguuaaccuuca

SEQ ID NO: 20578 - RNA, 20 nt, Artificial Sequence
  MKO10020578_A_Gm13152
  gRNA
guacuggcugucuucaucca

SEQ ID NO: 20579 - RNA, 20 nt, Artificial Sequence
  MKO10020579_A_Gm13152
  gRNA
uaccucacaaauguagugaa

SEQ ID NO: 20580 - RNA, 20 nt, Artificial Sequence
  MKO10020580_A_Gm13152
  gRNA
uguggccguggaauucucac

SEQ ID NO: 20581 - RNA, 20 nt, Artificial Sequence
  MKO10020581_A_Gm13154
  gRNA
aucacagcucucuucaauac

SEQ ID NO: 20582 - RNA, 20 nt, Artificial Sequence
  MKO10020582_A_Gm13154
  gRNA
gauccaucuuagaagucauc

SEQ ID NO: 20583 - RNA, 20 nt, Artificial Sequence
  MKO10020583_A_Gm13154
  gRNA
aacaagaaugagugagucuc

SEQ ID NO: 20584 - RNA, 20 nt, Artificial Sequence
  MKO10020584_A_Gm13157
  gRNA
cuugaauauucacguguuca

SEQ ID NO: 20585 - RNA, 20 nt, Artificial Sequence
  MKO10020585_A_Gm13157
  gRNA
cguggccuuguacuucucac

SEQ ID NO: 20586 - RNA, 20 nt, Artificial Sequence
  MKO10020586_A_Gm13157
  gRNA
aacaagaaugagugugucuc

SEQ ID NO: 20587 - RNA, 20 nt, Artificial Sequence
  MKO10020587_A_Gm13177
  gRNA
ucaguaccauggcuaucccg

SEQ ID NO: 20588 - RNA, 20 nt, Artificial Sequence
  MKO10020588_A_Gm13177
  gRNA
guguccucagaaggccgucg

SEQ ID NO: 20589 - RNA, 20 nt, Artificial Sequence
  MKO10020589_A_Gm13177
  gRNA
gcaccacugaauccgucugc

SEQ ID NO: 20590 - RNA, 20 nt, Artificial Sequence
  MKO10020590_A_Gm13178
  gRNA
cccucucggguggugaucuc

SEQ ID NO: 20591 - RNA, 20 nt, Artificial Sequence
  MKO10020591_A_Gm13178
  gRNA
uccagagaucaccacccgag

SEQ ID NO: 20592 - RNA, 20 nt, Artificial Sequence
  MKO10020592_A_Gm13178
  gRNA
ugaagcauccagucaagcua

SEQ ID NO: 20593 - RNA, 20 nt, Artificial Sequence
  MKO10020593_A_Gm13212
  gRNA
acuguacaaggauguaaugu

SEQ ID NO: 20594 - RNA, 20 nt, Artificial Sequence
  MKO10020594_A_Gm13212
  gRNA
aacaagaaugagugugucuc

SEQ ID NO: 20595 - RNA, 20 nt, Artificial Sequence
  MKO10020595_A_Gm13212
  gRNA
uuccuccagugagaaguaca

SEQ ID NO: 20596 - RNA, 20 nt, Artificial Sequence
  MKO10020596_A_Gm1322
  gRNA
aaaagcguucaauccugcgc

SEQ ID NO: 20597 - RNA, 20 nt, Artificial Sequence
  MKO10020597_A_Gm1322
  gRNA
auucccugacuggccggcgc

SEQ ID NO: 20598 - RNA, 20 nt, Artificial Sequence
  MKO10020598_A_Gm1322
  gRNA
caggcaugauggacauacgu

SEQ ID NO: 20599 - RNA, 20 nt, Artificial Sequence
  MKO10020599_A_Gm13242
  gRNA
guauucaucagaauucauac

SEQ ID NO: 20600 - RNA, 20 nt, Artificial Sequence
  MKO10020600_A_Gm13242
  gRNA
ucucugugauuaguguuaua

SEQ ID NO: 20601 - RNA, 20 nt, Artificial Sequence
  MKO10020601_A_Gm13242
  gRNA
uuguucuucucccagauucu

SEQ ID NO: 20602 - RNA, 20 nt, Artificial Sequence
  MKO10020602_A_Gm13247
  gRNA
guucaaagccacaucguuga

SEQ ID NO: 20603 - RNA, 20 nt, Artificial Sequence
  MKO10020603_A_Gm13247
  gRNA
cuuuacugacaaauucauuc

SEQ ID NO: 20604 - RNA, 20 nt, Artificial Sequence
  MKO10020604_A_Gm13247
  gRNA
cuaaagaaugagugccucuc

SEQ ID NO: 20605 - RNA, 20 nt, Artificial Sequence
  MKO10020605_A_Gm13251
  gRNA
aacaagaaugaguguguguc

SEQ ID NO: 20606 - RNA, 20 nt, Artificial Sequence
  MKO10020606_A_Gm13251
  gRNA
uuccuccagugagaagucca

SEQ ID NO: 20607 - RNA, 20 nt, Artificial Sequence
  MKO10020607_A_Gm13251
  gRNA
acagggucuguuaaccuuca

SEQ ID NO: 20608 - RNA, 20 nt, Artificial Sequence
  MKO10020608_A_Gm13271
  gRNA
gcgggguuucgcuaugcucc

SEQ ID NO: 20609 - RNA, 20 nt, Artificial Sequence
  MKO10020609_A_Gm13271
  gRNA
uaaaucugggagccuacacc

SEQ ID NO: 20610 - RNA, 20 nt, Artificial Sequence
  MKO10020610_A_Gm13271
  gRNA
agaacacucggaaguaggug

SEQ ID NO: 20611 - RNA, 20 nt, Artificial Sequence
  MKO10020611_A_Gm13272
  gRNA
cugggagguccacuugcaau

SEQ ID NO: 20612 - RNA, 20 nt, Artificial Sequence
  MKO10020612_A_Gm13272
  gRNA
gggccucuucucgcagacag

SEQ ID NO: 20613 - RNA, 20 nt, Artificial Sequence
  MKO10020613_A_Gm13272
  gRNA
gcugccugugcaucuauucc

SEQ ID NO: 20614 - RNA, 20 nt, Artificial Sequence
  MKO10020614_A_Gm13275
  gRNA
gcugccugugcauauauucc

SEQ ID NO: 20615 - RNA, 20 nt, Artificial Sequence
  MKO10020615_A_Gm13275
  gRNA
gggccucuucucgcagacag

SEQ ID NO: 20616 - RNA, 20 nt, Artificial Sequence
  MKO10020616_A_Gm13275
  gRNA
ggaggaccugccugaggguc

SEQ ID NO: 20617 - RNA, 20 nt, Artificial Sequence
  MKO10020617_A_Gm13276
  gRNA
gggccucuucucgcagacag

SEQ ID NO: 20618 - RNA, 20 nt, Artificial Sequence
  MKO10020618_A_Gm13276
  gRNA
gcugccugugcaucuauucc

SEQ ID NO: 20619 - RNA, 20 nt, Artificial Sequence
  MKO10020619_A_Gm13276
  gRNA
ggaggaccugccugaggcuc

SEQ ID NO: 20620 - RNA, 20 nt, Artificial Sequence
  MKO10020620_A_Gm13277
  gRNA
gggccucuucucgcagacag

SEQ ID NO: 20621 - RNA, 20 nt, Artificial Sequence
  MKO10020621_A_Gm13277
  gRNA
gcugccugugcaucuauucc

SEQ ID NO: 20622 - RNA, 20 nt, Artificial Sequence
  MKO10020622_A_Gm13277
  gRNA
ggaggaccugcuugaggguc

SEQ ID NO: 20623 - RNA, 20 nt, Artificial Sequence
  MKO10020623_A_Gm13278
  gRNA
gggccucuucucgcagacag

SEQ ID NO: 20624 - RNA, 20 nt, Artificial Sequence
  MKO10020624_A_Gm13278
  gRNA
gcugccugugcaucuauucc

SEQ ID NO: 20625 - RNA, 20 nt, Artificial Sequence
  MKO10020625_A_Gm13278
  gRNA
ggaggaccugcuugaggguc

SEQ ID NO: 20626 - RNA, 20 nt, Artificial Sequence
  MKO10020626_A_Gm13279
  gRNA
gggccucuucucgcagacag

SEQ ID NO: 20627 - RNA, 20 nt, Artificial Sequence
  MKO10020627_A_Gm13279
  gRNA
gcugccugugcaucuauucc

SEQ ID NO: 20628 - RNA, 20 nt, Artificial Sequence
  MKO10020628_A_Gm13279
  gRNA
ggaggaccugcuugaggguc

SEQ ID NO: 20629 - RNA, 20 nt, Artificial Sequence
  MKO10020629_A_Gm13280
  gRNA
ccucaccugcugcacuagac

SEQ ID NO: 20630 - RNA, 20 nt, Artificial Sequence
  MKO10020630_A_Gm13280
  gRNA
gcaagccugucuagugcagc

SEQ ID NO: 20631 - RNA, 20 nt, Artificial Sequence
  MKO10020631_A_Gm13280
  gRNA
agccaucccuguccuaagug

SEQ ID NO: 20632 - RNA, 20 nt, Artificial Sequence
  MKO10020632_A_Gm13283
  gRNA
ccuccaccgcuuugacacag

SEQ ID NO: 20633 - RNA, 20 nt, Artificial Sequence
  MKO10020633_A_Gm13283
  gRNA
agcagaucuccgaagcgugc

SEQ ID NO: 20634 - RNA, 20 nt, Artificial Sequence
  MKO10020634_A_Gm13283
  gRNA
gggccucuucucgcagacag

SEQ ID NO: 20635 - RNA, 20 nt, Artificial Sequence
  MKO10020635_A_Gm13285
  gRNA
gggccucuucucgcagacag

SEQ ID NO: 20636 - RNA, 20 nt, Artificial Sequence
  MKO10020636_A_Gm13285
  gRNA
gcugccugugcaucuauucc

SEQ ID NO: 20637 - RNA, 20 nt, Artificial Sequence
  MKO10020637_A_Gm13285
  gRNA
ggaggaccugccugaggguc

SEQ ID NO: 20638 - RNA, 20 nt, Artificial Sequence
  MKO10020638_A_Gm13286
  gRNA
gcagaucugccuggcacaag

SEQ ID NO: 20639 - RNA, 20 nt, Artificial Sequence
  MKO10020639_A_Gm13286
  gRNA
guccagcgcccucuugugcc

SEQ ID NO: 20640 - RNA, 20 nt, Artificial Sequence
  MKO10020640_A_Gm13286
  gRNA
uaaaucugggagucugcacc

SEQ ID NO: 20641 - RNA, 20 nt, Artificial Sequence
  MKO10020641_A_Gm13287
  gRNA
gggccucuucucgcagacag

SEQ ID NO: 20642 - RNA, 20 nt, Artificial Sequence
  MKO10020642_A_Gm13287
  gRNA
gcugccugugcaucuauucc

SEQ ID NO: 20643 - RNA, 20 nt, Artificial Sequence
  MKO10020643_A_Gm13287
  gRNA
ggaggaccugccugaggguc

SEQ ID NO: 20644 - RNA, 20 nt, Artificial Sequence
  MKO10020644_A_Gm13288
  gRNA
gggccucuucucgcagacag

SEQ ID NO: 20645 - RNA, 20 nt, Artificial Sequence
  MKO10020645_A_Gm13288
  gRNA
gcugccugugcaucuauucc

SEQ ID NO: 20646 - RNA, 20 nt, Artificial Sequence
  MKO10020646_A_Gm13288
  gRNA
ggaggaccugcuugaggguc

SEQ ID NO: 20647 - RNA, 20 nt, Artificial Sequence
  MKO10020647_A_Gm13289
  gRNA
gggccucuucucgcagacag

SEQ ID NO: 20648 - RNA, 20 nt, Artificial Sequence
  MKO10020648_A_Gm13289
  gRNA
gcugccugugcaucuauucc

SEQ ID NO: 20649 - RNA, 20 nt, Artificial Sequence
  MKO10020649_A_Gm13289
  gRNA
ggaggaccugcuugaggguc

SEQ ID NO: 20650 - RNA, 20 nt, Artificial Sequence
  MKO10020650_A_Gm13290
  gRNA
gggccucuucucgcagacag

SEQ ID NO: 20651 - RNA, 20 nt, Artificial Sequence
  MKO10020651_A_Gm13290
  gRNA
gcugccugugcaucuauucc

SEQ ID NO: 20652 - RNA, 20 nt, Artificial Sequence
  MKO10020652_A_Gm13290
  gRNA
ggaggaccugcuugaggguc

SEQ ID NO: 20653 - RNA, 20 nt, Artificial Sequence
  MKO10020653_A_Gm13304
  gRNA
cuccuugguaccuugggucc

SEQ ID NO: 20654 - RNA, 20 nt, Artificial Sequence
  MKO10020654_A_Gm13304
  gRNA
gacucugagccuccuuagcc

SEQ ID NO: 20655 - RNA, 20 nt, Artificial Sequence
  MKO10020655_A_Gm13304
  gRNA
agcgcacucacaggauugcc

SEQ ID NO: 20656 - RNA, 20 nt, Artificial Sequence
  MKO10020656_A_Gm13305
  gRNA
cacuuacccagcacucacuc

SEQ ID NO: 20657 - RNA, 20 nt, Artificial Sequence
  MKO10020657_A_Gm13305
  gRNA
cccgugaugcugugcugccc

SEQ ID NO: 20658 - RNA, 20 nt, Artificial Sequence
  MKO10020658_A_Gm13305
  gRNA
ccuccaggacuccagugucc

SEQ ID NO: 20659 - RNA, 20 nt, Artificial Sequence
  MKO10020659_A_Gm13306
  gRNA
uucugcuuagucuuguucca

SEQ ID NO: 20660 - RNA, 20 nt, Artificial Sequence
  MKO10020660_A_Gm13306
  gRNA
aacaagccagagacuaaguc

SEQ ID NO: 20661 - RNA, 20 nt, Artificial Sequence
  MKO10020661_A_Gm13306
  gRNA
aacuuaccugcuucaggagc

SEQ ID NO: 20662 - RNA, 20 nt, Artificial Sequence
  MKO10020662_A_Gm13308
  gRNA
gccuggacaugucgcgauug

SEQ ID NO: 20663 - RNA, 20 nt, Artificial Sequence
  MKO10020663_A_Gm13308
  gRNA
auacgagguggcgcuggaag

SEQ ID NO: 20664 - RNA, 20 nt, Artificial Sequence
  MKO10020664_A_Gm13308
  gRNA
cugcgccacauucgcaaccg

SEQ ID NO: 20665 - RNA, 20 nt, Artificial Sequence
  MKO10020665_A_Gm13547
  gRNA
gacaaucaguuagagccgaa

SEQ ID NO: 20666 - RNA, 20 nt, Artificial Sequence
  MKO10020666_A_Gm13547
  gRNA
gagagacaucugccagacga

SEQ ID NO: 20667 - RNA, 20 nt, Artificial Sequence
  MKO10020667_A_Gm13547
  gRNA
ugcaggagcagugccauccg

SEQ ID NO: 20668 - RNA, 20 nt, Artificial Sequence
  MKO10020668_A_Gm136
  gRNA
gcccaucauauugucaagag

SEQ ID NO: 20669 - RNA, 20 nt, Artificial Sequence
  MKO10020669_A_Gm136
  gRNA
acugcuccaaaaacaagccg

SEQ ID NO: 20670 - RNA, 20 nt, Artificial Sequence
  MKO10020670_A_Gm136
  gRNA
cugagccaugccguaguaga

SEQ ID NO: 20671 - RNA, 20 nt, Artificial Sequence
  MKO10020671_A_Gm13718
  gRNA
uucccaacaucggauggguc

SEQ ID NO: 20672 - RNA, 20 nt, Artificial Sequence
  MKO10020672_A_Gm13718
  gRNA
gggucuaguccaaugcugac

SEQ ID NO: 20673 - RNA, 20 nt, Artificial Sequence
  MKO10020673_A_Gm13718
  gRNA
ccugacagaaaacuacguaa

SEQ ID NO: 20674 - RNA, 20 nt, Artificial Sequence
  MKO10020674_A_Gm13769
  gRNA
gagcagacaaguuuaagcac

SEQ ID NO: 20675 - RNA, 20 nt, Artificial Sequence
  MKO10020675_A_Gm13769
  gRNA
uacuagcaucaugaaccgac

SEQ ID NO: 20676 - RNA, 20 nt, Artificial Sequence
  MKO10020676_A_Gm13769
  gRNA
gaaauaauggucaaugauau

SEQ ID NO: 20677 - RNA, 20 nt, Artificial Sequence
  MKO10020677_A_Gm13826
  gRNA
cuuuaaaaacagaugugcgc

SEQ ID NO: 20678 - RNA, 20 nt, Artificial Sequence
  MKO10020678_A_Gm13826
  gRNA
aacuguugaauguuaacugc

SEQ ID NO: 20679 - RNA, 20 nt, Artificial Sequence
  MKO10020679_A_Gm13826
  gRNA
cgcauaccagaagugugaga

SEQ ID NO: 20680 - RNA, 20 nt, Artificial Sequence
  MKO10020680_A_Gm13871
  gRNA
auaaccgcguccaaagugug

SEQ ID NO: 20681 - RNA, 20 nt, Artificial Sequence
  MKO10020681_A_Gm13871
  gRNA
ucugaauaccugaggaacuu

SEQ ID NO: 20682 - RNA, 20 nt, Artificial Sequence
  MKO10020682_A_Gm13871
  gRNA
cagguccgugugauagcccg

SEQ ID NO: 20683 - RNA, 20 nt, Artificial Sequence
  MKO10020683_A_Gm13889
  gRNA
ccggcgacgagccgacucag

SEQ ID NO: 20684 - RNA, 20 nt, Artificial Sequence
  MKO10020684_A_Gm13889
  gRNA
ccgcugagucggcucgucgc

SEQ ID NO: 20685 - RNA, 20 nt, Artificial Sequence
  MKO10020685_A_Gm13889
  gRNA
gcgcccgggcucuccggggg

SEQ ID NO: 20686 - RNA, 20 nt, Artificial Sequence
  MKO10020686_A_Gm14085
  gRNA
accacuucagacaacgucuc

SEQ ID NO: 20687 - RNA, 20 nt, Artificial Sequence
  MKO10020687_A_Gm14085
  gRNA
ugcgcaaagaaacacacuag

SEQ ID NO: 20688 - RNA, 20 nt, Artificial Sequence
  MKO10020688_A_Gm14085
  gRNA
gccugagacguugucugaag

SEQ ID NO: 20689 - RNA, 20 nt, Artificial Sequence
  MKO10020689_A_Gm14092
  gRNA
ugacucuugcauuaacaccg

SEQ ID NO: 20690 - RNA, 20 nt, Artificial Sequence
  MKO10020690_A_Gm14092
  gRNA
ugaucaauuauagcucccac

SEQ ID NO: 20691 - RNA, 20 nt, Artificial Sequence
  MKO10020691_A_Gm14092
  gRNA
aguuaagaauccagcgacuu

SEQ ID NO: 20692 - RNA, 20 nt, Artificial Sequence
  MKO10020692_A_Gm14124
  gRNA
gagacgacgagaacaugcaa

SEQ ID NO: 20693 - RNA, 20 nt, Artificial Sequence
  MKO10020693_A_Gm14124
  gRNA
uaccauaagagaguucguac

SEQ ID NO: 20694 - RNA, 20 nt, Artificial Sequence
  MKO10020694_A_Gm14124
  gRNA
gaagauguucuuccguauua

SEQ ID NO: 20695 - RNA, 20 nt, Artificial Sequence
  MKO10020695_A_Gm14137
  gRNA
cccugucgaugcagucuccg

SEQ ID NO: 20696 - RNA, 20 nt, Artificial Sequence
  MKO10020696_A_Gm14137
  gRNA
agcucucucgguagaggcgu

SEQ ID NO: 20697 - RNA, 20 nt, Artificial Sequence
  MKO10020697_A_Gm14137
  gRNA
gccacggagacugcaucgac

SEQ ID NO: 20698 - RNA, 20 nt, Artificial Sequence
  MKO10020698_A_Gm14139
  gRNA
guuccugucugaaucugagc

SEQ ID NO: 20699 - RNA, 20 nt, Artificial Sequence
  MKO10020699_A_Gm14139
  gRNA
gaagaugcucuuccguauua

SEQ ID NO: 20700 - RNA, 20 nt, Artificial Sequence
  MKO10020700_A_Gm14139
  gRNA
augcuaaaucuuuaccacac

SEQ ID NO: 20701 - RNA, 20 nt, Artificial Sequence
  MKO10020701_A_Gm14151
  gRNA
uaucagcgaagaugaagaga

SEQ ID NO: 20702 - RNA, 20 nt, Artificial Sequence
  MKO10020702_A_Gm14151
  gRNA
ucuccacuuaccugauacca

SEQ ID NO: 20703 - RNA, 20 nt, Artificial Sequence
  MKO10020703_A_Gm14151
  gRNA
ucuguuugaagagcauuuag

SEQ ID NO: 20704 - RNA, 20 nt, Artificial Sequence
  MKO10020704_A_Gm14288
  gRNA
cgugcaugugaacuucacuc

SEQ ID NO: 20705 - RNA, 20 nt, Artificial Sequence
  MKO10020705_A_Gm14288
  gRNA
uauagcugugagauuccuau

SEQ ID NO: 20706 - RNA, 20 nt, Artificial Sequence
  MKO10020706_A_Gm14288
  gRNA
acuguguuuagguuacaguu

SEQ ID NO: 20707 - RNA, 20 nt, Artificial Sequence
  MKO10020707_A_Gm14295
  gRNA
uauagcugugagauuccugu

SEQ ID NO: 20708 - RNA, 20 nt, Artificial Sequence
  MKO10020708_A_Gm14295
  gRNA
gugugaugcuagagaccuac

SEQ ID NO: 20709 - RNA, 20 nt, Artificial Sequence
  MKO10020709_A_Gm14295
  gRNA
gacuucgagaaguuugaaaa

SEQ ID NO: 20710 - RNA, 20 nt, Artificial Sequence
  MKO10020710_A_Gm14305
  gRNA
gagaguccuccaaauacaua

SEQ ID NO: 20711 - RNA, 20 nt, Artificial Sequence
  MKO10020711_A_Gm14305
  gRNA
uauagcugugagauucuuau

SEQ ID NO: 20712 - RNA, 20 nt, Artificial Sequence
  MKO10020712_A_Gm14305
  gRNA
cgugcaugugaacuucacuc

SEQ ID NO: 20713 - RNA, 20 nt, Artificial Sequence
  MKO10020713_A_Gm14306
  gRNA
uguguuaugcgugacucuac

SEQ ID NO: 20714 - RNA, 20 nt, Artificial Sequence
  MKO10020714_A_Gm14306
  gRNA
caagcucagaacuccaaaca

SEQ ID NO: 20715 - RNA, 20 nt, Artificial Sequence
  MKO10020715_A_Gm14306
  gRNA
uauagcugugagauuccuau

SEQ ID NO: 20716 - RNA, 20 nt, Artificial Sequence
  MKO10020716_A_Gm14308
  gRNA
cgugcaugugaacuucacuc

SEQ ID NO: 20717 - RNA, 20 nt, Artificial Sequence
  MKO10020717_A_Gm14308
  gRNA
uauagcugugagauucuuau

SEQ ID NO: 20718 - RNA, 20 nt, Artificial Sequence
  MKO10020718_A_Gm14308
  gRNA
acuggguuuagguuacauuu

SEQ ID NO: 20719 - RNA, 20 nt, Artificial Sequence
  MKO10020719_A_Gm14322
  gRNA
gagaguauagcuuacugcaa

SEQ ID NO: 20720 - RNA, 20 nt, Artificial Sequence
  MKO10020720_A_Gm14322
  gRNA
uauagcugugagauuccuau

SEQ ID NO: 20721 - RNA, 20 nt, Artificial Sequence
  MKO10020721_A_Gm14322
  gRNA
cgugcaugugaacuucacuc

SEQ ID NO: 20722 - RNA, 20 nt, Artificial Sequence
  MKO10020722_A_Gm14325
  gRNA
ucaauguggaaauugugagc

SEQ ID NO: 20723 - RNA, 20 nt, Artificial Sequence
  MKO10020723_A_Gm14325
  gRNA
agaaaacaaaauguagcaaa

SEQ ID NO: 20724 - RNA, 20 nt, Artificial Sequence
  MKO10020724_A_Gm14325
  gRNA
gacuucuagaaguuugaaga

SEQ ID NO: 20725 - RNA, 20 nt, Artificial Sequence
  MKO10020725_A_Gm14326
  gRNA
acauucauaugauuucucuc

SEQ ID NO: 20726 - RNA, 20 nt, Artificial Sequence
  MKO10020726_A_Gm14326
  gRNA
cccuaugaauggaaccaaug

SEQ ID NO: 20727 - RNA, 20 nt, Artificial Sequence
  MKO10020727_A_Gm14326
  gRNA
agucaccuaugaugaugugc

SEQ ID NO: 20728 - RNA, 20 nt, Artificial Sequence
  MKO10020728_A_Gm14345
  gRNA
caaccacuguuguuuguaaa

SEQ ID NO: 20729 - RNA, 20 nt, Artificial Sequence
  MKO10020729_A_Gm14345
  gRNA
acuuggagagaaucacacca

SEQ ID NO: 20730 - RNA, 20 nt, Artificial Sequence
  MKO10020730_A_Gm14345
  gRNA
aucuuguucaagaauaguug

SEQ ID NO: 20731 - RNA, 20 nt, Artificial Sequence
  MKO10020731_A_Gm14346
  gRNA
acuuggagagaaucacacca

SEQ ID NO: 20732 - RNA, 20 nt, Artificial Sequence
  MKO10020732_A_Gm14346
  gRNA
caaccacuguuguuuguaaa

SEQ ID NO: 20733 - RNA, 20 nt, Artificial Sequence
  MKO10020733_A_Gm14346
  gRNA
aaaucugaucauuaagaaug

SEQ ID NO: 20734 - RNA, 20 nt, Artificial Sequence
  MKO10020734_A_Gm14347
  gRNA
caaccacuguuguuuguaaa

SEQ ID NO: 20735 - RNA, 20 nt, Artificial Sequence
  MKO10020735_A_Gm14347
  gRNA
acuuggagagaaucacacca

SEQ ID NO: 20736 - RNA, 20 nt, Artificial Sequence
  MKO10020736_A_Gm14347
  gRNA
aucuuguucaagaauaguug

SEQ ID NO: 20737 - RNA, 20 nt, Artificial Sequence
  MKO10020737_A_Gm14351
  gRNA
acuuggagagaaucacacca

SEQ ID NO: 20738 - RNA, 20 nt, Artificial Sequence
  MKO10020738_A_Gm14351
  gRNA
caaccacuguuguuuguaaa

SEQ ID NO: 20739 - RNA, 20 nt, Artificial Sequence
  MKO10020739_A_Gm14351
  gRNA
aaaucugaucauuaagaaug

SEQ ID NO: 20740 - RNA, 20 nt, Artificial Sequence
  MKO10020740_A_Gm14374
  gRNA
caaccacuguuguuuguaaa

SEQ ID NO: 20741 - RNA, 20 nt, Artificial Sequence
  MKO10020741_A_Gm14374
  gRNA
acuuggagagaaucacacca

SEQ ID NO: 20742 - RNA, 20 nt, Artificial Sequence
  MKO10020742_A_Gm14374
  gRNA
aucuuguucaagaauaguug

SEQ ID NO: 20743 - RNA, 20 nt, Artificial Sequence
  MKO10020743_A_Gm14378
  gRNA
cuucagcuuucgccugcguc

SEQ ID NO: 20744 - RNA, 20 nt, Artificial Sequence
  MKO10020744_A_Gm14378
  gRNA
uccggguguaccgaccugcc

SEQ ID NO: 20745 - RNA, 20 nt, Artificial Sequence
  MKO10020745_A_Gm14378
  gRNA
uggcccguccuucaccgaga

SEQ ID NO: 20746 - RNA, 20 nt, Artificial Sequence
  MKO10020746_A_Gm14391
  gRNA
agucaccuaugaugacgugc

SEQ ID NO: 20747 - RNA, 20 nt, Artificial Sequence
  MKO10020747_A_Gm14391
  gRNA
uauagcugugagauuccuau

SEQ ID NO: 20748 - RNA, 20 nt, Artificial Sequence
  MKO10020748_A_Gm14391
  gRNA
acuggguuuagguuacauuu

SEQ ID NO: 20749 - RNA, 20 nt, Artificial Sequence
  MKO10020749_A_Gm14393
  gRNA
ucuggguuuagguuacauuu

SEQ ID NO: 20750 - RNA, 20 nt, Artificial Sequence
  MKO10020750_A_Gm14393
  gRNA
cgugcaugucaacuucacuc

SEQ ID NO: 20751 - RNA, 20 nt, Artificial Sequence
  MKO10020751_A_Gm14393
  gRNA
uauagcugugagauuccuau

SEQ ID NO: 20752 - RNA, 20 nt, Artificial Sequence
  MKO10020752_A_Gm14420
  gRNA
gcacaaagugguacucucca

SEQ ID NO: 20753 - RNA, 20 nt, Artificial Sequence
  MKO10020753_A_Gm14420
  gRNA
uauguguucgcucauguccu

SEQ ID NO: 20754 - RNA, 20 nt, Artificial Sequence
  MKO10020754_A_Gm14420
  gRNA
uauagcugugagauuccuau

SEQ ID NO: 20755 - RNA, 20 nt, Artificial Sequence
  MKO10020755_A_Gm14430
  gRNA
ucuguucuuagugucuucgc

SEQ ID NO: 20756 - RNA, 20 nt, Artificial Sequence
  MKO10020756_A_Gm14430
  gRNA
caagcucagaacuucacaca

SEQ ID NO: 20757 - RNA, 20 nt, Artificial Sequence
  MKO10020757_A_Gm14430
  gRNA
cgugcaugugaacuucacuc

SEQ ID NO: 20758 - RNA, 20 nt, Artificial Sequence
  MKO10020758_A_Gm14431
  gRNA
uguguuaugcgugacucuac

SEQ ID NO: 20759 - RNA, 20 nt, Artificial Sequence
  MKO10020759_A_Gm14431
  gRNA
caagcucagaacuccaaaca

SEQ ID NO: 20760 - RNA, 20 nt, Artificial Sequence
  MKO10020760_A_Gm14431
  gRNA
uauagcugugagauuccuau

SEQ ID NO: 20761 - RNA, 20 nt, Artificial Sequence
  MKO10020761_A_Gm14434
  gRNA
cgugcaugugaacuucacuc

SEQ ID NO: 20762 - RNA, 20 nt, Artificial Sequence
  MKO10020762_A_Gm14434
  gRNA
uauagcugugagauucuuau

SEQ ID NO: 20763 - RNA, 20 nt, Artificial Sequence
  MKO10020763_A_Gm14434
  gRNA
acuggguuuagguuacauuu

SEQ ID NO: 20764 - RNA, 20 nt, Artificial Sequence
  MKO10020764_A_Gm14436
  gRNA
uguguuaugcgugacucuac

SEQ ID NO: 20765 - RNA, 20 nt, Artificial Sequence
  MKO10020765_A_Gm14436
  gRNA
caagcucagaacuccaaaca

SEQ ID NO: 20766 - RNA, 20 nt, Artificial Sequence
  MKO10020766_A_Gm14436
  gRNA
uauagcugugagauuccuau

SEQ ID NO: 20767 - RNA, 20 nt, Artificial Sequence
  MKO10020767_A_Gm14440
  gRNA
cgugcaugugaacuucacuc

SEQ ID NO: 20768 - RNA, 20 nt, Artificial Sequence
  MKO10020768_A_Gm14440
  gRNA
uauagcugugagauuccuau

SEQ ID NO: 20769 - RNA, 20 nt, Artificial Sequence
  MKO10020769_A_Gm14440
  gRNA
uacuguguuuagguuacagu

SEQ ID NO: 20770 - RNA, 20 nt, Artificial Sequence
  MKO10020770_A_Gm14446
  gRNA
guuuguagacaaacccaagu

SEQ ID NO: 20771 - RNA, 20 nt, Artificial Sequence
  MKO10020771_A_Gm14446
  gRNA
agcagaccaauccauccauu

SEQ ID NO: 20772 - RNA, 20 nt, Artificial Sequence
  MKO10020772_A_Gm14446
  gRNA
aagccuuuaccucacguugc

SEQ ID NO: 20773 - RNA, 20 nt, Artificial Sequence
  MKO10020773_A_Gm14458
  gRNA
gaaugcagcagaacuaugac

SEQ ID NO: 20774 - RNA, 20 nt, Artificial Sequence
  MKO10020774_A_Gm14458
  gRNA
acaggcugagcuugucaaag

SEQ ID NO: 20775 - RNA, 20 nt, Artificial Sequence
  MKO10020775_A_Gm14458
  gRNA
ugaacaucucugcacugguc

SEQ ID NO: 20776 - RNA, 20 nt, Artificial Sequence
  MKO10020776_A_Gm14459
  gRNA
ggaucaggacaagcaaugcc

SEQ ID NO: 20777 - RNA, 20 nt, Artificial Sequence
  MKO10020777_A_Gm14459
  gRNA
auugaaguucaugacaguaa

SEQ ID NO: 20778 - RNA, 20 nt, Artificial Sequence
  MKO10020778_A_Gm14459
  gRNA
gaguaugauuccaacuuggc

SEQ ID NO: 20779 - RNA, 20 nt, Artificial Sequence
  MKO10020779_A_Gm14461
  gRNA
cagacagugcaucgccaguu

SEQ ID NO: 20780 - RNA, 20 nt, Artificial Sequence
  MKO10020780_A_Gm14461
  gRNA
uuguacaagcuucgucauuc

SEQ ID NO: 20781 - RNA, 20 nt, Artificial Sequence
  MKO10020781_A_Gm14461
  gRNA
aaugcaggguugaaccgaac

SEQ ID NO: 20782 - RNA, 20 nt, Artificial Sequence
  MKO10020782_A_Gm14474
  gRNA
ucauucacugaugugccacc

SEQ ID NO: 20783 - RNA, 20 nt, Artificial Sequence
  MKO10020783_A_Gm14474
  gRNA
ucauggccaagaaaaugcaa

SEQ ID NO: 20784 - RNA, 20 nt, Artificial Sequence
  MKO10020784_A_Gm14474
  gRNA
accaccagauguacauccuc

SEQ ID NO: 20785 - RNA, 20 nt, Artificial Sequence
  MKO10020785_A_Gm14475
  gRNA
ucauucacugaugugccacc

SEQ ID NO: 20786 - RNA, 20 nt, Artificial Sequence
  MKO10020786_A_Gm14475
  gRNA
ucauggccaagaaaaugcaa

SEQ ID NO: 20787 - RNA, 20 nt, Artificial Sequence
  MKO10020787_A_Gm14475
  gRNA
accaccagacguacauccuc

SEQ ID NO: 20788 - RNA, 20 nt, Artificial Sequence
  MKO10020788_A_Gm14476
  gRNA
ucauucacugaugugccacc

SEQ ID NO: 20789 - RNA, 20 nt, Artificial Sequence
  MKO10020789_A_Gm14476
  gRNA
ucauggccaagaaaaugcaa

SEQ ID NO: 20790 - RNA, 20 nt, Artificial Sequence
  MKO10020790_A_Gm14476
  gRNA
accaccagacguacauccuc

SEQ ID NO: 20791 - RNA, 20 nt, Artificial Sequence
  MKO10020791_A_Gm14477
  gRNA
ucauucacugaugugccacc

SEQ ID NO: 20792 - RNA, 20 nt, Artificial Sequence
  MKO10020792_A_Gm14477
  gRNA
ucauggccaagaaaaugcaa

SEQ ID NO: 20793 - RNA, 20 nt, Artificial Sequence
  MKO10020793_A_Gm14477
  gRNA
accaccagacguacauccuc

SEQ ID NO: 20794 - RNA, 20 nt, Artificial Sequence
  MKO10020794_A_Gm14478
  gRNA
ucauucacugaugugccacc

SEQ ID NO: 20795 - RNA, 20 nt, Artificial Sequence
  MKO10020795_A_Gm14478
  gRNA
ucauggccaagaaaaugcaa

SEQ ID NO: 20796 - RNA, 20 nt, Artificial Sequence
  MKO10020796_A_Gm14478
  gRNA
accaccagacguacauccuc

SEQ ID NO: 20797 - RNA, 20 nt, Artificial Sequence
  MKO10020797_A_Gm14479
  gRNA
ucauucacugaugugccacc

SEQ ID NO: 20798 - RNA, 20 nt, Artificial Sequence
  MKO10020798_A_Gm14479
  gRNA
ucauggccaagaaaaugcaa

SEQ ID NO: 20799 - RNA, 20 nt, Artificial Sequence
  MKO10020799_A_Gm14479
  gRNA
accaccagacguacauccuc

SEQ ID NO: 20800 - RNA, 20 nt, Artificial Sequence
  MKO10020800_A_Gm14482
  gRNA
ucauucacugaugugccacc

SEQ ID NO: 20801 - RNA, 20 nt, Artificial Sequence
  MKO10020801_A_Gm14482
  gRNA
ucauggccaagaaaaugcaa

SEQ ID NO: 20802 - RNA, 20 nt, Artificial Sequence
  MKO10020802_A_Gm14482
  gRNA
accaccagacguacauccuc

SEQ ID NO: 20803 - RNA, 20 nt, Artificial Sequence
  MKO10020803_A_Gm14483
  gRNA
ucauucacugaugugccacc

SEQ ID NO: 20804 - RNA, 20 nt, Artificial Sequence
  MKO10020804_A_Gm14483
  gRNA
ucauggccaagaaaaugcaa

SEQ ID NO: 20805 - RNA, 20 nt, Artificial Sequence
  MKO10020805_A_Gm14483
  gRNA
accaccagacguacauccuc

SEQ ID NO: 20806 - RNA, 20 nt, Artificial Sequence
  MKO10020806_A_Gm14484
  gRNA
ucauucacugaugugccacc

SEQ ID NO: 20807 - RNA, 20 nt, Artificial Sequence
  MKO10020807_A_Gm14484
  gRNA
ucauggccaagaaaaugcaa

SEQ ID NO: 20808 - RNA, 20 nt, Artificial Sequence
  MKO10020808_A_Gm14484
  gRNA
accaccagacguacauccuc

SEQ ID NO: 20809 - RNA, 20 nt, Artificial Sequence
  MKO10020809_A_Gm14496
  gRNA
ggacauggggcaaccuauca

SEQ ID NO: 20810 - RNA, 20 nt, Artificial Sequence
  MKO10020810_A_Gm14496
  gRNA
acauucagugaaaucucguu

SEQ ID NO: 20811 - RNA, 20 nt, Artificial Sequence
  MKO10020811_A_Gm14496
  gRNA
ucagaugauucaugucucau

SEQ ID NO: 20812 - RNA, 20 nt, Artificial Sequence
  MKO10020812_A_Gm14499
  gRNA
ucaucuccuucaaaaugucu

SEQ ID NO: 20813 - RNA, 20 nt, Artificial Sequence
  MKO10020813_A_Gm14499
  gRNA
caucagaaaccgaaaaugag

SEQ ID NO: 20814 - RNA, 20 nt, Artificial Sequence
  MKO10020814_A_Gm14499
  gRNA
ggugggcaggaacagccauu

SEQ ID NO: 20815 - RNA, 20 nt, Artificial Sequence
  MKO10020815_A_Gm14501
  gRNA
ucauucacugaugugccacc

SEQ ID NO: 20816 - RNA, 20 nt, Artificial Sequence
  MKO10020816_A_Gm14501
  gRNA
ucauggccaagaaaaugcaa

SEQ ID NO: 20817 - RNA, 20 nt, Artificial Sequence
  MKO10020817_A_Gm14501
  gRNA
accaccagacguacauccuc

SEQ ID NO: 20818 - RNA, 20 nt, Artificial Sequence
  MKO10020818_A_Gm14511
  gRNA
ccgaagcgcccucucgagug

SEQ ID NO: 20819 - RNA, 20 nt, Artificial Sequence
  MKO10020819_A_Gm14511
  gRNA
acaagcugagcuugucaaag

SEQ ID NO: 20820 - RNA, 20 nt, Artificial Sequence
  MKO10020820_A_Gm14511
  gRNA
gcaaaacugccuagaucagc

SEQ ID NO: 20821 - RNA, 20 nt, Artificial Sequence
  MKO10020821_A_Gm14525
  gRNA
auaguaaagaggccagcauu

SEQ ID NO: 20822 - RNA, 20 nt, Artificial Sequence
  MKO10020822_A_Gm14525
  gRNA
ucuucaucugcuucuacgug

SEQ ID NO: 20823 - RNA, 20 nt, Artificial Sequence
  MKO10020823_A_Gm14525
  gRNA
agaugaacaagacaguaugu

SEQ ID NO: 20824 - RNA, 20 nt, Artificial Sequence
  MKO10020824_A_Gm14548
  gRNA
gaaccugugauuguugugcc

SEQ ID NO: 20825 - RNA, 20 nt, Artificial Sequence
  MKO10020825_A_Gm14548
  gRNA
ugcauccaugagagcuucug

SEQ ID NO: 20826 - RNA, 20 nt, Artificial Sequence
  MKO10020826_A_Gm14548
  gRNA
cagaguacagccacacucug

SEQ ID NO: 20827 - RNA, 20 nt, Artificial Sequence
  MKO10020827_A_Gm14625
  gRNA
aguaauaaguaaccguccuu

SEQ ID NO: 20828 - RNA, 20 nt, Artificial Sequence
  MKO10020828_A_Gm14625
  gRNA
cugagugcuuaagagaaaaa

SEQ ID NO: 20829 - RNA, 20 nt, Artificial Sequence
  MKO10020829_A_Gm14625
  gRNA
agaaaacguaaguuucucag

SEQ ID NO: 20830 - RNA, 20 nt, Artificial Sequence
  MKO10020830_A_Gm14632
  gRNA
ucuucaucugcuucuacgug

SEQ ID NO: 20831 - RNA, 20 nt, Artificial Sequence
  MKO10020831_A_Gm14632
  gRNA
auaguaaagaggccagcauu

SEQ ID NO: 20832 - RNA, 20 nt, Artificial Sequence
  MKO10020832_A_Gm14632
  gRNA
agaugaacaagacaguaugu

SEQ ID NO: 20833 - RNA, 20 nt, Artificial Sequence
  MKO10020833_A_Gm14685
  gRNA
agccagguacauccaagcuc

SEQ ID NO: 20834 - RNA, 20 nt, Artificial Sequence
  MKO10020834_A_Gm14685
  gRNA
guaccuggcuuucucuuccc

SEQ ID NO: 20835 - RNA, 20 nt, Artificial Sequence
  MKO10020835_A_Gm14685
  gRNA
gacgaucccuucuaaggagu

SEQ ID NO: 20836 - RNA, 20 nt, Artificial Sequence
  MKO10020836_A_Gm14692
  gRNA
aucacugaucucgaucacca

SEQ ID NO: 20837 - RNA, 20 nt, Artificial Sequence
  MKO10020837_A_Gm14692
  gRNA
caauauagcagagcagcccg

SEQ ID NO: 20838 - RNA, 20 nt, Artificial Sequence
  MKO10020838_A_Gm14692
  gRNA
uagggaaucuguucagaaga

SEQ ID NO: 20839 - RNA, 20 nt, Artificial Sequence
  MKO10020839_A_Gm14725
  gRNA
cacucauguuaccuuagaua

SEQ ID NO: 20840 - RNA, 20 nt, Artificial Sequence
  MKO10020840_A_Gm14725
  gRNA
gcguucaggauguaucugca

SEQ ID NO: 20841 - RNA, 20 nt, Artificial Sequence
  MKO10020841_A_Gm14725
  gRNA
agaugaggaugaggaagaug

SEQ ID NO: 20842 - RNA, 20 nt, Artificial Sequence
  MKO10020842_A_Gm14743
  gRNA
cuucaugugcgaguucuuua

SEQ ID NO: 20843 - RNA, 20 nt, Artificial Sequence
  MKO10020843_A_Gm14743
  gRNA
cuuaaagaacucgcacauga

SEQ ID NO: 20844 - RNA, 20 nt, Artificial Sequence
  MKO10020844_A_Gm14743
  gRNA
uuucacgaacaaagagcucc

SEQ ID NO: 20845 - RNA, 20 nt, Artificial Sequence
  MKO10020845_A_Gm14744
  gRNA
ccuuuacauagcugcggaca

SEQ ID NO: 20846 - RNA, 20 nt, Artificial Sequence
  MKO10020846_A_Gm14744
  gRNA
auccagcacuuggcgcccac

SEQ ID NO: 20847 - RNA, 20 nt, Artificial Sequence
  MKO10020847_A_Gm14744
  gRNA
uaccugugggcgccaagugc

SEQ ID NO: 20848 - RNA, 20 nt, Artificial Sequence
  MKO10020848_A_Gm14781
  gRNA
aggacaaacccuuccuuugu

SEQ ID NO: 20849 - RNA, 20 nt, Artificial Sequence
  MKO10020849_A_Gm14781
  gRNA
aaugucuuccucagaagcag

SEQ ID NO: 20850 - RNA, 20 nt, Artificial Sequence
  MKO10020850_A_Gm14781
  gRNA
auugagguuucauaaccuuc

SEQ ID NO: 20851 - RNA, 20 nt, Artificial Sequence
  MKO10020851_A_Gm14819
  gRNA
ucuucaucugcuucuacgug

SEQ ID NO: 20852 - RNA, 20 nt, Artificial Sequence
  MKO10020852_A_Gm14819
  gRNA
auaguaaagaggccagcauu

SEQ ID NO: 20853 - RNA, 20 nt, Artificial Sequence
  MKO10020853_A_Gm14819
  gRNA
agaugaacaagacaguaugu

SEQ ID NO: 20854 - RNA, 20 nt, Artificial Sequence
  MKO10020854_A_Gm14850
  gRNA
caugaagagcagacccuucu

SEQ ID NO: 20855 - RNA, 20 nt, Artificial Sequence
  MKO10020855_A_Gm14850
  gRNA
ccucucugcccuuguccugc

SEQ ID NO: 20856 - RNA, 20 nt, Artificial Sequence
  MKO10020856_A_Gm14850
  gRNA
aguuaaaaaaagauuucugc

SEQ ID NO: 20857 - RNA, 20 nt, Artificial Sequence
  MKO10020857_A_Gm14851
  gRNA
cagcccaacgaagguuucug

SEQ ID NO: 20858 - RNA, 20 nt, Artificial Sequence
  MKO10020858_A_Gm14851
  gRNA
cuuugggcacugagggcaug

SEQ ID NO: 20859 - RNA, 20 nt, Artificial Sequence
  MKO10020859_A_Gm14851
  gRNA
ccucucugcccuugcccugc

SEQ ID NO: 20860 - RNA, 20 nt, Artificial Sequence
  MKO10020860_A_Gm14920
  gRNA
ugauauggugcccaucuucc

SEQ ID NO: 20861 - RNA, 20 nt, Artificial Sequence
  MKO10020861_A_Gm14920
  gRNA
ugagggagauuagccgugcc

SEQ ID NO: 20862 - RNA, 20 nt, Artificial Sequence
  MKO10020862_A_Gm14920
  gRNA
ccgcaagcuccagcaaccug

SEQ ID NO: 20863 - RNA, 20 nt, Artificial Sequence
  MKO10020863_A_Gm15023
  gRNA
aaaauauagguucauuauga

SEQ ID NO: 20864 - RNA, 20 nt, Artificial Sequence
  MKO10020864_A_Gm15023
  gRNA
cuuaccuaguagcugaguuc

SEQ ID NO: 20865 - RNA, 20 nt, Artificial Sequence
  MKO10020865_A_Gm15023
  gRNA
ccuacaggagcccuaaacug

SEQ ID NO: 20866 - RNA, 20 nt, Artificial Sequence
  MKO10020866_A_Gm15056
  gRNA
acaaaguguauucgcaugcc

SEQ ID NO: 20867 - RNA, 20 nt, Artificial Sequence
  MKO10020867_A_Gm15056
  gRNA
aacuccugaaggcuguaaac

SEQ ID NO: 20868 - RNA, 20 nt, Artificial Sequence
  MKO10020868_A_Gm15056
  gRNA
cauggacucacuguugauga

SEQ ID NO: 20869 - RNA, 20 nt, Artificial Sequence
  MKO10020869_A_Gm15070
  gRNA
aaggauuggacggccuaagu

SEQ ID NO: 20870 - RNA, 20 nt, Artificial Sequence
  MKO10020870_A_Gm15070
  gRNA
agauuccuuaccggaucucg

SEQ ID NO: 20871 - RNA, 20 nt, Artificial Sequence
  MKO10020871_A_Gm15070
  gRNA
guccaucuugccucgauuac

SEQ ID NO: 20872 - RNA, 20 nt, Artificial Sequence
  MKO10020872_A_Gm15080
  gRNA
ccucucccucgcagaugucc

SEQ ID NO: 20873 - RNA, 20 nt, Artificial Sequence
  MKO10020873_A_Gm15080
  gRNA
cacaucaaaaucaugcaguu

SEQ ID NO: 20874 - RNA, 20 nt, Artificial Sequence
  MKO10020874_A_Gm15080
  gRNA
uucugaagaagaauacaaug

SEQ ID NO: 20875 - RNA, 20 nt, Artificial Sequence
  MKO10020875_A_Gm15085
  gRNA
uguacuuuaccucucccucg

SEQ ID NO: 20876 - RNA, 20 nt, Artificial Sequence
  MKO10020876_A_Gm15085
  gRNA
uucugaagaagaauacaaug

SEQ ID NO: 20877 - RNA, 20 nt, Artificial Sequence
  MKO10020877_A_Gm15085
  gRNA
ucacuuaccagaugaaguag

SEQ ID NO: 20878 - RNA, 20 nt, Artificial Sequence
  MKO10020878_A_Gm15091
  gRNA
cggaacaaccagucaaaaag

SEQ ID NO: 20879 - RNA, 20 nt, Artificial Sequence
  MKO10020879_A_Gm15091
  gRNA
acggaaaaaugccugcccuc

SEQ ID NO: 20880 - RNA, 20 nt, Artificial Sequence
  MKO10020880_A_Gm15091
  gRNA
uucugaaaaagaauacaaug

SEQ ID NO: 20881 - RNA, 20 nt, Artificial Sequence
  MKO10020881_A_Gm15093
  gRNA
uguacuuuaccucucccucg

SEQ ID NO: 20882 - RNA, 20 nt, Artificial Sequence
  MKO10020882_A_Gm15093
  gRNA
uucugaagaagaauacaaug

SEQ ID NO: 20883 - RNA, 20 nt, Artificial Sequence
  MKO10020883_A_Gm15093
  gRNA
ucacuuaccagaugaaguag

SEQ ID NO: 20884 - RNA, 20 nt, Artificial Sequence
  MKO10020884_A_Gm15097
  gRNA
gaagaucacguaaucgauuu

SEQ ID NO: 20885 - RNA, 20 nt, Artificial Sequence
  MKO10020885_A_Gm15097
  gRNA
aaaucgauuacgugaucuuc

SEQ ID NO: 20886 - RNA, 20 nt, Artificial Sequence
  MKO10020886_A_Gm15097
  gRNA
uguacuuuaccucucccucg

SEQ ID NO: 20887 - RNA, 20 nt, Artificial Sequence
  MKO10020887_A_Gm15104
  gRNA
uugacucaucuguaucucgu

SEQ ID NO: 20888 - RNA, 20 nt, Artificial Sequence
  MKO10020888_A_Gm15104
  gRNA
agaacaaaaugcaguggcca

SEQ ID NO: 20889 - RNA, 20 nt, Artificial Sequence
  MKO10020889_A_Gm15104
  gRNA
ucaagaaaaagaaaugcguu

SEQ ID NO: 20890 - RNA, 20 nt, Artificial Sequence
  MKO10020890_A_Gm15107
  gRNA
uguacuuuaccucucccucg

SEQ ID NO: 20891 - RNA, 20 nt, Artificial Sequence
  MKO10020891_A_Gm15107
  gRNA
uucugaagaagaauacaaug

SEQ ID NO: 20892 - RNA, 20 nt, Artificial Sequence
  MKO10020892_A_Gm15107
  gRNA
ucacuuaccagaugaaguag

SEQ ID NO: 20893 - RNA, 20 nt, Artificial Sequence
  MKO10020893_A_Gm15114
  gRNA
gaucuuaaacagucauggag

SEQ ID NO: 20894 - RNA, 20 nt, Artificial Sequence
  MKO10020894_A_Gm15114
  gRNA
guuuaagaucucuccaugac

SEQ ID NO: 20895 - RNA, 20 nt, Artificial Sequence
  MKO10020895_A_Gm15114
  gRNA
uguacuuuaccucucccucg

SEQ ID NO: 20896 - RNA, 20 nt, Artificial Sequence
  MKO10020896_A_Gm15127
  gRNA
cggaacaaccagucacaaag

SEQ ID NO: 20897 - RNA, 20 nt, Artificial Sequence
  MKO10020897_A_Gm15127
  gRNA
ugucaugaccucuuugugac

SEQ ID NO: 20898 - RNA, 20 nt, Artificial Sequence
  MKO10020898_A_Gm15127
  gRNA
uguacuuuaccucucccucg

SEQ ID NO: 20899 - RNA, 20 nt, Artificial Sequence
  MKO10020899_A_Gm15140
  gRNA
ugacagcaauguugugcagu

SEQ ID NO: 20900 - RNA, 20 nt, Artificial Sequence
  MKO10020900_A_Gm15140
  gRNA
aucaacucaucguugauacu

SEQ ID NO: 20901 - RNA, 20 nt, Artificial Sequence
  MKO10020901_A_Gm15140
  gRNA
cuacagauuuaucaaugaga

SEQ ID NO: 20902 - RNA, 20 nt, Artificial Sequence
  MKO10020902_A_Gm1527
  gRNA
aucaauucaugaagccaaga

SEQ ID NO: 20903 - RNA, 20 nt, Artificial Sequence
  MKO10020903_A_Gm1527
  gRNA
gguggcccaaaaguguccau

SEQ ID NO: 20904 - RNA, 20 nt, Artificial Sequence
  MKO10020904_A_Gm1527
  gRNA
ucaucccacugcaucuccug

SEQ ID NO: 20905 - RNA, 20 nt, Artificial Sequence
  MKO10020905_A_Gm15284
  gRNA
cauuaaaugacccuuacugc

SEQ ID NO: 20906 - RNA, 20 nt, Artificial Sequence
  MKO10020906_A_Gm15284
  gRNA
ucuugaagagaagagccuuc

SEQ ID NO: 20907 - RNA, 20 nt, Artificial Sequence
  MKO10020907_A_Gm15284
  gRNA
ccucucugcccucguccugc

SEQ ID NO: 20908 - RNA, 20 nt, Artificial Sequence
  MKO10020908_A_Gm15292
  gRNA
auagccugcuccucuuccuc

SEQ ID NO: 20909 - RNA, 20 nt, Artificial Sequence
  MKO10020909_A_Gm15292
  gRNA
gcagccagaggaagaggagc

SEQ ID NO: 20910 - RNA, 20 nt, Artificial Sequence
  MKO10020910_A_Gm15292
  gRNA
cauuaaaugacccuuucugc

SEQ ID NO: 20911 - RNA, 20 nt, Artificial Sequence
  MKO10020911_A_Gm15293
  gRNA
aucuccucuggaggccaaga

SEQ ID NO: 20912 - RNA, 20 nt, Artificial Sequence
  MKO10020912_A_Gm15293
  gRNA
cagaggagauagacacagcc

SEQ ID NO: 20913 - RNA, 20 nt, Artificial Sequence
  MKO10020913_A_Gm15293
  gRNA
aguuaaaaaaagauuucugc

SEQ ID NO: 20914 - RNA, 20 nt, Artificial Sequence
  MKO10020914_A_Gm15299
  gRNA
aggaucagccuggacuuggg

SEQ ID NO: 20915 - RNA, 20 nt, Artificial Sequence
  MKO10020915_A_Gm15299
  gRNA
ucuugaagagaagagccuuc

SEQ ID NO: 20916 - RNA, 20 nt, Artificial Sequence
  MKO10020916_A_Gm15299
  gRNA
cauuaaaugacccuuucugc

SEQ ID NO: 20917 - RNA, 20 nt, Artificial Sequence
  MKO10020917_A_Gm15308
  gRNA
ucaugaagagcagauccuuc

SEQ ID NO: 20918 - RNA, 20 nt, Artificial Sequence
  MKO10020918_A_Gm15308
  gRNA
ccucucugcccucguccugc

SEQ ID NO: 20919 - RNA, 20 nt, Artificial Sequence
  MKO10020919_A_Gm15308
  gRNA
aucugcauguucaguggcgg

SEQ ID NO: 20920 - RNA, 20 nt, Artificial Sequence
  MKO10020920_A_Gm15315
  gRNA
caugaagagcagacccuucu

SEQ ID NO: 20921 - RNA, 20 nt, Artificial Sequence
  MKO10020921_A_Gm15315
  gRNA
ccucucugcccuuguccugc

SEQ ID NO: 20922 - RNA, 20 nt, Artificial Sequence
  MKO10020922_A_Gm15315
  gRNA
aguuaaaaaaagauuucugc

SEQ ID NO: 20923 - RNA, 20 nt, Artificial Sequence
  MKO10020923_A_Gm15319
  gRNA
ucagagagagaagaagugcc

SEQ ID NO: 20924 - RNA, 20 nt, Artificial Sequence
  MKO10020924_A_Gm15319
  gRNA
ugcccacaaccauccagacg

SEQ ID NO: 20925 - RNA, 20 nt, Artificial Sequence
  MKO10020925_A_Gm15319
  gRNA
ccaauagcuaccuuaaucaa

SEQ ID NO: 20926 - RNA, 20 nt, Artificial Sequence
  MKO10020926_A_Gm15386
  gRNA
aaauccaagcuaccauacuc

SEQ ID NO: 20927 - RNA, 20 nt, Artificial Sequence
  MKO10020927_A_Gm15386
  gRNA
aaagaaugcaaaaugcguag

SEQ ID NO: 20928 - RNA, 20 nt, Artificial Sequence
  MKO10020928_A_Gm15386
  gRNA
cauauuaccuguuaauauug

SEQ ID NO: 20929 - RNA, 20 nt, Artificial Sequence
  MKO10020929_A_Gm15455
  gRNA
ccucccgugcuuugacucca

SEQ ID NO: 20930 - RNA, 20 nt, Artificial Sequence
  MKO10020930_A_Gm15455
  gRNA
gggacuggaagccgguggua

SEQ ID NO: 20931 - RNA, 20 nt, Artificial Sequence
  MKO10020931_A_Gm15455
  gRNA
cuuagcucccgccuacccag

SEQ ID NO: 20932 - RNA, 20 nt, Artificial Sequence
  MKO10020932_A_Gm1553
  gRNA
cauuaucaguagacguguau

SEQ ID NO: 20933 - RNA, 20 nt, Artificial Sequence
  MKO10020933_A_Gm1553
  gRNA
acaggugaacgucuaccaau

SEQ ID NO: 20934 - RNA, 20 nt, Artificial Sequence
  MKO10020934_A_Gm1553
  gRNA
uuacuaaacauaaugggccu

SEQ ID NO: 20935 - RNA, 20 nt, Artificial Sequence
  MKO10020935_A_Gm1564
  gRNA
cguuccguggaagcgcgaau

SEQ ID NO: 20936 - RNA, 20 nt, Artificial Sequence
  MKO10020936_A_Gm1564
  gRNA
uagccgugugaaucgcacac

SEQ ID NO: 20937 - RNA, 20 nt, Artificial Sequence
  MKO10020937_A_Gm1564
  gRNA
agcaccgauucgcgcuucca

SEQ ID NO: 20938 - RNA, 20 nt, Artificial Sequence
  MKO10020938_A_Gm156
  gRNA
aucacaacacuuaugcgcca

SEQ ID NO: 20939 - RNA, 20 nt, Artificial Sequence
  MKO10020939_A_Gm156
  gRNA
aaaggcugcuauacauguca

SEQ ID NO: 20940 - RNA, 20 nt, Artificial Sequence
  MKO10020940_A_Gm156
  gRNA
cacaagugaauuacagcuau

SEQ ID NO: 20941 - RNA, 20 nt, Artificial Sequence
  MKO10020941_A_Gm15800
  gRNA
gaugugucggccuguguccg

SEQ ID NO: 20942 - RNA, 20 nt, Artificial Sequence
  MKO10020942_A_Gm15800
  gRNA
cauucaggcgguauuccagc

SEQ ID NO: 20943 - RNA, 20 nt, Artificial Sequence
  MKO10020943_A_Gm15800
  gRNA
guacagguaaugcccaucug

SEQ ID NO: 20944 - RNA, 20 nt, Artificial Sequence
  MKO10020944_A_Gm15816
  gRNA
aaugucgguggggcuuggac

SEQ ID NO: 20945 - RNA, 20 nt, Artificial Sequence
  MKO10020945_A_Gm15816
  gRNA
agaucauucgcaaagucguc

SEQ ID NO: 20946 - RNA, 20 nt, Artificial Sequence
  MKO10020946_A_Gm15816
  gRNA
uguuggcugagacuuuaucc

SEQ ID NO: 20947 - RNA, 20 nt, Artificial Sequence
  MKO10020947_A_Gm1587
  gRNA
cuacagccgagaagaacaug

SEQ ID NO: 20948 - RNA, 20 nt, Artificial Sequence
  MKO10020948_A_Gm1587
  gRNA
gugaccaagugcugaagcuu

SEQ ID NO: 20949 - RNA, 20 nt, Artificial Sequence
  MKO10020949_A_Gm1587
  gRNA
ucaacaugcagaccccaccu

SEQ ID NO: 20950 - RNA, 20 nt, Artificial Sequence
  MKO10020950_A_Gm15881
  gRNA
agcuugaauccauuacucga

SEQ ID NO: 20951 - RNA, 20 nt, Artificial Sequence
  MKO10020951_A_Gm15881
  gRNA
cgccaugacacugaucgucc

SEQ ID NO: 20952 - RNA, 20 nt, Artificial Sequence
  MKO10020952_A_Gm15881
  gRNA
gcacccauauagagcacuag

SEQ ID NO: 20953 - RNA, 20 nt, Artificial Sequence
  MKO10020953_A_Gm1604b
  gRNA
cgugcucaccucugucucca

SEQ ID NO: 20954 - RNA, 20 nt, Artificial Sequence
  MKO10020954_A_Gm1604b
  gRNA
aaugcccaucgcacaguugc

SEQ ID NO: 20955 - RNA, 20 nt, Artificial Sequence
  MKO10020955_A_Gm1604b
  gRNA
acuucuucugugguaucuuc

SEQ ID NO: 20956 - RNA, 20 nt, Artificial Sequence
  MKO10020956_A_Gm16130
  gRNA
ccucgccguccguacaaccc

SEQ ID NO: 20957 - RNA, 20 nt, Artificial Sequence
  MKO10020957_A_Gm16130
  gRNA
ucacuagggaugcgacguga

SEQ ID NO: 20958 - RNA, 20 nt, Artificial Sequence
  MKO10020958_A_Gm16130
  gRNA
gaagcuacugcugaacgaac

SEQ ID NO: 20959 - RNA, 20 nt, Artificial Sequence
  MKO10020959_A_Gm16367
  gRNA
ggacuuggaaauugcuuacc

SEQ ID NO: 20960 - RNA, 20 nt, Artificial Sequence
  MKO10020960_A_Gm16367
  gRNA
cccacccacacuccagaagc

SEQ ID NO: 20961 - RNA, 20 nt, Artificial Sequence
  MKO10020961_A_Gm16367
  gRNA
cuuguauaacugaguauuca

SEQ ID NO: 20962 - RNA, 20 nt, Artificial Sequence
  MKO10020962_A_Gm16381
  gRNA
uccagccacaaugauugagg

SEQ ID NO: 20963 - RNA, 20 nt, Artificial Sequence
  MKO10020963_A_Gm16381
  gRNA
ucuacugguaauaaagcucc

SEQ ID NO: 20964 - RNA, 20 nt, Artificial Sequence
  MKO10020964_A_Gm16381
  gRNA
ugcaacaccgaugauaccau

SEQ ID NO: 20965 - RNA, 20 nt, Artificial Sequence
  MKO10020965_A_Gm16390
  gRNA
ggauaugcagcaaaguagcc

SEQ ID NO: 20966 - RNA, 20 nt, Artificial Sequence
  MKO10020966_A_Gm16390
  gRNA
uccccgaauauacaaaggaa

SEQ ID NO: 20967 - RNA, 20 nt, Artificial Sequence
  MKO10020967_A_Gm16390
  gRNA
cuacuuugcugcauauccac

SEQ ID NO: 20968 - RNA, 20 nt, Artificial Sequence
  MKO10020968_A_Gm16404
  gRNA
aguaauaaguaaccguccuu

SEQ ID NO: 20969 - RNA, 20 nt, Artificial Sequence
  MKO10020969_A_Gm16404
  gRNA
cugagugcuuaagagaaaaa

SEQ ID NO: 20970 - RNA, 20 nt, Artificial Sequence
  MKO10020970_A_Gm16404
  gRNA
agaaaacguaaguuucucag

SEQ ID NO: 20971 - RNA, 20 nt, Artificial Sequence
  MKO10020971_A_Gm16405
  gRNA
agaaaacguaaguuucucag

SEQ ID NO: 20972 - RNA, 20 nt, Artificial Sequence
  MKO10020972_A_Gm16405
  gRNA
uagagacaccaauagaaaac

SEQ ID NO: 20973 - RNA, 20 nt, Artificial Sequence
  MKO10020973_A_Gm16405
  gRNA
guaucuccaacgauuucuuc

SEQ ID NO: 20974 - RNA, 20 nt, Artificial Sequence
  MKO10020974_A_Gm16430
  gRNA
agaaaacguaaguuucucag

SEQ ID NO: 20975 - RNA, 20 nt, Artificial Sequence
  MKO10020975_A_Gm16430
  gRNA
uagagacaccaauagaaaac

SEQ ID NO: 20976 - RNA, 20 nt, Artificial Sequence
  MKO10020976_A_Gm16430
  gRNA
guaucuccaacgauuucuuc

SEQ ID NO: 20977 - RNA, 20 nt, Artificial Sequence
  MKO10020977_A_Gm16432
  gRNA
cuuacuugguuucuggcaau

SEQ ID NO: 20978 - RNA, 20 nt, Artificial Sequence
  MKO10020978_A_Gm16432
  gRNA
agaacuccugguacuaaaaa

SEQ ID NO: 20979 - RNA, 20 nt, Artificial Sequence
  MKO10020979_A_Gm16432
  gRNA
uagauuaaauuagaguauga

SEQ ID NO: 20980 - RNA, 20 nt, Artificial Sequence
  MKO10020980_A_Gm16442
  gRNA
gcccucuccaugucugcuca

SEQ ID NO: 20981 - RNA, 20 nt, Artificial Sequence
  MKO10020981_A_Gm16442
  gRNA
caguugaagagcacagaaca

SEQ ID NO: 20982 - RNA, 20 nt, Artificial Sequence
  MKO10020982_A_Gm16442
  gRNA
uguccaucaguuugucacuc

SEQ ID NO: 20983 - RNA, 20 nt, Artificial Sequence
  MKO10020983_A_Gm16445
  gRNA
aacucgucguugauacucug

SEQ ID NO: 20984 - RNA, 20 nt, Artificial Sequence
  MKO10020984_A_Gm16445
  gRNA
uaaaggugauucaacuccuu

SEQ ID NO: 20985 - RNA, 20 nt, Artificial Sequence
  MKO10020985_A_Gm16445
  gRNA
ugaaagcuaauaagcugcua

SEQ ID NO: 20986 - RNA, 20 nt, Artificial Sequence
  MKO10020986_A_Gm16451
  gRNA
gcccucuccaugucugcuca

SEQ ID NO: 20987 - RNA, 20 nt, Artificial Sequence
  MKO10020987_A_Gm16451
  gRNA
caguugaagagcacagaaca

SEQ ID NO: 20988 - RNA, 20 nt, Artificial Sequence
  MKO10020988_A_Gm16451
  gRNA
uguccaucaguuugucacuc

SEQ ID NO: 20989 - RNA, 20 nt, Artificial Sequence
  MKO10020989_A_Gm1647
  gRNA
gucacgacugcagaugcuac

SEQ ID NO: 20990 - RNA, 20 nt, Artificial Sequence
  MKO10020990_A_Gm1647
  gRNA
cuggguuagaacugucgcug

SEQ ID NO: 20991 - RNA, 20 nt, Artificial Sequence
  MKO10020991_A_Gm1647
  gRNA
gaagucugaacagcccauga

SEQ ID NO: 20992 - RNA, 20 nt, Artificial Sequence
  MKO10020992_A_Gm16501
  gRNA
aggcaucaucaguugucuuc

SEQ ID NO: 20993 - RNA, 20 nt, Artificial Sequence
  MKO10020993_A_Gm16501
  gRNA
ucauggccaggaaaagccaa

SEQ ID NO: 20994 - RNA, 20 nt, Artificial Sequence
  MKO10020994_A_Gm16501
  gRNA
aaauugaagcucagcucucu

SEQ ID NO: 20995 - RNA, 20 nt, Artificial Sequence
  MKO10020995_A_Gm16515
  gRNA
guuggcggucgugcuccacg

SEQ ID NO: 20996 - RNA, 20 nt, Artificial Sequence
  MKO10020996_A_Gm16515
  gRNA
cgcuaccccgccgagcgcac

SEQ ID NO: 20997 - RNA, 20 nt, Artificial Sequence
  MKO10020997_A_Gm16515
  gRNA
ccagaugcuuaccgugggcg

SEQ ID NO: 20998 - RNA, 20 nt, Artificial Sequence
  MKO10020998_A_Gm16532
  gRNA
acagcaaacaaccaucgugu

SEQ ID NO: 20999 - RNA, 20 nt, Artificial Sequence
  MKO10020999_A_Gm16532
  gRNA
cacacacacuaccaacacga

SEQ ID NO: 21000 - RNA, 20 nt, Artificial Sequence
  MKO10021000_A_Gm16532
  gRNA
gaucuguccucccaagagac

SEQ ID NO: 21001 - RNA, 20 nt, Artificial Sequence
  MKO10021001_A_Gm1661
  gRNA
cacugccgcagcuauaugac

SEQ ID NO: 21002 - RNA, 20 nt, Artificial Sequence
  MKO10021002_A_Gm1661
  gRNA
uccucauacgagugaccacc

SEQ ID NO: 21003 - RNA, 20 nt, Artificial Sequence
  MKO10021003_A_Gm1661
  gRNA
caaguauuuccaagagcguu

SEQ ID NO: 21004 - RNA, 20 nt, Artificial Sequence
  MKO10021004_A_Gm166
  gRNA
cauuccuccacguugcccag

SEQ ID NO: 21005 - RNA, 20 nt, Artificial Sequence
  MKO10021005_A_Gm166
  gRNA
ccaagauaauggcaucccgc

SEQ ID NO: 21006 - RNA, 20 nt, Artificial Sequence
  MKO10021006_A_Gm166
  gRNA
ggcggcagaagauaagugcg

SEQ ID NO: 21007 - RNA, 20 nt, Artificial Sequence
  MKO10021007_A_Gm1673
  gRNA
aacaagcagcgcgggcgacu

SEQ ID NO: 21008 - RNA, 20 nt, Artificial Sequence
  MKO10021008_A_Gm1673
  gRNA
auucaugcagcgcgcccuuc

SEQ ID NO: 21009 - RNA, 20 nt, Artificial Sequence
  MKO10021009_A_Gm1673
  gRNA
ucgcccgcgcugcuuguucg

SEQ ID NO: 21010 - RNA, 20 nt, Artificial Sequence
  MKO10021010_A_Gm17019
  gRNA
ccugaguguaaaagacgaac

SEQ ID NO: 21011 - RNA, 20 nt, Artificial Sequence
  MKO10021011_A_Gm17019
  gRNA
aagcaagaagcaguuugaga

SEQ ID NO: 21012 - RNA, 20 nt, Artificial Sequence
  MKO10021012_A_Gm17019
  gRNA
caauguauaccucuuguuca

SEQ ID NO: 21013 - RNA, 20 nt, Artificial Sequence
  MKO10021013_A_Gm17252
  gRNA
uuacguuuguuagcaucacc

SEQ ID NO: 21014 - RNA, 20 nt, Artificial Sequence
  MKO10021014_A_Gm17252
  gRNA
gcaucugaaguccaccagau

SEQ ID NO: 21015 - RNA, 20 nt, Artificial Sequence
  MKO10021015_A_Gm17252
  gRNA
cuucaggggaugguaccaua

SEQ ID NO: 21016 - RNA, 20 nt, Artificial Sequence
  MKO10021016_A_Gm17296
  gRNA
ucuuagguccgagccuauuc

SEQ ID NO: 21017 - RNA, 20 nt, Artificial Sequence
  MKO10021017_A_Gm17296
  gRNA
cgucauacagcuccaagaag

SEQ ID NO: 21018 - RNA, 20 nt, Artificial Sequence
  MKO10021018_A_Gm17296
  gRNA
guuuauuacuggcccgcuga

SEQ ID NO: 21019 - RNA, 20 nt, Artificial Sequence
  MKO10021019_A_Gm17359
  gRNA
cgaacuaagucuccgcgcga

SEQ ID NO: 21020 - RNA, 20 nt, Artificial Sequence
  MKO10021020_A_Gm17359
  gRNA
caccagcauaccgccuauau

SEQ ID NO: 21021 - RNA, 20 nt, Artificial Sequence
  MKO10021021_A_Gm17359
  gRNA
cccaccgcuaucaaaaccca

SEQ ID NO: 21022 - RNA, 20 nt, Artificial Sequence
  MKO10021022_A_Gm17365
  gRNA
cucucuccaguuaucauaca

SEQ ID NO: 21023 - RNA, 20 nt, Artificial Sequence
  MKO10021023_A_Gm17365
  gRNA
gacacaccauguaugauaac

SEQ ID NO: 21024 - RNA, 20 nt, Artificial Sequence
  MKO10021024_A_Gm17365
  gRNA
augaaauaugcaugagcuug

SEQ ID NO: 21025 - RNA, 20 nt, Artificial Sequence
  MKO10021025_A_Gm17384
  gRNA
aguccaucucuccgaaaacc

SEQ ID NO: 21026 - RNA, 20 nt, Artificial Sequence
  MKO10021026_A_Gm17384
  gRNA
aaccacuguaggacgugcaa

SEQ ID NO: 21027 - RNA, 20 nt, Artificial Sequence
  MKO10021027_A_Gm17384
  gRNA
accuuuaauuguacaagcac

SEQ ID NO: 21028 - RNA, 20 nt, Artificial Sequence
  MKO10021028_A_Gm17455
  gRNA
agggcgaugaggaucgguac

SEQ ID NO: 21029 - RNA, 20 nt, Artificial Sequence
  MKO10021029_A_Gm17455
  gRNA
uguaccgauccucaucgccc

SEQ ID NO: 21030 - RNA, 20 nt, Artificial Sequence
  MKO10021030_A_Gm17455
  gRNA
ugcauucccgggccccucgg

SEQ ID NO: 21031 - RNA, 20 nt, Artificial Sequence
  MKO10021031_A_Gm17660
  gRNA
ucugacaccuaaucagcuuc

SEQ ID NO: 21032 - RNA, 20 nt, Artificial Sequence
  MKO10021032_A_Gm17660
  gRNA
cccuccguuuccccuuccgc

SEQ ID NO: 21033 - RNA, 20 nt, Artificial Sequence
  MKO10021033_A_Gm17660
  gRNA
cauaccugauuuggaucaaa

SEQ ID NO: 21034 - RNA, 20 nt, Artificial Sequence
  MKO10021034_A_Gm17677
  gRNA
uggaguauguacgcuucauc

SEQ ID NO: 21035 - RNA, 20 nt, Artificial Sequence
  MKO10021035_A_Gm17677
  gRNA
gacccccaaguuucuuguac

SEQ ID NO: 21036 - RNA, 20 nt, Artificial Sequence
  MKO10021036_A_Gm17677
  gRNA
uuguacaaaaucaguacucc

SEQ ID NO: 21037 - RNA, 20 nt, Artificial Sequence
  MKO10021037_A_Gm17689
  gRNA
gagaccagaagugucucuua

SEQ ID NO: 21038 - RNA, 20 nt, Artificial Sequence
  MKO10021038_A_Gm17689
  gRNA
cuguccauaagagacacuuc

SEQ ID NO: 21039 - RNA, 20 nt, Artificial Sequence
  MKO10021039_A_Gm17689
  gRNA
uaccucuugauacuccugcu

SEQ ID NO: 21040 - RNA, 20 nt, Artificial Sequence
  MKO10021040_A_Gm17727
  gRNA
auccucaaugggaaaaguac

SEQ ID NO: 21041 - RNA, 20 nt, Artificial Sequence
  MKO10021041_A_Gm17727
  gRNA
cugcuacucuguaugcaaac

SEQ ID NO: 21042 - RNA, 20 nt, Artificial Sequence
  MKO10021042_A_Gm17727
  gRNA
uugcugugccaagugaugaa

SEQ ID NO: 21043 - RNA, 20 nt, Artificial Sequence
  MKO10021043_A_Gm19345
  gRNA
caguauaccgucaaguucag

SEQ ID NO: 21044 - RNA, 20 nt, Artificial Sequence
  MKO10021044_A_Gm19345
  gRNA
auggccggcauccgugcugc

SEQ ID NO: 21045 - RNA, 20 nt, Artificial Sequence
  MKO10021045_A_Gm19345
  gRNA
ggcaggugccuaccagugcg

SEQ ID NO: 21046 - RNA, 20 nt, Artificial Sequence
  MKO10021046_A_Gm19402
  gRNA
agacccgccugucauagcuu

SEQ ID NO: 21047 - RNA, 20 nt, Artificial Sequence
  MKO10021047_A_Gm19402
  gRNA
ccagugaccuaagcuaugac

SEQ ID NO: 21048 - RNA, 20 nt, Artificial Sequence
  MKO10021048_A_Gm19402
  gRNA
aguacaagaaucacaggaac

SEQ ID NO: 21049 - RNA, 20 nt, Artificial Sequence
  MKO10021049_A_Gm1965
  gRNA
guguugcugugcccaauaua

SEQ ID NO: 21050 - RNA, 20 nt, Artificial Sequence
  MKO10021050_A_Gm1965
  gRNA
gcguugggugccacggcauc

SEQ ID NO: 21051 - RNA, 20 nt, Artificial Sequence
  MKO10021051_A_Gm1965
  gRNA
gaccugccuggaccauauau

SEQ ID NO: 21052 - RNA, 20 nt, Artificial Sequence
  MKO10021052_A_Gm19668
  gRNA
auggcaggcagacaauuguc

SEQ ID NO: 21053 - RNA, 20 nt, Artificial Sequence
  MKO10021053_A_Gm19668
  gRNA
ugcuccaguaauuugaguug

SEQ ID NO: 21054 - RNA, 20 nt, Artificial Sequence
  MKO10021054_A_Gm19668
  gRNA
cacgcaaguccuugugcagc

SEQ ID NO: 21055 - RNA, 20 nt, Artificial Sequence
  MKO10021055_A_Gm1966
  gRNA
auucagccugccauaauuuc

SEQ ID NO: 21056 - RNA, 20 nt, Artificial Sequence
  MKO10021056_A_Gm1966
  gRNA
uacuuacggcuuggaguuga

SEQ ID NO: 21057 - RNA, 20 nt, Artificial Sequence
  MKO10021057_A_Gm1966
  gRNA
acgagccucaguccagacgc

SEQ ID NO: 21058 - RNA, 20 nt, Artificial Sequence
  MKO10021058_A_Gm1979
  gRNA
ugaauuagagaugaagaaca

SEQ ID NO: 21059 - RNA, 20 nt, Artificial Sequence
  MKO10021059_A_Gm1979
  gRNA
aagcaaaaagcaguuugaga

SEQ ID NO: 21060 - RNA, 20 nt, Artificial Sequence
  MKO10021060_A_Gm1979
  gRNA
caauguauaccucuuguuca

SEQ ID NO: 21061 - RNA, 20 nt, Artificial Sequence
  MKO10021061_A_Gm1987
  gRNA
uaccuugcaggcagugaugg

SEQ ID NO: 21062 - RNA, 20 nt, Artificial Sequence
  MKO10021062_A_Gm1987
  gRNA
agcgcacucacaggauugcc

SEQ ID NO: 21063 - RNA, 20 nt, Artificial Sequence
  MKO10021063_A_Gm1987
  gRNA
caacccucagguucucaccc

SEQ ID NO: 21064 - RNA, 20 nt, Artificial Sequence
  MKO10021064_A_Gm1993
  gRNA
uaaguggugaucagcaaguu

SEQ ID NO: 21065 - RNA, 20 nt, Artificial Sequence
  MKO10021065_A_Gm1993
  gRNA
auaguaaagaggccagcauu

SEQ ID NO: 21066 - RNA, 20 nt, Artificial Sequence
  MKO10021066_A_Gm1993
  gRNA
ucuucaucugcuucuacgug

SEQ ID NO: 21067 - RNA, 20 nt, Artificial Sequence
  MKO10021067_A_Gm2002
  gRNA
guggagacaucuguccucaa

SEQ ID NO: 21068 - RNA, 20 nt, Artificial Sequence
  MKO10021068_A_Gm2002
  gRNA
uucugacccuaagugaucac

SEQ ID NO: 21069 - RNA, 20 nt, Artificial Sequence
  MKO10021069_A_Gm2002
  gRNA
cagaugagcagcagcugcuc

SEQ ID NO: 21070 - RNA, 20 nt, Artificial Sequence
  MKO10021070_A_Gm2012
  gRNA
acguaaguuucucagaaaaa

SEQ ID NO: 21071 - RNA, 20 nt, Artificial Sequence
  MKO10021071_A_Gm2012
  gRNA
auaguaaagaggccagcauu

SEQ ID NO: 21072 - RNA, 20 nt, Artificial Sequence
  MKO10021072_A_Gm2012
  gRNA
ucuucaucugcuucuacgug

SEQ ID NO: 21073 - RNA, 20 nt, Artificial Sequence
  MKO10021073_A_Gm2016
  gRNA
uguguccauuucauugauuu

SEQ ID NO: 21074 - RNA, 20 nt, Artificial Sequence
  MKO10021074_A_Gm2016
  gRNA
uccaucaugccaaagaauaa

SEQ ID NO: 21075 - RNA, 20 nt, Artificial Sequence
  MKO10021075_A_Gm2016
  gRNA
acaugccaaaaucaaugaaa

SEQ ID NO: 21076 - RNA, 20 nt, Artificial Sequence
  MKO10021076_A_Gm20172
  gRNA
gcucucuaaaaccccccuug

SEQ ID NO: 21077 - RNA, 20 nt, Artificial Sequence
  MKO10021077_A_Gm20172
  gRNA
aaaauaugaacgaguccuca

SEQ ID NO: 21078 - RNA, 20 nt, Artificial Sequence
  MKO10021078_A_Gm20172
  gRNA
guaucuuaaagcuacccaua

SEQ ID NO: 21079 - RNA, 20 nt, Artificial Sequence
  MKO10021079_A_Gm2022
  gRNA
ugccaggaaguauugaacag

SEQ ID NO: 21080 - RNA, 20 nt, Artificial Sequence
  MKO10021080_A_Gm2022
  gRNA
uaccacuguucaauacuucc

SEQ ID NO: 21081 - RNA, 20 nt, Artificial Sequence
  MKO10021081_A_Gm2022
  gRNA
gccuucaucuugggagacaa

SEQ ID NO: 21082 - RNA, 20 nt, Artificial Sequence
  MKO10021082_A_Gm2030
  gRNA
auaguaaagaggccagcauu

SEQ ID NO: 21083 - RNA, 20 nt, Artificial Sequence
  MKO10021083_A_Gm2030
  gRNA
ucuucaccugcuucuacgug

SEQ ID NO: 21084 - RNA, 20 nt, Artificial Sequence
  MKO10021084_A_Gm2030
  gRNA
agaugaacaagacagcaugu

SEQ ID NO: 21085 - RNA, 20 nt, Artificial Sequence
  MKO10021085_A_Gm2042
  gRNA
uacuuaccugaucuggacaa

SEQ ID NO: 21086 - RNA, 20 nt, Artificial Sequence
  MKO10021086_A_Gm2042
  gRNA
cugucuccauuguccagauc

SEQ ID NO: 21087 - RNA, 20 nt, Artificial Sequence
  MKO10021087_A_Gm2042
  gRNA
gcauagccuucaaagucucc

SEQ ID NO: 21088 - RNA, 20 nt, Artificial Sequence
  MKO10021088_A_Gm20594
  gRNA
ugccuauguacagaaaacca

SEQ ID NO: 21089 - RNA, 20 nt, Artificial Sequence
  MKO10021089_A_Gm20594
  gRNA
cuagcaugaauggcuaaagg

SEQ ID NO: 21090 - RNA, 20 nt, Artificial Sequence
  MKO10021090_A_Gm20594
  gRNA
uaauaagacgagaagacccu

SEQ ID NO: 21091 - RNA, 20 nt, Artificial Sequence
  MKO10021091_A_Gm20604
  gRNA
gcgaguacgucgguugugac

SEQ ID NO: 21092 - RNA, 20 nt, Artificial Sequence
  MKO10021092_A_Gm20604
  gRNA
gcggcuacgaguguccugug

SEQ ID NO: 21093 - RNA, 20 nt, Artificial Sequence
  MKO10021093_A_Gm20604
  gRNA
cucgucucuuuaacacgcag

SEQ ID NO: 21094 - RNA, 20 nt, Artificial Sequence
  MKO10021094_A_Gm20736
  gRNA
ucuucaucugcuucugcuug

SEQ ID NO: 21095 - RNA, 20 nt, Artificial Sequence
  MKO10021095_A_Gm20736
  gRNA
agcagaagcagaugaagaua

SEQ ID NO: 21096 - RNA, 20 nt, Artificial Sequence
  MKO10021096_A_Gm20736
  gRNA
agaugaaguagacaguaugu

SEQ ID NO: 21097 - RNA, 20 nt, Artificial Sequence
  MKO10021097_A_Gm20738
  gRNA
guucucguagagaagagucu

SEQ ID NO: 21098 - RNA, 20 nt, Artificial Sequence
  MKO10021098_A_Gm20738
  gRNA
guaaugagccugucacccau

SEQ ID NO: 21099 - RNA, 20 nt, Artificial Sequence
  MKO10021099_A_Gm20738
  gRNA
ugaguucacuaucuucacag

SEQ ID NO: 21100 - RNA, 20 nt, Artificial Sequence
  MKO10021100_A_Gm20747
  gRNA
guucucguagagaagagucu

SEQ ID NO: 21101 - RNA, 20 nt, Artificial Sequence
  MKO10021101_A_Gm20747
  gRNA
uaaaaauaguccuguaagaa

SEQ ID NO: 21102 - RNA, 20 nt, Artificial Sequence
  MKO10021102_A_Gm20747
  gRNA
guaaugagccugucacccau

SEQ ID NO: 21103 - RNA, 20 nt, Artificial Sequence
  MKO10021103_A_Gm20765
  gRNA
aaucagguaccuuggauaca

SEQ ID NO: 21104 - RNA, 20 nt, Artificial Sequence
  MKO10021104_A_Gm20765
  gRNA
cagcuacucuuugcugaauu

SEQ ID NO: 21105 - RNA, 20 nt, Artificial Sequence
  MKO10021105_A_Gm20765
  gRNA
uguucagucgaagcugugaa

SEQ ID NO: 21106 - RNA, 20 nt, Artificial Sequence
  MKO10021106_A_Gm20767
  gRNA
acaugcacugcccaaugcac

SEQ ID NO: 21107 - RNA, 20 nt, Artificial Sequence
  MKO10021107_A_Gm20767
  gRNA
ggcuggcaagaccugugcau

SEQ ID NO: 21108 - RNA, 20 nt, Artificial Sequence
  MKO10021108_A_Gm20767
  gRNA
ucuugccagcccugaguaca

SEQ ID NO: 21109 - RNA, 20 nt, Artificial Sequence
  MKO10021109_A_Gm20806
  gRNA
ggaauucauauauaugauag

SEQ ID NO: 21110 - RNA, 20 nt, Artificial Sequence
  MKO10021110_A_Gm20806
  gRNA
gacggaauugacagugucua

SEQ ID NO: 21111 - RNA, 20 nt, Artificial Sequence
  MKO10021111_A_Gm20806
  gRNA
uaaaaauaguccuguaagaa

SEQ ID NO: 21112 - RNA, 20 nt, Artificial Sequence
  MKO10021112_A_Gm20809
  gRNA
ggaauucauauauaugacag

SEQ ID NO: 21113 - RNA, 20 nt, Artificial Sequence
  MKO10021113_A_Gm20809
  gRNA
uaaaaauaguccuguaagaa

SEQ ID NO: 21114 - RNA, 20 nt, Artificial Sequence
  MKO10021114_A_Gm20809
  gRNA
aacaaacccuucucuuuauu

SEQ ID NO: 21115 - RNA, 20 nt, Artificial Sequence
  MKO10021115_A_Gm20815
  gRNA
ucugcauugugagcaaaaau

SEQ ID NO: 21116 - RNA, 20 nt, Artificial Sequence
  MKO10021116_A_Gm20815
  gRNA
gucauacucagacucuucag

SEQ ID NO: 21117 - RNA, 20 nt, Artificial Sequence
  MKO10021117_A_Gm20815
  gRNA
ugaguucacuaucuucacag

SEQ ID NO: 21118 - RNA, 20 nt, Artificial Sequence
  MKO10021118_A_Gm20816
  gRNA
ugaguucacuaucuucacag

SEQ ID NO: 21119 - RNA, 20 nt, Artificial Sequence
  MKO10021119_A_Gm20816
  gRNA
ucugucuccugauacagacc

SEQ ID NO: 21120 - RNA, 20 nt, Artificial Sequence
  MKO10021120_A_Gm20816
  gRNA
guucucguagagaagagucu

SEQ ID NO: 21121 - RNA, 20 nt, Artificial Sequence
  MKO10021121_A_Gm20822
  gRNA
caucacucaagaagaagagu

SEQ ID NO: 21122 - RNA, 20 nt, Artificial Sequence
  MKO10021122_A_Gm20822
  gRNA
ccagaguauagacauagaua

SEQ ID NO: 21123 - RNA, 20 nt, Artificial Sequence
  MKO10021123_A_Gm20822
  gRNA
gagguacaacacaaauuuga

SEQ ID NO: 21124 - RNA, 20 nt, Artificial Sequence
  MKO10021124_A_Gm20823
  gRNA
caccugaagaaaaacuacau

SEQ ID NO: 21125 - RNA, 20 nt, Artificial Sequence
  MKO10021125_A_Gm20823
  gRNA
guucucguagagaagagucu

SEQ ID NO: 21126 - RNA, 20 nt, Artificial Sequence
  MKO10021126_A_Gm20823
  gRNA
guaaugagccugucacccau

SEQ ID NO: 21127 - RNA, 20 nt, Artificial Sequence
  MKO10021127_A_Gm20826
  gRNA
caucacucaagaagaagaau

SEQ ID NO: 21128 - RNA, 20 nt, Artificial Sequence
  MKO10021128_A_Gm20826
  gRNA
gaguauagacauagauaugu

SEQ ID NO: 21129 - RNA, 20 nt, Artificial Sequence
  MKO10021129_A_Gm20826
  gRNA
agagguacaacacaaauuug

SEQ ID NO: 21130 - RNA, 20 nt, Artificial Sequence
  MKO10021130_A_Gm20831
  gRNA
guaccugcaagcugugaaau

SEQ ID NO: 21131 - RNA, 20 nt, Artificial Sequence
  MKO10021131_A_Gm20831
  gRNA
uagaagauguaacuucuaaa

SEQ ID NO: 21132 - RNA, 20 nt, Artificial Sequence
  MKO10021132_A_Gm20831
  gRNA
caggcaauaucuucaaucca

SEQ ID NO: 21133 - RNA, 20 nt, Artificial Sequence
  MKO10021133_A_Gm2083
  gRNA
uauuacagauuaauggggaa

SEQ ID NO: 21134 - RNA, 20 nt, Artificial Sequence
  MKO10021134_A_Gm2083
  gRNA
aguauggaauuuaagaacua

SEQ ID NO: 21135 - RNA, 20 nt, Artificial Sequence
  MKO10021135_A_Gm2083
  gRNA
agagugcuccgaauuaucua

SEQ ID NO: 21136 - RNA, 20 nt, Artificial Sequence
  MKO10021136_A_Gm20854
  gRNA
ccucuacgucuaucagcuac

SEQ ID NO: 21137 - RNA, 20 nt, Artificial Sequence
  MKO10021137_A_Gm20854
  gRNA
ccaguagcugauagacguag

SEQ ID NO: 21138 - RNA, 20 nt, Artificial Sequence
  MKO10021138_A_Gm20854
  gRNA
ggaauucauauauaugacag

SEQ ID NO: 21139 - RNA, 20 nt, Artificial Sequence
  MKO10021139_A_Gm20865
  gRNA
gcugcagaauuucucacgag

SEQ ID NO: 21140 - RNA, 20 nt, Artificial Sequence
  MKO10021140_A_Gm20865
  gRNA
gaguauagacauagauaugu

SEQ ID NO: 21141 - RNA, 20 nt, Artificial Sequence
  MKO10021141_A_Gm20865
  gRNA
cgggcaagaucuucaguccc

SEQ ID NO: 21142 - RNA, 20 nt, Artificial Sequence
  MKO10021142_A_Gm20867
  gRNA
ugaguucacuaucuucacag

SEQ ID NO: 21143 - RNA, 20 nt, Artificial Sequence
  MKO10021143_A_Gm20867
  gRNA
ucugucuccugauacagacc

SEQ ID NO: 21144 - RNA, 20 nt, Artificial Sequence
  MKO10021144_A_Gm20867
  gRNA
guucucguagagaagagucu

SEQ ID NO: 21145 - RNA, 20 nt, Artificial Sequence
  MKO10021145_A_Gm20877
  gRNA
gaacaagcacgaaaagccuu

SEQ ID NO: 21146 - RNA, 20 nt, Artificial Sequence
  MKO10021146_A_Gm20877
  gRNA
ugaguucauuaucuucacag

SEQ ID NO: 21147 - RNA, 20 nt, Artificial Sequence
  MKO10021147_A_Gm20877
  gRNA
guucucuuagcaaagagucu

SEQ ID NO: 21148 - RNA, 20 nt, Artificial Sequence
  MKO10021148_A_Gm20878
  gRNA
gccuggacaugucgcgauug

SEQ ID NO: 21149 - RNA, 20 nt, Artificial Sequence
  MKO10021149_A_Gm20878
  gRNA
auacgagguggcgcuggaag

SEQ ID NO: 21150 - RNA, 20 nt, Artificial Sequence
  MKO10021150_A_Gm20878
  gRNA
cugcgccacauucgcaaccg

SEQ ID NO: 21151 - RNA, 20 nt, Artificial Sequence
  MKO10021151_A_Gm20917
  gRNA
ggaauucauauauaugacag

SEQ ID NO: 21152 - RNA, 20 nt, Artificial Sequence
  MKO10021152_A_Gm20917
  gRNA
uaaaaauaguccuguaagaa

SEQ ID NO: 21153 - RNA, 20 nt, Artificial Sequence
  MKO10021153_A_Gm20917
  gRNA
aacaaacccuucucuuuauu

SEQ ID NO: 21154 - RNA, 20 nt, Artificial Sequence
  MKO10021154_A_Gm20939
  gRNA
uaugcauuugaagcucauaa

SEQ ID NO: 21155 - RNA, 20 nt, Artificial Sequence
  MKO10021155_A_Gm20939
  gRNA
cccucugaaaauacuaaaug

SEQ ID NO: 21156 - RNA, 20 nt, Artificial Sequence
  MKO10021156_A_Gm20939
  gRNA
uacagcaaucuugaaagaug

SEQ ID NO: 21157 - RNA, 20 nt, Artificial Sequence
  MKO10021157_A_Gm21002
  gRNA
ucaugaagagcagauccuuc

SEQ ID NO: 21158 - RNA, 20 nt, Artificial Sequence
  MKO10021158_A_Gm21002
  gRNA
ccucucugcccucguccugc

SEQ ID NO: 21159 - RNA, 20 nt, Artificial Sequence
  MKO10021159_A_Gm21002
  gRNA
aucugcauguucaguggcgg

SEQ ID NO: 21160 - RNA, 20 nt, Artificial Sequence
  MKO10021160_A_Gm21119
  gRNA
ccaauagcuaccuuaaucaa

SEQ ID NO: 21161 - RNA, 20 nt, Artificial Sequence
  MKO10021161_A_Gm21119
  gRNA
ugcccacaaccauccagacg

SEQ ID NO: 21162 - RNA, 20 nt, Artificial Sequence
  MKO10021162_A_Gm21119
  gRNA
caaugucuacguugugcuca

SEQ ID NO: 21163 - RNA, 20 nt, Artificial Sequence
  MKO10021163_A_Gm21293
  gRNA
aaucagguaccuuggauaca

SEQ ID NO: 21164 - RNA, 20 nt, Artificial Sequence
  MKO10021164_A_Gm21293
  gRNA
cagcuacucuuugcugaauu

SEQ ID NO: 21165 - RNA, 20 nt, Artificial Sequence
  MKO10021165_A_Gm21293
  gRNA
uguucagucgaagcugugaa

SEQ ID NO: 21166 - RNA, 20 nt, Artificial Sequence
  MKO10021166_A_Gm21304
  gRNA
aaucagguaccuuggauaca

SEQ ID NO: 21167 - RNA, 20 nt, Artificial Sequence
  MKO10021167_A_Gm21304
  gRNA
cagcuacucuuugcugaauu

SEQ ID NO: 21168 - RNA, 20 nt, Artificial Sequence
  MKO10021168_A_Gm21304
  gRNA
uguucagucgaagcugugaa

SEQ ID NO: 21169 - RNA, 20 nt, Artificial Sequence
  MKO10021169_A_Gm21312
  gRNA
aaucagguaccuuggauaca

SEQ ID NO: 21170 - RNA, 20 nt, Artificial Sequence
  MKO10021170_A_Gm21312
  gRNA
cagcuacucuuugcugaauu

SEQ ID NO: 21171 - RNA, 20 nt, Artificial Sequence
  MKO10021171_A_Gm21312
  gRNA
uguucagucgaagcugugaa

SEQ ID NO: 21172 - RNA, 20 nt, Artificial Sequence
  MKO10021172_A_Gm21319
  gRNA
ggaggcaaaaacaggugcag

SEQ ID NO: 21173 - RNA, 20 nt, Artificial Sequence
  MKO10021173_A_Gm21319
  gRNA
gaaaucguguuugaugauac

SEQ ID NO: 21174 - RNA, 20 nt, Artificial Sequence
  MKO10021174_A_Gm21319
  gRNA
auguucuugaaguucuccau

SEQ ID NO: 21175 - RNA, 20 nt, Artificial Sequence
  MKO10021175_A_Gm21498
  gRNA
caugaagagcagacccuucu

SEQ ID NO: 21176 - RNA, 20 nt, Artificial Sequence
  MKO10021176_A_Gm21498
  gRNA
ccucucugcccuuguccugc

SEQ ID NO: 21177 - RNA, 20 nt, Artificial Sequence
  MKO10021177_A_Gm21498
  gRNA
aguuaaaaaaagauuucugc

SEQ ID NO: 21178 - RNA, 20 nt, Artificial Sequence
  MKO10021178_A_Gm21541
  gRNA
cuccuugguaccuugggucc

SEQ ID NO: 21179 - RNA, 20 nt, Artificial Sequence
  MKO10021179_A_Gm21541
  gRNA
gacucugagccuccuuagcc

SEQ ID NO: 21180 - RNA, 20 nt, Artificial Sequence
  MKO10021180_A_Gm21541
  gRNA
agcgcacucacaggauugcc

SEQ ID NO: 21181 - RNA, 20 nt, Artificial Sequence
  MKO10021181_A_Gm21586
  gRNA
gccuggacaugucgcgauug

SEQ ID NO: 21182 - RNA, 20 nt, Artificial Sequence
  MKO10021182_A_Gm21586
  gRNA
auacgagguggcgcuggaag

SEQ ID NO: 21183 - RNA, 20 nt, Artificial Sequence
  MKO10021183_A_Gm21586
  gRNA
cugcgccacauucgcaaccg

SEQ ID NO: 21184 - RNA, 20 nt, Artificial Sequence
  MKO10021184_A_Gm21637
  gRNA
ccaagugagugacauguaug

SEQ ID NO: 21185 - RNA, 20 nt, Artificial Sequence
  MKO10021185_A_Gm21637
  gRNA
aagcugaccaagaaaagagc

SEQ ID NO: 21186 - RNA, 20 nt, Artificial Sequence
  MKO10021186_A_Gm21637
  gRNA
auuaacuucuuugcccacua

SEQ ID NO: 21187 - RNA, 20 nt, Artificial Sequence
  MKO10021187_A_Gm21671
  gRNA
auaucuacacaucuuagaga

SEQ ID NO: 21188 - RNA, 20 nt, Artificial Sequence
  MKO10021188_A_Gm21671
  gRNA
aagcaaaaagcaguuugaga

SEQ ID NO: 21189 - RNA, 20 nt, Artificial Sequence
  MKO10021189_A_Gm21671
  gRNA
caauguauaccucuuguuca

SEQ ID NO: 21190 - RNA, 20 nt, Artificial Sequence
  MKO10021190_A_Gm21677
  gRNA
auggcagaaacuaaucagcc

SEQ ID NO: 21191 - RNA, 20 nt, Artificial Sequence
  MKO10021191_A_Gm21677
  gRNA
aaagaauuaccacgugcuac

SEQ ID NO: 21192 - RNA, 20 nt, Artificial Sequence
  MKO10021192_A_Gm21677
  gRNA
cgugaaacuaagaagucuag

SEQ ID NO: 21193 - RNA, 20 nt, Artificial Sequence
  MKO10021193_A_Gm21693
  gRNA
auggcagaaacuaaucagcc

SEQ ID NO: 21194 - RNA, 20 nt, Artificial Sequence
  MKO10021194_A_Gm21693
  gRNA
aaagaauuaccacgugcuac

SEQ ID NO: 21195 - RNA, 20 nt, Artificial Sequence
  MKO10021195_A_Gm21693
  gRNA
cgugaaacuaagaagucuag

SEQ ID NO: 21196 - RNA, 20 nt, Artificial Sequence
  MKO10021196_A_Gm216
  gRNA
ucgcuuccuagccuuagacu

SEQ ID NO: 21197 - RNA, 20 nt, Artificial Sequence
  MKO10021197_A_Gm216
  gRNA
gagcuugcccuccgagucua

SEQ ID NO: 21198 - RNA, 20 nt, Artificial Sequence
  MKO10021198_A_Gm216
  gRNA
ucccacacagcgauuugucu

SEQ ID NO: 21199 - RNA, 20 nt, Artificial Sequence
  MKO10021199_A_Gm21704
  gRNA
aaagaauuaccacgugcuac

SEQ ID NO: 21200 - RNA, 20 nt, Artificial Sequence
  MKO10021200_A_Gm21704
  gRNA
auggcagaaacugaucagcc

SEQ ID NO: 21201 - RNA, 20 nt, Artificial Sequence
  MKO10021201_A_Gm21704
  gRNA
cagcauucuuagcaucugca

SEQ ID NO: 21202 - RNA, 20 nt, Artificial Sequence
  MKO10021202_A_Gm21708
  gRNA
uuaaaacuuagugaucaugc

SEQ ID NO: 21203 - RNA, 20 nt, Artificial Sequence
  MKO10021203_A_Gm21708
  gRNA
gauuucucugaauauuuaag

SEQ ID NO: 21204 - RNA, 20 nt, Artificial Sequence
  MKO10021204_A_Gm21708
  gRNA
augcacuuucuucccgagag

SEQ ID NO: 21205 - RNA, 20 nt, Artificial Sequence
  MKO10021205_A_Gm21943
  gRNA
guucucuuagagaagagucu

SEQ ID NO: 21206 - RNA, 20 nt, Artificial Sequence
  MKO10021206_A_Gm21943
  gRNA
guaaugagccugucacccau

SEQ ID NO: 21207 - RNA, 20 nt, Artificial Sequence
  MKO10021207_A_Gm21943
  gRNA
ugaguucacuaucuucacag

SEQ ID NO: 21208 - RNA, 20 nt, Artificial Sequence
  MKO10021208_A_Gm21949
  gRNA
augccguccccgaugccuaa

SEQ ID NO: 21209 - RNA, 20 nt, Artificial Sequence
  MKO10021209_A_Gm21949
  gRNA
gugcaaauccucaucgucgc

SEQ ID NO: 21210 - RNA, 20 nt, Artificial Sequence
  MKO10021210_A_Gm21949
  gRNA
aguacucucgccaugcucgc

SEQ ID NO: 21211 - RNA, 20 nt, Artificial Sequence
  MKO10021211_A_Gm21950
  gRNA
auuucauuacaauuugcucc

SEQ ID NO: 21212 - RNA, 20 nt, Artificial Sequence
  MKO10021212_A_Gm21950
  gRNA
ccucaccuuugaauauaacc

SEQ ID NO: 21213 - RNA, 20 nt, Artificial Sequence
  MKO10021213_A_Gm21950
  gRNA
cgaguaauucagaaguguga

SEQ ID NO: 21214 - RNA, 20 nt, Artificial Sequence
  MKO10021214_A_Gm21951
  gRNA
caaccacuguuguuuguaaa

SEQ ID NO: 21215 - RNA, 20 nt, Artificial Sequence
  MKO10021215_A_Gm21951
  gRNA
acuuggagagaaucacacca

SEQ ID NO: 21216 - RNA, 20 nt, Artificial Sequence
  MKO10021216_A_Gm21951
  gRNA
aucuuguucaagaauaguug

SEQ ID NO: 21217 - RNA, 20 nt, Artificial Sequence
  MKO10021217_A_Gm2382
  gRNA
cuucucguaccuucugcgug

SEQ ID NO: 21218 - RNA, 20 nt, Artificial Sequence
  MKO10021218_A_Gm2382
  gRNA
cguuguguaacuuaggaugc

SEQ ID NO: 21219 - RNA, 20 nt, Artificial Sequence
  MKO10021219_A_Gm2382
  gRNA
aucuugcaugcucagaaaga

SEQ ID NO: 21220 - RNA, 20 nt, Artificial Sequence
  MKO10021220_A_Gm2663
  gRNA
guacccacugaucauugaua

SEQ ID NO: 21221 - RNA, 20 nt, Artificial Sequence
  MKO10021221_A_Gm2663
  gRNA
aucucuccauugcagacaac

SEQ ID NO: 21222 - RNA, 20 nt, Artificial Sequence
  MKO10021222_A_Gm2663
  gRNA
gcucccuuaucaaugaucag

SEQ ID NO: 21223 - RNA, 20 nt, Artificial Sequence
  MKO10021223_A_Gm266
  gRNA
gcggccgcacgcgaacugcg

SEQ ID NO: 21224 - RNA, 20 nt, Artificial Sequence
  MKO10021224_A_Gm266
  gRNA
cgaguggcguugcccguucc

SEQ ID NO: 21225 - RNA, 20 nt, Artificial Sequence
  MKO10021225_A_Gm266
  gRNA
ugcgccccgccaaagacuac

SEQ ID NO: 21226 - RNA, 20 nt, Artificial Sequence
  MKO10021226_A_Gm2696
  gRNA
ccggggauagaaucagcagc

SEQ ID NO: 21227 - RNA, 20 nt, Artificial Sequence
  MKO10021227_A_Gm2696
  gRNA
acacucgaaccaacuccucc

SEQ ID NO: 21228 - RNA, 20 nt, Artificial Sequence
  MKO10021228_A_Gm2696
  gRNA
gucagaacagacagacauag

SEQ ID NO: 21229 - RNA, 20 nt, Artificial Sequence
  MKO10021229_A_Gm2799
  gRNA
cuggcuccggcuaugucuuc

SEQ ID NO: 21230 - RNA, 20 nt, Artificial Sequence
  MKO10021230_A_Gm2799
  gRNA
ccacagccagaagacauagc

SEQ ID NO: 21231 - RNA, 20 nt, Artificial Sequence
  MKO10021231_A_Gm2799
  gRNA
caaccacuguuguuuguaaa

SEQ ID NO: 21232 - RNA, 20 nt, Artificial Sequence
  MKO10021232_A_Gm2825
  gRNA
caaccacuguuguuuguaaa

SEQ ID NO: 21233 - RNA, 20 nt, Artificial Sequence
  MKO10021233_A_Gm2825
  gRNA
acuuggagagaaucacacca

SEQ ID NO: 21234 - RNA, 20 nt, Artificial Sequence
  MKO10021234_A_Gm2825
  gRNA
aucuuguucaagaauaguug

SEQ ID NO: 21235 - RNA, 20 nt, Artificial Sequence
  MKO10021235_A_Gm2863
  gRNA
caugcugcugccaaaccuug

SEQ ID NO: 21236 - RNA, 20 nt, Artificial Sequence
  MKO10021236_A_Gm2863
  gRNA
caaccacuguuguuuguaaa

SEQ ID NO: 21237 - RNA, 20 nt, Artificial Sequence
  MKO10021237_A_Gm2863
  gRNA
acuuggagagaaucacacca

SEQ ID NO: 21238 - RNA, 20 nt, Artificial Sequence
  MKO10021238_A_Gm2897
  gRNA
ucaaauccucauacauguaa

SEQ ID NO: 21239 - RNA, 20 nt, Artificial Sequence
  MKO10021239_A_Gm2897
  gRNA
ugaacuagaagaacugaaau

SEQ ID NO: 21240 - RNA, 20 nt, Artificial Sequence
  MKO10021240_A_Gm2897
  gRNA
guuaucuucuaucaguuccu

SEQ ID NO: 21241 - RNA, 20 nt, Artificial Sequence
  MKO10021241_A_Gm2913
  gRNA
agagaaacacagagaagucu

SEQ ID NO: 21242 - RNA, 20 nt, Artificial Sequence
  MKO10021242_A_Gm2913
  gRNA
guucacaacaguuucaacaa

SEQ ID NO: 21243 - RNA, 20 nt, Artificial Sequence
  MKO10021243_A_Gm2913
  gRNA
aaauugcagaauauacacau

SEQ ID NO: 21244 - RNA, 20 nt, Artificial Sequence
  MKO10021244_A_Gm2927
  gRNA
ugaucagauuuauagcacca

SEQ ID NO: 21245 - RNA, 20 nt, Artificial Sequence
  MKO10021245_A_Gm2927
  gRNA
agagaaacacagagaagucu

SEQ ID NO: 21246 - RNA, 20 nt, Artificial Sequence
  MKO10021246_A_Gm2927
  gRNA
uugcuccuccuuauauucaa

SEQ ID NO: 21247 - RNA, 20 nt, Artificial Sequence
  MKO10021247_A_Gm2933
  gRNA
ugacuuacuagucauacaaa

SEQ ID NO: 21248 - RNA, 20 nt, Artificial Sequence
  MKO10021248_A_Gm2933
  gRNA
acuuggagagaaucacacca

SEQ ID NO: 21249 - RNA, 20 nt, Artificial Sequence
  MKO10021249_A_Gm2933
  gRNA
caaccacuguuguuuguaaa

SEQ ID NO: 21250 - RNA, 20 nt, Artificial Sequence
  MKO10021250_A_Gm2a
  gRNA
cagcagcgguagacggugca

SEQ ID NO: 21251 - RNA, 20 nt, Artificial Sequence
  MKO10021251_A_Gm2a
  gRNA
cugaccuagagcuaccgagc

SEQ ID NO: 21252 - RNA, 20 nt, Artificial Sequence
  MKO10021252_A_Gm2a
  gRNA
auagacgaauacauuccucc

SEQ ID NO: 21253 - RNA, 20 nt, Artificial Sequence
  MKO10021253_A_Gm3139
  gRNA
accaucuagcagagcuugca

SEQ ID NO: 21254 - RNA, 20 nt, Artificial Sequence
  MKO10021254_A_Gm3139
  gRNA
ccacacuccagaagcgagca

SEQ ID NO: 21255 - RNA, 20 nt, Artificial Sequence
  MKO10021255_A_Gm3139
  gRNA
cuuacccuaggaucugaugc

SEQ ID NO: 21256 - RNA, 20 nt, Artificial Sequence
  MKO10021256_A_Gm3238
  gRNA
cagcagggauaggcuagagc

SEQ ID NO: 21257 - RNA, 20 nt, Artificial Sequence
  MKO10021257_A_Gm3238
  gRNA
ggacagaaguccaacugcug

SEQ ID NO: 21258 - RNA, 20 nt, Artificial Sequence
  MKO10021258_A_Gm3238
  gRNA
gccuccuccugccagcccag

SEQ ID NO: 21259 - RNA, 20 nt, Artificial Sequence
  MKO10021259_A_Gm3258
  gRNA
ucagcucccgcacgauuccu

SEQ ID NO: 21260 - RNA, 20 nt, Artificial Sequence
  MKO10021260_A_Gm3258
  gRNA
cgagucaguaacuuuaagcc

SEQ ID NO: 21261 - RNA, 20 nt, Artificial Sequence
  MKO10021261_A_Gm3258
  gRNA
gccugccccaaggaaucgug

SEQ ID NO: 21262 - RNA, 20 nt, Artificial Sequence
  MKO10021262_A_Gm3259
  gRNA
gccuuuccccugucuccaug

SEQ ID NO: 21263 - RNA, 20 nt, Artificial Sequence
  MKO10021263_A_Gm3259
  gRNA
uccaucuagcagagcuugca

SEQ ID NO: 21264 - RNA, 20 nt, Artificial Sequence
  MKO10021264_A_Gm3259
  gRNA
ucauguagucucuuagaaaa

SEQ ID NO: 21265 - RNA, 20 nt, Artificial Sequence
  MKO10021265_A_Gm3264
  gRNA
ccucauacauguaaacguuc

SEQ ID NO: 21266 - RNA, 20 nt, Artificial Sequence
  MKO10021266_A_Gm3264
  gRNA
ugaacuagaagaacugaaau

SEQ ID NO: 21267 - RNA, 20 nt, Artificial Sequence
  MKO10021267_A_Gm3264
  gRNA
guuaucuucuaucaguuccu

SEQ ID NO: 21268 - RNA, 20 nt, Artificial Sequence
  MKO10021268_A_Gm3285
  gRNA
ccgcccagccaacaccgcca

SEQ ID NO: 21269 - RNA, 20 nt, Artificial Sequence
  MKO10021269_A_Gm3285
  gRNA
aagagcguguugaaugugug

SEQ ID NO: 21270 - RNA, 20 nt, Artificial Sequence
  MKO10021270_A_Gm3285
  gRNA
cuggagcacagcagcagggc

SEQ ID NO: 21271 - RNA, 20 nt, Artificial Sequence
  MKO10021271_A_Gm3286
  gRNA
uccaucuagcagagcuugca

SEQ ID NO: 21272 - RNA, 20 nt, Artificial Sequence
  MKO10021272_A_Gm3286
  gRNA
ccacacuccagaagcuagca

SEQ ID NO: 21273 - RNA, 20 nt, Artificial Sequence
  MKO10021273_A_Gm3286
  gRNA
uauccauguuuacugcaaac

SEQ ID NO: 21274 - RNA, 20 nt, Artificial Sequence
  MKO10021274_A_Gm3317
  gRNA
ucaaauccucauacauguaa

SEQ ID NO: 21275 - RNA, 20 nt, Artificial Sequence
  MKO10021275_A_Gm3317
  gRNA
ugaacuagaagaacugaaau

SEQ ID NO: 21276 - RNA, 20 nt, Artificial Sequence
  MKO10021276_A_Gm3317
  gRNA
guuaucuucuaucaguuccu

SEQ ID NO: 21277 - RNA, 20 nt, Artificial Sequence
  MKO10021277_A_Gm3336
  gRNA
cugcaggaauggcgagcucg

SEQ ID NO: 21278 - RNA, 20 nt, Artificial Sequence
  MKO10021278_A_Gm3336
  gRNA
acaguggacaacccuugugg

SEQ ID NO: 21279 - RNA, 20 nt, Artificial Sequence
  MKO10021279_A_Gm3336
  gRNA
ucuagggcagcgugagccag

SEQ ID NO: 21280 - RNA, 20 nt, Artificial Sequence
  MKO10021280_A_Gm3376
  gRNA
aagacacuucaagaaauauu

SEQ ID NO: 21281 - RNA, 20 nt, Artificial Sequence
  MKO10021281_A_Gm3376
  gRNA
aaagaauuaccacgugcuac

SEQ ID NO: 21282 - RNA, 20 nt, Artificial Sequence
  MKO10021282_A_Gm3376
  gRNA
acagcauucuuagcaucugc

SEQ ID NO: 21283 - RNA, 20 nt, Artificial Sequence
  MKO10021283_A_Gm3383
  gRNA
aggcuauuucagaaagagaa

SEQ ID NO: 21284 - RNA, 20 nt, Artificial Sequence
  MKO10021284_A_Gm3383
  gRNA
auucccucuuccuucucugu

SEQ ID NO: 21285 - RNA, 20 nt, Artificial Sequence
  MKO10021285_A_Gm3383
  gRNA
ugaacuagaagaacugaaau

SEQ ID NO: 21286 - RNA, 20 nt, Artificial Sequence
  MKO10021286_A_Gm3402
  gRNA
ccacucacguucucaucagc

SEQ ID NO: 21287 - RNA, 20 nt, Artificial Sequence
  MKO10021287_A_Gm3402
  gRNA
ggucuguucucaaaaugaac

SEQ ID NO: 21288 - RNA, 20 nt, Artificial Sequence
  MKO10021288_A_Gm3402
  gRNA
ccacucaccucuuaguuugc

SEQ ID NO: 21289 - RNA, 20 nt, Artificial Sequence
  MKO10021289_A_Gm3404
  gRNA
cuacucaccucuuaguuugc

SEQ ID NO: 21290 - RNA, 20 nt, Artificial Sequence
  MKO10021290_A_Gm3404
  gRNA
ccacucacguucucaucagc

SEQ ID NO: 21291 - RNA, 20 nt, Artificial Sequence
  MKO10021291_A_Gm3404
  gRNA
ggucuguucucaaaaugaac

SEQ ID NO: 21292 - RNA, 20 nt, Artificial Sequence
  MKO10021292_A_Gm3409
  gRNA
uugccuccugaucuuccagc

SEQ ID NO: 21293 - RNA, 20 nt, Artificial Sequence
  MKO10021293_A_Gm3409
  gRNA
gcucucccugcuggaagauc

SEQ ID NO: 21294 - RNA, 20 nt, Artificial Sequence
  MKO10021294_A_Gm3409
  gRNA
ccacucacguucucaucagc

SEQ ID NO: 21295 - RNA, 20 nt, Artificial Sequence
  MKO10021295_A_Gm3415
  gRNA
ccacucacguucucaucagc

SEQ ID NO: 21296 - RNA, 20 nt, Artificial Sequence
  MKO10021296_A_Gm3415
  gRNA
ggucuguucucaaaaugaac

SEQ ID NO: 21297 - RNA, 20 nt, Artificial Sequence
  MKO10021297_A_Gm3415
  gRNA
ccacucaccucuuaguuugc

SEQ ID NO: 21298 - RNA, 20 nt, Artificial Sequence
  MKO10021298_A_Gm3417
  gRNA
ccgaucaagauggagcggcg

SEQ ID NO: 21299 - RNA, 20 nt, Artificial Sequence
  MKO10021299_A_Gm3417
  gRNA
gacuccuucucgaacaugcu

SEQ ID NO: 21300 - RNA, 20 nt, Artificial Sequence
  MKO10021300_A_Gm3417
  gRNA
uaauuaccuuuaauaucugc

SEQ ID NO: 21301 - RNA, 20 nt, Artificial Sequence
  MKO10021301_A_Gm3435
  gRNA
cuaauucuucauaucucaca

SEQ ID NO: 21302 - RNA, 20 nt, Artificial Sequence
  MKO10021302_A_Gm3435
  gRNA
uuucuuugaguucaaaccca

SEQ ID NO: 21303 - RNA, 20 nt, Artificial Sequence
  MKO10021303_A_Gm3435
  gRNA
ccucuggauaaguuguccac

SEQ ID NO: 21304 - RNA, 20 nt, Artificial Sequence
  MKO10021304_A_Gm3448
  gRNA
ccgaucaagauggagcggcg

SEQ ID NO: 21305 - RNA, 20 nt, Artificial Sequence
  MKO10021305_A_Gm3448
  gRNA
gacuccuucucgaacaugcu

SEQ ID NO: 21306 - RNA, 20 nt, Artificial Sequence
  MKO10021306_A_Gm3448
  gRNA
uaauuaccuuuaauaucugc

SEQ ID NO: 21307 - RNA, 20 nt, Artificial Sequence
  MKO10021307_A_Gm3488
  gRNA
ucaaauccucauacauguaa

SEQ ID NO: 21308 - RNA, 20 nt, Artificial Sequence
  MKO10021308_A_Gm3488
  gRNA
ugaacuagaagaacugaaau

SEQ ID NO: 21309 - RNA, 20 nt, Artificial Sequence
  MKO10021309_A_Gm3488
  gRNA
guuaucuucuaucaguuccu

SEQ ID NO: 21310 - RNA, 20 nt, Artificial Sequence
  MKO10021310_A_Gm3500
  gRNA
ugaacuagaagaacugaaau

SEQ ID NO: 21311 - RNA, 20 nt, Artificial Sequence
  MKO10021311_A_Gm3500
  gRNA
ucaaauccucauacauguaa

SEQ ID NO: 21312 - RNA, 20 nt, Artificial Sequence
  MKO10021312_A_Gm3500
  gRNA
acaacaugagaagacaaugu

SEQ ID NO: 21313 - RNA, 20 nt, Artificial Sequence
  MKO10021313_A_Gm3558
  gRNA
ugaacuagaagaacugaaau

SEQ ID NO: 21314 - RNA, 20 nt, Artificial Sequence
  MKO10021314_A_Gm3558
  gRNA
ucaaauccucauacauguaa

SEQ ID NO: 21315 - RNA, 20 nt, Artificial Sequence
  MKO10021315_A_Gm3558
  gRNA
acaacaugagaagacaaugu

SEQ ID NO: 21316 - RNA, 20 nt, Artificial Sequence
  MKO10021316_A_Gm3604
  gRNA
acuuucguauacagauacug

SEQ ID NO: 21317 - RNA, 20 nt, Artificial Sequence
  MKO10021317_A_Gm3604
  gRNA
ccauauacauauacgcaaug

SEQ ID NO: 21318 - RNA, 20 nt, Artificial Sequence
  MKO10021318_A_Gm3604
  gRNA
agaucgcuagcaaugcccua

SEQ ID NO: 21319 - RNA, 20 nt, Artificial Sequence
  MKO10021319_A_Gm362
  gRNA
ucuauacgaccuuucgcucu

SEQ ID NO: 21320 - RNA, 20 nt, Artificial Sequence
  MKO10021320_A_Gm362
  gRNA
guaaaacugugaaucgcuca

SEQ ID NO: 21321 - RNA, 20 nt, Artificial Sequence
  MKO10021321_A_Gm362
  gRNA
cuuagagaugucguacaaac

SEQ ID NO: 21322 - RNA, 20 nt, Artificial Sequence
  MKO10021322_A_Gm3646
  gRNA
accggcgaccuuucauaucu

SEQ ID NO: 21323 - RNA, 20 nt, Artificial Sequence
  MKO10021323_A_Gm3646
  gRNA
cccuagauaugaaaggucgc

SEQ ID NO: 21324 - RNA, 20 nt, Artificial Sequence
  MKO10021324_A_Gm3646
  gRNA
cccagguacuuucaguccac

SEQ ID NO: 21325 - RNA, 20 nt, Artificial Sequence
  MKO10021325_A_Gm364
  gRNA
aguaacaucaugucccuaca

SEQ ID NO: 21326 - RNA, 20 nt, Artificial Sequence
  MKO10021326_A_Gm364
  gRNA
uuuaggauuguugauaacac

SEQ ID NO: 21327 - RNA, 20 nt, Artificial Sequence
  MKO10021327_A_Gm364
  gRNA
aucagcauacaccugaauug

SEQ ID NO: 21328 - RNA, 20 nt, Artificial Sequence
  MKO10021328_A_Gm3696
  gRNA
uugggacacagauguucuug

SEQ ID NO: 21329 - RNA, 20 nt, Artificial Sequence
  MKO10021329_A_Gm3696
  gRNA
ugaacuagaagaacugaaau

SEQ ID NO: 21330 - RNA, 20 nt, Artificial Sequence
  MKO10021330_A_Gm3696
  gRNA
ucaaauccucauacauguaa

SEQ ID NO: 21331 - RNA, 20 nt, Artificial Sequence
  MKO10021331_A_Gm3701
  gRNA
caaacacaaaaagcagagau

SEQ ID NO: 21332 - RNA, 20 nt, Artificial Sequence
  MKO10021332_A_Gm3701
  gRNA
guucacaacaguuucaacaa

SEQ ID NO: 21333 - RNA, 20 nt, Artificial Sequence
  MKO10021333_A_Gm3701
  gRNA
agagaaacacagagaagucu

SEQ ID NO: 21334 - RNA, 20 nt, Artificial Sequence
  MKO10021334_A_Gm3706
  gRNA
aaucaugccauuguugaaac

SEQ ID NO: 21335 - RNA, 20 nt, Artificial Sequence
  MKO10021335_A_Gm3706
  gRNA
guucacaccaguuucaacaa

SEQ ID NO: 21336 - RNA, 20 nt, Artificial Sequence
  MKO10021336_A_Gm3706
  gRNA
agagaaacacagagaagucu

SEQ ID NO: 21337 - RNA, 20 nt, Artificial Sequence
  MKO10021337_A_Gm3750
  gRNA
caaccacuguuguuuguaaa

SEQ ID NO: 21338 - RNA, 20 nt, Artificial Sequence
  MKO10021338_A_Gm3750
  gRNA
acuuggagagaaucacacca

SEQ ID NO: 21339 - RNA, 20 nt, Artificial Sequence
  MKO10021339_A_Gm3750
  gRNA
aucuuguucaagaauaguug

SEQ ID NO: 21340 - RNA, 20 nt, Artificial Sequence
  MKO10021340_A_Gm3763
  gRNA
caagcuaaaaagaaacaguu

SEQ ID NO: 21341 - RNA, 20 nt, Artificial Sequence
  MKO10021341_A_Gm3763
  gRNA
ccacauuaaaauccgugcuc

SEQ ID NO: 21342 - RNA, 20 nt, Artificial Sequence
  MKO10021342_A_Gm3763
  gRNA
caaccacuguuguuuguaaa

SEQ ID NO: 21343 - RNA, 20 nt, Artificial Sequence
  MKO10021343_A_Gm3776
  gRNA
ccuccaccccugcugcagcc

SEQ ID NO: 21344 - RNA, 20 nt, Artificial Sequence
  MKO10021344_A_Gm3776
  gRNA
gugaaccacaguugcugcaa

SEQ ID NO: 21345 - RNA, 20 nt, Artificial Sequence
  MKO10021345_A_Gm3776
  gRNA
agagaaguuuauacagaguc

SEQ ID NO: 21346 - RNA, 20 nt, Artificial Sequence
  MKO10021346_A_Gm382
  gRNA
gcauaauuuacgucaucuau

SEQ ID NO: 21347 - RNA, 20 nt, Artificial Sequence
  MKO10021347_A_Gm382
  gRNA
auugugaaauugcacguaac

SEQ ID NO: 21348 - RNA, 20 nt, Artificial Sequence
  MKO10021348_A_Gm382
  gRNA
acccuaaaccagcagguucg

SEQ ID NO: 21349 - RNA, 20 nt, Artificial Sequence
  MKO10021349_A_Gm3985
  gRNA
gccaucccgucaucgauaga

SEQ ID NO: 21350 - RNA, 20 nt, Artificial Sequence
  MKO10021350_A_Gm3985
  gRNA
uaagcauguacgaguuccuu

SEQ ID NO: 21351 - RNA, 20 nt, Artificial Sequence
  MKO10021351_A_Gm3985
  gRNA
gaguuuccuucuaucgauga

SEQ ID NO: 21352 - RNA, 20 nt, Artificial Sequence
  MKO10021352_A_Gm4027
  gRNA
uguguccauuucauugauuu

SEQ ID NO: 21353 - RNA, 20 nt, Artificial Sequence
  MKO10021353_A_Gm4027
  gRNA
uccaucaugccaaagaauaa

SEQ ID NO: 21354 - RNA, 20 nt, Artificial Sequence
  MKO10021354_A_Gm4027
  gRNA
agaugaagcaagaagucuga

SEQ ID NO: 21355 - RNA, 20 nt, Artificial Sequence
  MKO10021355_A_Gm4064
  gRNA
aaagaauuaccacgugcuac

SEQ ID NO: 21356 - RNA, 20 nt, Artificial Sequence
  MKO10021356_A_Gm4064
  gRNA
auggcagaaacugaucagcc

SEQ ID NO: 21357 - RNA, 20 nt, Artificial Sequence
  MKO10021357_A_Gm4064
  gRNA
cagcauucuuagcaucugca

SEQ ID NO: 21358 - RNA, 20 nt, Artificial Sequence
  MKO10021358_A_Gm4070
  gRNA
gcuucucgauauuucuugaa

SEQ ID NO: 21359 - RNA, 20 nt, Artificial Sequence
  MKO10021359_A_Gm4070
  gRNA
uucaagaaauaucgagaagc

SEQ ID NO: 21360 - RNA, 20 nt, Artificial Sequence
  MKO10021360_A_Gm4070
  gRNA
ucuuccguccuuccauaguu

SEQ ID NO: 21361 - RNA, 20 nt, Artificial Sequence
  MKO10021361_A_Gm410
  gRNA
uguguucaaugccgugaccc

SEQ ID NO: 21362 - RNA, 20 nt, Artificial Sequence
  MKO10021362_A_Gm410
  gRNA
cacaggcacaacacuucguc

SEQ ID NO: 21363 - RNA, 20 nt, Artificial Sequence
  MKO10021363_A_Gm410
  gRNA
cgauguugaagcacauacau

SEQ ID NO: 21364 - RNA, 20 nt, Artificial Sequence
  MKO10021364_A_Gm4133
  gRNA
gcccucuccaugucugcuca

SEQ ID NO: 21365 - RNA, 20 nt, Artificial Sequence
  MKO10021365_A_Gm4133
  gRNA
caguugaagagcacagaaca

SEQ ID NO: 21366 - RNA, 20 nt, Artificial Sequence
  MKO10021366_A_Gm4133
  gRNA
uguccaucaguuugucacuc

SEQ ID NO: 21367 - RNA, 20 nt, Artificial Sequence
  MKO10021367_A_Gm4141
  gRNA
gcccucuccaugucugcuca

SEQ ID NO: 21368 - RNA, 20 nt, Artificial Sequence
  MKO10021368_A_Gm4141
  gRNA
cauuugaagagcacagaaca

SEQ ID NO: 21369 - RNA, 20 nt, Artificial Sequence
  MKO10021369_A_Gm4141
  gRNA
cagagcaaguguccaaaauu

SEQ ID NO: 21370 - RNA, 20 nt, Artificial Sequence
  MKO10021370_A_Gm4175
  gRNA
gcccucuccaugucuguucg

SEQ ID NO: 21371 - RNA, 20 nt, Artificial Sequence
  MKO10021371_A_Gm4175
  gRNA
cagagcaagugucccaaauu

SEQ ID NO: 21372 - RNA, 20 nt, Artificial Sequence
  MKO10021372_A_Gm4175
  gRNA
gaccaugaugcucaugaaug

SEQ ID NO: 21373 - RNA, 20 nt, Artificial Sequence
  MKO10021373_A_Gm4177
  gRNA
acccucucaaugucugauca

SEQ ID NO: 21374 - RNA, 20 nt, Artificial Sequence
  MKO10021374_A_Gm4177
  gRNA
caguugaaaagcacagaaca

SEQ ID NO: 21375 - RNA, 20 nt, Artificial Sequence
  MKO10021375_A_Gm4177
  gRNA
uaacauccacauuccaauua

SEQ ID NO: 21376 - RNA, 20 nt, Artificial Sequence
  MKO10021376_A_Gm4187
  gRNA
gcccucuccaugucugcuca

SEQ ID NO: 21377 - RNA, 20 nt, Artificial Sequence
  MKO10021377_A_Gm4187
  gRNA
caguugaagagcacagaaca

SEQ ID NO: 21378 - RNA, 20 nt, Artificial Sequence
  MKO10021378_A_Gm4187
  gRNA
uguccaucaguuugucacuc

SEQ ID NO: 21379 - RNA, 20 nt, Artificial Sequence
  MKO10021379_A_Gm4201
  gRNA
gcccucuccaugucugcuca

SEQ ID NO: 21380 - RNA, 20 nt, Artificial Sequence
  MKO10021380_A_Gm4201
  gRNA
cauuugaagagcacagaaca

SEQ ID NO: 21381 - RNA, 20 nt, Artificial Sequence
  MKO10021381_A_Gm4201
  gRNA
cagagcaaguguccaaaauu

SEQ ID NO: 21382 - RNA, 20 nt, Artificial Sequence
  MKO10021382_A_Gm4214
  gRNA
gcccucuccaugucuguucg

SEQ ID NO: 21383 - RNA, 20 nt, Artificial Sequence
  MKO10021383_A_Gm4214
  gRNA
cagagcaagugucccaaauu

SEQ ID NO: 21384 - RNA, 20 nt, Artificial Sequence
  MKO10021384_A_Gm4214
  gRNA
gaccaugaugcucaugaaug

SEQ ID NO: 21385 - RNA, 20 nt, Artificial Sequence
  MKO10021385_A_Gm4216
  gRNA
acccucucaaugucugauca

SEQ ID NO: 21386 - RNA, 20 nt, Artificial Sequence
  MKO10021386_A_Gm4216
  gRNA
caguugaaaagcacagaaca

SEQ ID NO: 21387 - RNA, 20 nt, Artificial Sequence
  MKO10021387_A_Gm4216
  gRNA
uaacauccacauuccaauua

SEQ ID NO: 21388 - RNA, 20 nt, Artificial Sequence
  MKO10021388_A_Gm428
  gRNA
ucugaauaccugaggaacuu

SEQ ID NO: 21389 - RNA, 20 nt, Artificial Sequence
  MKO10021389_A_Gm428
  gRNA
gaaaugacaaagaagccaau

SEQ ID NO: 21390 - RNA, 20 nt, Artificial Sequence
  MKO10021390_A_Gm428
  gRNA
caccuggcacauagccuccc

SEQ ID NO: 21391 - RNA, 20 nt, Artificial Sequence
  MKO10021391_A_Gm4297
  gRNA
agaugaacaauucaguaugu

SEQ ID NO: 21392 - RNA, 20 nt, Artificial Sequence
  MKO10021392_A_Gm4297
  gRNA
acguaaguuucucaguugaa

SEQ ID NO: 21393 - RNA, 20 nt, Artificial Sequence
  MKO10021393_A_Gm4297
  gRNA
ugcuucagaauuggaccuaa

SEQ ID NO: 21394 - RNA, 20 nt, Artificial Sequence
  MKO10021394_A_Gm4301
  gRNA
aaucagguaccuuggauaca

SEQ ID NO: 21395 - RNA, 20 nt, Artificial Sequence
  MKO10021395_A_Gm4301
  gRNA
gcuuugcucaguuguuuagc

SEQ ID NO: 21396 - RNA, 20 nt, Artificial Sequence
  MKO10021396_A_Gm4301
  gRNA
uguacucucucauagccuuc

SEQ ID NO: 21397 - RNA, 20 nt, Artificial Sequence
  MKO10021397_A_Gm4302
  gRNA
uauccugauaauaauccagc

SEQ ID NO: 21398 - RNA, 20 nt, Artificial Sequence
  MKO10021398_A_Gm4302
  gRNA
ggcaaauuccaugacuacca

SEQ ID NO: 21399 - RNA, 20 nt, Artificial Sequence
  MKO10021399_A_Gm4302
  gRNA
uguacucucucauagccuuc

SEQ ID NO: 21400 - RNA, 20 nt, Artificial Sequence
  MKO10021400_A_Gm4303
  gRNA
uauccugauaauaauccagc

SEQ ID NO: 21401 - RNA, 20 nt, Artificial Sequence
  MKO10021401_A_Gm4303
  gRNA
ggcaaauuccaugacuacca

SEQ ID NO: 21402 - RNA, 20 nt, Artificial Sequence
  MKO10021402_A_Gm4303
  gRNA
uguacucucucauagccuuc

SEQ ID NO: 21403 - RNA, 20 nt, Artificial Sequence
  MKO10021403_A_Gm4305
  gRNA
uauccugauaauaauccagc

SEQ ID NO: 21404 - RNA, 20 nt, Artificial Sequence
  MKO10021404_A_Gm4305
  gRNA
ggcaaauuccaugacuacca

SEQ ID NO: 21405 - RNA, 20 nt, Artificial Sequence
  MKO10021405_A_Gm4305
  gRNA
uguacucucucauagccuuc

SEQ ID NO: 21406 - RNA, 20 nt, Artificial Sequence
  MKO10021406_A_Gm4307
  gRNA
uauccugauaauaauccagc

SEQ ID NO: 21407 - RNA, 20 nt, Artificial Sequence
  MKO10021407_A_Gm4307
  gRNA
ggcaaauuccaugacuacca

SEQ ID NO: 21408 - RNA, 20 nt, Artificial Sequence
  MKO10021408_A_Gm4307
  gRNA
uguacucucucauagccuuc

SEQ ID NO: 21409 - RNA, 20 nt, Artificial Sequence
  MKO10021409_A_Gm4312
  gRNA
gcuuugcucaguuguuuagc

SEQ ID NO: 21410 - RNA, 20 nt, Artificial Sequence
  MKO10021410_A_Gm4312
  gRNA
aaucagguaccuuggauaca

SEQ ID NO: 21411 - RNA, 20 nt, Artificial Sequence
  MKO10021411_A_Gm4312
  gRNA
uguacucucucauagccuuc

SEQ ID NO: 21412 - RNA, 20 nt, Artificial Sequence
  MKO10021412_A_Gm4340
  gRNA
aaucagguaccuuggauaca

SEQ ID NO: 21413 - RNA, 20 nt, Artificial Sequence
  MKO10021413_A_Gm4340
  gRNA
cacuugucuggaaguuguuu

SEQ ID NO: 21414 - RNA, 20 nt, Artificial Sequence
  MKO10021414_A_Gm4340
  gRNA
uguucagucgaagcugugaa

SEQ ID NO: 21415 - RNA, 20 nt, Artificial Sequence
  MKO10021415_A_Gm436
  gRNA
gagacuagggguacugacca

SEQ ID NO: 21416 - RNA, 20 nt, Artificial Sequence
  MKO10021416_A_Gm436
  gRNA
gaugaugccccuccggaguu

SEQ ID NO: 21417 - RNA, 20 nt, Artificial Sequence
  MKO10021417_A_Gm436
  gRNA
cuuauggaguggacccaucu

SEQ ID NO: 21418 - RNA, 20 nt, Artificial Sequence
  MKO10021418_A_Gm438
  gRNA
uauaauaccucgccuguauu

SEQ ID NO: 21419 - RNA, 20 nt, Artificial Sequence
  MKO10021419_A_Gm438
  gRNA
uccaagaucuaauccugaua

SEQ ID NO: 21420 - RNA, 20 nt, Artificial Sequence
  MKO10021420_A_Gm438
  gRNA
uuggcaugcuuguuaagacc

SEQ ID NO: 21421 - RNA, 20 nt, Artificial Sequence
  MKO10021421_A_Gm4461
  gRNA
uuccuuucuacucaccguca

SEQ ID NO: 21422 - RNA, 20 nt, Artificial Sequence
  MKO10021422_A_Gm4461
  gRNA
guagcggucauagcccauga

SEQ ID NO: 21423 - RNA, 20 nt, Artificial Sequence
  MKO10021423_A_Gm4461
  gRNA
caagaugguaacuacaauga

SEQ ID NO: 21424 - RNA, 20 nt, Artificial Sequence
  MKO10021424_A_Gm4477
  gRNA
gcaguugcuucuucugcaag

SEQ ID NO: 21425 - RNA, 20 nt, Artificial Sequence
  MKO10021425_A_Gm4477
  gRNA
gugagaacucauguagguuc

SEQ ID NO: 21426 - RNA, 20 nt, Artificial Sequence
  MKO10021426_A_Gm4477
  gRNA
uuaucauauccgaaaauacc

SEQ ID NO: 21427 - RNA, 20 nt, Artificial Sequence
  MKO10021427_A_Gm4498
  gRNA
uaaauccgugaaaaccacug

SEQ ID NO: 21428 - RNA, 20 nt, Artificial Sequence
  MKO10021428_A_Gm4498
  gRNA
cauuugaagagcagagaaca

SEQ ID NO: 21429 - RNA, 20 nt, Artificial Sequence
  MKO10021429_A_Gm4498
  gRNA
guuauucuuguuacaguugu

SEQ ID NO: 21430 - RNA, 20 nt, Artificial Sequence
  MKO10021430_A_Gm44
  gRNA
ugauaagaucauacacucgc

SEQ ID NO: 21431 - RNA, 20 nt, Artificial Sequence
  MKO10021431_A_Gm44
  gRNA
ccgugccagaaauuaugcuc

SEQ ID NO: 21432 - RNA, 20 nt, Artificial Sequence
  MKO10021432_A_Gm44
  gRNA
ccaagauauucugacccaaa

SEQ ID NO: 21433 - RNA, 20 nt, Artificial Sequence
  MKO10021433_A_Gm4559
  gRNA
gcagcagcuagauugacagc

SEQ ID NO: 21434 - RNA, 20 nt, Artificial Sequence
  MKO10021434_A_Gm4559
  gRNA
cccugcuguucaucagccug

SEQ ID NO: 21435 - RNA, 20 nt, Artificial Sequence
  MKO10021435_A_Gm4559
  gRNA
cccgcaggcugaugaacagc

SEQ ID NO: 21436 - RNA, 20 nt, Artificial Sequence
  MKO10021436_A_Gm4567
  gRNA
agagggccugaugacggagc

SEQ ID NO: 21437 - RNA, 20 nt, Artificial Sequence
  MKO10021437_A_Gm4567
  gRNA
ucaugguccugacaaugcug

SEQ ID NO: 21438 - RNA, 20 nt, Artificial Sequence
  MKO10021438_A_Gm4567
  gRNA
uagaggagagcgagacucga

SEQ ID NO: 21439 - RNA, 20 nt, Artificial Sequence
  MKO10021439_A_Gm4724
  gRNA
cgugcaugugaacuucacuc

SEQ ID NO: 21440 - RNA, 20 nt, Artificial Sequence
  MKO10021440_A_Gm4724
  gRNA
uauagcugugagauucuuau

SEQ ID NO: 21441 - RNA, 20 nt, Artificial Sequence
  MKO10021441_A_Gm4724
  gRNA
acuggguuuagguuacauuu

SEQ ID NO: 21442 - RNA, 20 nt, Artificial Sequence
  MKO10021442_A_Gm4736
  gRNA
gagacgcacagggucccccu

SEQ ID NO: 21443 - RNA, 20 nt, Artificial Sequence
  MKO10021443_A_Gm4736
  gRNA
ggacccugugcgucucccug

SEQ ID NO: 21444 - RNA, 20 nt, Artificial Sequence
  MKO10021444_A_Gm4736
  gRNA
ccagcaaggcccacccccgc

SEQ ID NO: 21445 - RNA, 20 nt, Artificial Sequence
  MKO10021445_A_Gm4745
  gRNA
ugaugagugccaguacccaa

SEQ ID NO: 21446 - RNA, 20 nt, Artificial Sequence
  MKO10021446_A_Gm4745
  gRNA
guggagcuggcuguauugau

SEQ ID NO: 21447 - RNA, 20 nt, Artificial Sequence
  MKO10021447_A_Gm4745
  gRNA
aaguucuuugccaguucuug

SEQ ID NO: 21448 - RNA, 20 nt, Artificial Sequence
  MKO10021448_A_Gm4763
  gRNA
aaugcuugcgacuacacgug

SEQ ID NO: 21449 - RNA, 20 nt, Artificial Sequence
  MKO10021449_A_Gm4763
  gRNA
ccccgaaagugcaaacagac

SEQ ID NO: 21450 - RNA, 20 nt, Artificial Sequence
  MKO10021450_A_Gm4763
  gRNA
agaggacaaauuugguaugc

SEQ ID NO: 21451 - RNA, 20 nt, Artificial Sequence
  MKO10021451_A_Gm4787
  gRNA
ucgcgcgugcugcguguauu

SEQ ID NO: 21452 - RNA, 20 nt, Artificial Sequence
  MKO10021452_A_Gm4787
  gRNA
auacaaaacguuccucguug

SEQ ID NO: 21453 - RNA, 20 nt, Artificial Sequence
  MKO10021453_A_Gm4787
  gRNA
cucuucagaggguuaguuau

SEQ ID NO: 21454 - RNA, 20 nt, Artificial Sequence
  MKO10021454_A_Gm4788
  gRNA
agaauggacaaucugcauac

SEQ ID NO: 21455 - RNA, 20 nt, Artificial Sequence
  MKO10021455_A_Gm4788
  gRNA
cuuuccacugcuaaagggga

SEQ ID NO: 21456 - RNA, 20 nt, Artificial Sequence
  MKO10021456_A_Gm4788
  gRNA
aacauccuauagauguaaac

SEQ ID NO: 21457 - RNA, 20 nt, Artificial Sequence
  MKO10021457_A_Gm4791
  gRNA
gccuaaugagggacgaagcc

SEQ ID NO: 21458 - RNA, 20 nt, Artificial Sequence
  MKO10021458_A_Gm4791
  gRNA
ucagcagucuacauaucccc

SEQ ID NO: 21459 - RNA, 20 nt, Artificial Sequence
  MKO10021459_A_Gm4791
  gRNA
auggacuucagaagagccac

SEQ ID NO: 21460 - RNA, 20 nt, Artificial Sequence
  MKO10021460_A_Gm4794
  gRNA
acgggagcuuuccuucgcaa

SEQ ID NO: 21461 - RNA, 20 nt, Artificial Sequence
  MKO10021461_A_Gm4794
  gRNA
gauucgaggggauggcauuu

SEQ ID NO: 21462 - RNA, 20 nt, Artificial Sequence
  MKO10021462_A_Gm4794
  gRNA
uuugugaauauuguacucaa

SEQ ID NO: 21463 - RNA, 20 nt, Artificial Sequence
  MKO10021463_A_Gm4832
  gRNA
ucaugaacuuccugguccga

SEQ ID NO: 21464 - RNA, 20 nt, Artificial Sequence
  MKO10021464_A_Gm4832
  gRNA
ggcacaacgaaggccaauga

SEQ ID NO: 21465 - RNA, 20 nt, Artificial Sequence
  MKO10021465_A_Gm4832
  gRNA
augugccuuaccacugaguu

SEQ ID NO: 21466 - RNA, 20 nt, Artificial Sequence
  MKO10021466_A_Gm4836
  gRNA
auaguaaagaggccagcauu

SEQ ID NO: 21467 - RNA, 20 nt, Artificial Sequence
  MKO10021467_A_Gm4836
  gRNA
ucuucaucugcuucuacgug

SEQ ID NO: 21468 - RNA, 20 nt, Artificial Sequence
  MKO10021468_A_Gm4836
  gRNA
agaugaacaagacaguaugu

SEQ ID NO: 21469 - RNA, 20 nt, Artificial Sequence
  MKO10021469_A_Gm4841
  gRNA
aaugaguuugagccgcuuua

SEQ ID NO: 21470 - RNA, 20 nt, Artificial Sequence
  MKO10021470_A_Gm4841
  gRNA
ccaaaccacguaacuuuaac

SEQ ID NO: 21471 - RNA, 20 nt, Artificial Sequence
  MKO10021471_A_Gm4841
  gRNA
caucuucagccacuguaucc

SEQ ID NO: 21472 - RNA, 20 nt, Artificial Sequence
  MKO10021472_A_Gm4846
  gRNA
ggugaagagugcgaugucca

SEQ ID NO: 21473 - RNA, 20 nt, Artificial Sequence
  MKO10021473_A_Gm4846
  gRNA
acgucccucgucuugugcug

SEQ ID NO: 21474 - RNA, 20 nt, Artificial Sequence
  MKO10021474_A_Gm4846
  gRNA
agaguugucgugauuggcau

SEQ ID NO: 21475 - RNA, 20 nt, Artificial Sequence
  MKO10021475_A_Gm4847
  gRNA
uguaggcagcagcccguaau

SEQ ID NO: 21476 - RNA, 20 nt, Artificial Sequence
  MKO10021476_A_Gm4847
  gRNA
gaucagcagggucgcugacc

SEQ ID NO: 21477 - RNA, 20 nt, Artificial Sequence
  MKO10021477_A_Gm4847
  gRNA
ggaugugguaguagagaccg

SEQ ID NO: 21478 - RNA, 20 nt, Artificial Sequence
  MKO10021478_A_Gm4858
  gRNA
ugcgcauuggaagaugacgu

SEQ ID NO: 21479 - RNA, 20 nt, Artificial Sequence
  MKO10021479_A_Gm4858
  gRNA
cuucaggguggaugucaaug

SEQ ID NO: 21480 - RNA, 20 nt, Artificial Sequence
  MKO10021480_A_Gm4858
  gRNA
uguagcacaauuucuguuca

SEQ ID NO: 21481 - RNA, 20 nt, Artificial Sequence
  MKO10021481_A_Gm4861
  gRNA
uucugugguucucgaccagc

SEQ ID NO: 21482 - RNA, 20 nt, Artificial Sequence
  MKO10021482_A_Gm4861
  gRNA
gacuagaguaaagaccagcg

SEQ ID NO: 21483 - RNA, 20 nt, Artificial Sequence
  MKO10021483_A_Gm4861
  gRNA
agaacuggaucuaucauaua

SEQ ID NO: 21484 - RNA, 20 nt, Artificial Sequence
  MKO10021484_A_Gm4871
  gRNA
cagugccauauucaacuuuc

SEQ ID NO: 21485 - RNA, 20 nt, Artificial Sequence
  MKO10021485_A_Gm4871
  gRNA
uugcucgcagucaggcugga

SEQ ID NO: 21486 - RNA, 20 nt, Artificial Sequence
  MKO10021486_A_Gm4871
  gRNA
cuaucuuacacugugcaauu

SEQ ID NO: 21487 - RNA, 20 nt, Artificial Sequence
  MKO10021487_A_Gm4884
  gRNA
caccaguggccucuuugacc

SEQ ID NO: 21488 - RNA, 20 nt, Artificial Sequence
  MKO10021488_A_Gm4884
  gRNA
acaagguaccaucaccuccc

SEQ ID NO: 21489 - RNA, 20 nt, Artificial Sequence
  MKO10021489_A_Gm4884
  gRNA
agcaacuccaaacagccugc

SEQ ID NO: 21490 - RNA, 20 nt, Artificial Sequence
  MKO10021490_A_Gm4894
  gRNA
accaacuaccuaaacugacg

SEQ ID NO: 21491 - RNA, 20 nt, Artificial Sequence
  MKO10021491_A_Gm4894
  gRNA
gaagagccccucgucaguuu

SEQ ID NO: 21492 - RNA, 20 nt, Artificial Sequence
  MKO10021492_A_Gm4894
  gRNA
cagucauuuaucaugcaucu

SEQ ID NO: 21493 - RNA, 20 nt, Artificial Sequence
  MKO10021493_A_Gm4906
  gRNA
aguacucgagcacacuaucg

SEQ ID NO: 21494 - RNA, 20 nt, Artificial Sequence
  MKO10021494_A_Gm4906
  gRNA
cgaccggaaugauuucccuc

SEQ ID NO: 21495 - RNA, 20 nt, Artificial Sequence
  MKO10021495_A_Gm4906
  gRNA
ucaaacacugauguagcacc

SEQ ID NO: 21496 - RNA, 20 nt, Artificial Sequence
  MKO10021496_A_Gm4907
  gRNA
caucauauucuuacacugcg

SEQ ID NO: 21497 - RNA, 20 nt, Artificial Sequence
  MKO10021497_A_Gm4907
  gRNA
gaucgccaagcugaaaucag

SEQ ID NO: 21498 - RNA, 20 nt, Artificial Sequence
  MKO10021498_A_Gm4907
  gRNA
gacaaggugcacaacccagc

SEQ ID NO: 21499 - RNA, 20 nt, Artificial Sequence
  MKO10021499_A_Gm4922
  gRNA
uugcguuuguugccaauaac

SEQ ID NO: 21500 - RNA, 20 nt, Artificial Sequence
  MKO10021500_A_Gm4922
  gRNA
acagcuacauaaucgagucc

SEQ ID NO: 21501 - RNA, 20 nt, Artificial Sequence
  MKO10021501_A_Gm4922
  gRNA
acgugcagcaacacaauguc

SEQ ID NO: 21502 - RNA, 20 nt, Artificial Sequence
  MKO10021502_A_Gm4925
  gRNA
ccaccuacgagggcguugga

SEQ ID NO: 21503 - RNA, 20 nt, Artificial Sequence
  MKO10021503_A_Gm4925
  gRNA
ucguuauuauuacguaaccc

SEQ ID NO: 21504 - RNA, 20 nt, Artificial Sequence
  MKO10021504_A_Gm4925
  gRNA
cgucaauacggcuuugcaag

SEQ ID NO: 21505 - RNA, 20 nt, Artificial Sequence
  MKO10021505_A_Gm4937
  gRNA
gaaaaagugccaucgccaaa

SEQ ID NO: 21506 - RNA, 20 nt, Artificial Sequence
  MKO10021506_A_Gm4937
  gRNA
uguuaccaauacaaauacga

SEQ ID NO: 21507 - RNA, 20 nt, Artificial Sequence
  MKO10021507_A_Gm4937
  gRNA
cuucccaucuuccgaauguc

SEQ ID NO: 21508 - RNA, 20 nt, Artificial Sequence
  MKO10021508_A_Gm4944
  gRNA
ugucaucggauuauucauac

SEQ ID NO: 21509 - RNA, 20 nt, Artificial Sequence
  MKO10021509_A_Gm4944
  gRNA
aauccgaugacaccugagcc

SEQ ID NO: 21510 - RNA, 20 nt, Artificial Sequence
  MKO10021510_A_Gm4944
  gRNA
acagggucaguuaacguuca

SEQ ID NO: 21511 - RNA, 20 nt, Artificial Sequence
  MKO10021511_A_Gm4951
  gRNA
gucaacuguucucuucacgu

SEQ ID NO: 21512 - RNA, 20 nt, Artificial Sequence
  MKO10021512_A_Gm4951
  gRNA
ccgcucaauguugcucucac

SEQ ID NO: 21513 - RNA, 20 nt, Artificial Sequence
  MKO10021513_A_Gm4951
  gRNA
aucgaagugaugaucucaug

SEQ ID NO: 21514 - RNA, 20 nt, Artificial Sequence
  MKO10021514_A_Gm4952
  gRNA
ugaccaucuuacccgccgca

SEQ ID NO: 21515 - RNA, 20 nt, Artificial Sequence
  MKO10021515_A_Gm4952
  gRNA
cccggggccugccagauuga

SEQ ID NO: 21516 - RNA, 20 nt, Artificial Sequence
  MKO10021516_A_Gm4952
  gRNA
aggccuugugcccgguaguc

SEQ ID NO: 21517 - RNA, 20 nt, Artificial Sequence
  MKO10021517_A_Gm4975
  gRNA
ucgcuuaaagcuaaauaacu

SEQ ID NO: 21518 - RNA, 20 nt, Artificial Sequence
  MKO10021518_A_Gm4975
  gRNA
ugaaacgagcagucuuucug

SEQ ID NO: 21519 - RNA, 20 nt, Artificial Sequence
  MKO10021519_A_Gm4975
  gRNA
uuccaaauuacauugaugua

SEQ ID NO: 21520 - RNA, 20 nt, Artificial Sequence
  MKO10021520_A_Gm4980
  gRNA
gauggugagguugcgcgcgu

SEQ ID NO: 21521 - RNA, 20 nt, Artificial Sequence
  MKO10021521_A_Gm4980
  gRNA
cugagcgcgcuugagcgcga

SEQ ID NO: 21522 - RNA, 20 nt, Artificial Sequence
  MKO10021522_A_Gm4980
  gRNA
ggccgguccaacaguacgcg

SEQ ID NO: 21523 - RNA, 20 nt, Artificial Sequence
  MKO10021523_A_Gm4981
  gRNA
acaaaagagcucggcgccac

SEQ ID NO: 21524 - RNA, 20 nt, Artificial Sequence
  MKO10021524_A_Gm4981
  gRNA
gacucacuuugucacagcgc

SEQ ID NO: 21525 - RNA, 20 nt, Artificial Sequence
  MKO10021525_A_Gm4981
  gRNA
ggccccaccggacacuugug

SEQ ID NO: 21526 - RNA, 20 nt, Artificial Sequence
  MKO10021526_A_Gm4984
  gRNA
cacgucagcagcgcgugaac

SEQ ID NO: 21527 - RNA, 20 nt, Artificial Sequence
  MKO10021527_A_Gm4984
  gRNA
gcuucaggaaacggcccgcc

SEQ ID NO: 21528 - RNA, 20 nt, Artificial Sequence
  MKO10021528_A_Gm4984
  gRNA
gcaaggaaaguggcggcuua

SEQ ID NO: 21529 - RNA, 20 nt, Artificial Sequence
  MKO10021529_A_Gm5071
  gRNA
uccuguaaguagauuucuca

SEQ ID NO: 21530 - RNA, 20 nt, Artificial Sequence
  MKO10021530_A_Gm5071
  gRNA
cccaugagaaaucuacuuac

SEQ ID NO: 21531 - RNA, 20 nt, Artificial Sequence
  MKO10021531_A_Gm5071
  gRNA
acugcuagcuugggcaugug

SEQ ID NO: 21532 - RNA, 20 nt, Artificial Sequence
  MKO10021532_A_Gm5072
  gRNA
aauggcuagcuaaauguggg

SEQ ID NO: 21533 - RNA, 20 nt, Artificial Sequence
  MKO10021533_A_Gm5072
  gRNA
acaagagcaagagccgaucc

SEQ ID NO: 21534 - RNA, 20 nt, Artificial Sequence
  MKO10021534_A_Gm5072
  gRNA
cugccagaccucuuccucag

SEQ ID NO: 21535 - RNA, 20 nt, Artificial Sequence
  MKO10021535_A_Gm5077
  gRNA
uccaucgaagaacaguuuac

SEQ ID NO: 21536 - RNA, 20 nt, Artificial Sequence
  MKO10021536_A_Gm5077
  gRNA
agcccuccugcaguugaauc

SEQ ID NO: 21537 - RNA, 20 nt, Artificial Sequence
  MKO10021537_A_Gm5077
  gRNA
gguacgccuggggauaguua

SEQ ID NO: 21538 - RNA, 20 nt, Artificial Sequence
  MKO10021538_A_Gm5082
  gRNA
cguccaccccauaauguuau

SEQ ID NO: 21539 - RNA, 20 nt, Artificial Sequence
  MKO10021539_A_Gm5082
  gRNA
uugacaauaugaugaacccg

SEQ ID NO: 21540 - RNA, 20 nt, Artificial Sequence
  MKO10021540_A_Gm5082
  gRNA
cacccaaguccaacagagcc

SEQ ID NO: 21541 - RNA, 20 nt, Artificial Sequence
  MKO10021541_A_Gm5087
  gRNA
auaucagauaaugaaagucc

SEQ ID NO: 21542 - RNA, 20 nt, Artificial Sequence
  MKO10021542_A_Gm5087
  gRNA
uucccuucagugccaccucc

SEQ ID NO: 21543 - RNA, 20 nt, Artificial Sequence
  MKO10021543_A_Gm5087
  gRNA
uuccuggagguggcacugaa

SEQ ID NO: 21544 - RNA, 20 nt, Artificial Sequence
  MKO10021544_A_Gm5108
  gRNA
acuuacugcaagacuuguug

SEQ ID NO: 21545 - RNA, 20 nt, Artificial Sequence
  MKO10021545_A_Gm5108
  gRNA
agccagagaauaucagaacg

SEQ ID NO: 21546 - RNA, 20 nt, Artificial Sequence
  MKO10021546_A_Gm5108
  gRNA
cauuaccauacaacuucacu

SEQ ID NO: 21547 - RNA, 20 nt, Artificial Sequence
  MKO10021547_A_Gm5111
  gRNA
aucgauaaucuucgcauuca

SEQ ID NO: 21548 - RNA, 20 nt, Artificial Sequence
  MKO10021548_A_Gm5111
  gRNA
ccaucuaagaugcuaaccau

SEQ ID NO: 21549 - RNA, 20 nt, Artificial Sequence
  MKO10021549_A_Gm5111
  gRNA
uggaacucaagaggcaugcg

SEQ ID NO: 21550 - RNA, 20 nt, Artificial Sequence
  MKO10021550_A_Gm5113
  gRNA
agucggaaugaacucgguag

SEQ ID NO: 21551 - RNA, 20 nt, Artificial Sequence
  MKO10021551_A_Gm5113
  gRNA
acuaccgaguucauuccgac

SEQ ID NO: 21552 - RNA, 20 nt, Artificial Sequence
  MKO10021552_A_Gm5113
  gRNA
gagcugcgcaugcugucuga

SEQ ID NO: 21553 - RNA, 20 nt, Artificial Sequence
  MKO10021553_A_Gm5114
  gRNA
ccaaauucuccaguuaucag

SEQ ID NO: 21554 - RNA, 20 nt, Artificial Sequence
  MKO10021554_A_Gm5114
  gRNA
cuuguguccagcuccaagcc

SEQ ID NO: 21555 - RNA, 20 nt, Artificial Sequence
  MKO10021555_A_Gm5114
  gRNA
acuguuguaguaacugagcu

SEQ ID NO: 21556 - RNA, 20 nt, Artificial Sequence
  MKO10021556_A_Gm5127
  gRNA
cuaucucagcaugcgugaua

SEQ ID NO: 21557 - RNA, 20 nt, Artificial Sequence
  MKO10021557_A_Gm5127
  gRNA
gcuaccaauaaacaccgcag

SEQ ID NO: 21558 - RNA, 20 nt, Artificial Sequence
  MKO10021558_A_Gm5127
  gRNA
uugccuaugaaugccaagau

SEQ ID NO: 21559 - RNA, 20 nt, Artificial Sequence
  MKO10021559_A_Gm5128
  gRNA
cuuaccuaguagcugaguuc

SEQ ID NO: 21560 - RNA, 20 nt, Artificial Sequence
  MKO10021560_A_Gm5128
  gRNA
guucauuaugauggacacca

SEQ ID NO: 21561 - RNA, 20 nt, Artificial Sequence
  MKO10021561_A_Gm5128
  gRNA
caguuucaagaugaucugug

SEQ ID NO: 21562 - RNA, 20 nt, Artificial Sequence
  MKO10021562_A_Gm5132
  gRNA
aggcaucauccguuguuauc

SEQ ID NO: 21563 - RNA, 20 nt, Artificial Sequence
  MKO10021563_A_Gm5132
  gRNA
ccaccagaaccugauaacaa

SEQ ID NO: 21564 - RNA, 20 nt, Artificial Sequence
  MKO10021564_A_Gm5132
  gRNA
aacaucgaacauccuugaac

SEQ ID NO: 21565 - RNA, 20 nt, Artificial Sequence
  MKO10021565_A_Gm5134
  gRNA
uugaccgugcugacgaucau

SEQ ID NO: 21566 - RNA, 20 nt, Artificial Sequence
  MKO10021566_A_Gm5134
  gRNA
cagcggccacuauauggccc

SEQ ID NO: 21567 - RNA, 20 nt, Artificial Sequence
  MKO10021567_A_Gm5134
  gRNA
caugccgaugaucgucagca

SEQ ID NO: 21568 - RNA, 20 nt, Artificial Sequence
  MKO10021568_A_Gm5136
  gRNA
guacgcacgucgacaugaga

SEQ ID NO: 21569 - RNA, 20 nt, Artificial Sequence
  MKO10021569_A_Gm5136
  gRNA
ucaugucgacgugcguacac

SEQ ID NO: 21570 - RNA, 20 nt, Artificial Sequence
  MKO10021570_A_Gm5136
  gRNA
uaaccguucugccucuaucg

SEQ ID NO: 21571 - RNA, 20 nt, Artificial Sequence
  MKO10021571_A_Gm5141
  gRNA
cacacgcucaccauuucgcc

SEQ ID NO: 21572 - RNA, 20 nt, Artificial Sequence
  MKO10021572_A_Gm5141
  gRNA
uaaaccaguuaccuuaucaa

SEQ ID NO: 21573 - RNA, 20 nt, Artificial Sequence
  MKO10021573_A_Gm5141
  gRNA
caugucccagucuucuuaaa

SEQ ID NO: 21574 - RNA, 20 nt, Artificial Sequence
  MKO10021574_A_Gm5142
  gRNA
ucgcaacccguuuccucccc

SEQ ID NO: 21575 - RNA, 20 nt, Artificial Sequence
  MKO10021575_A_Gm5142
  gRNA
uccuuucuguuucgcgucug

SEQ ID NO: 21576 - RNA, 20 nt, Artificial Sequence
  MKO10021576_A_Gm5142
  gRNA
ucuuguagucuuagcauuuc

SEQ ID NO: 21577 - RNA, 20 nt, Artificial Sequence
  MKO10021577_A_Gm5148
  gRNA
gcauuccaccaugucuuaug

SEQ ID NO: 21578 - RNA, 20 nt, Artificial Sequence
  MKO10021578_A_Gm5148
  gRNA
gugagacuccacauaagaca

SEQ ID NO: 21579 - RNA, 20 nt, Artificial Sequence
  MKO10021579_A_Gm5148
  gRNA
aaugcuuucucuugggcccg

SEQ ID NO: 21580 - RNA, 20 nt, Artificial Sequence
  MKO10021580_A_Gm514
  gRNA
gcccuccugcaccgcuuccg

SEQ ID NO: 21581 - RNA, 20 nt, Artificial Sequence
  MKO10021581_A_Gm514
  gRNA
cuuccagcaagaccggauca

SEQ ID NO: 21582 - RNA, 20 nt, Artificial Sequence
  MKO10021582_A_Gm514
  gRNA
gagcagcgacgauggcuugu

SEQ ID NO: 21583 - RNA, 20 nt, Artificial Sequence
  MKO10021583_A_Gm5150
  gRNA
agcaauugccagcaguaguu

SEQ ID NO: 21584 - RNA, 20 nt, Artificial Sequence
  MKO10021584_A_Gm5150
  gRNA
gcaggacacugugaugaauc

SEQ ID NO: 21585 - RNA, 20 nt, Artificial Sequence
  MKO10021585_A_Gm5150
  gRNA
ggcacugaguuguuuguccu

SEQ ID NO: 21586 - RNA, 20 nt, Artificial Sequence
  MKO10021586_A_Gm5168
  gRNA
uagaagaagaugaagauaua

SEQ ID NO: 21587 - RNA, 20 nt, Artificial Sequence
  MKO10021587_A_Gm5168
  gRNA
ucuucaucuucuucuacgug

SEQ ID NO: 21588 - RNA, 20 nt, Artificial Sequence
  MKO10021588_A_Gm5168
  gRNA
agaugaacaagacaguaugu

SEQ ID NO: 21589 - RNA, 20 nt, Artificial Sequence
  MKO10021589_A_Gm5169
  gRNA
uucucauguuugccauaugc

SEQ ID NO: 21590 - RNA, 20 nt, Artificial Sequence
  MKO10021590_A_Gm5169
  gRNA
auaguaaagaggccagcaua

SEQ ID NO: 21591 - RNA, 20 nt, Artificial Sequence
  MKO10021591_A_Gm5169
  gRNA
agaugaacaagacaguaugu

SEQ ID NO: 21592 - RNA, 20 nt, Artificial Sequence
  MKO10021592_A_Gm525
  gRNA
cucacccgcaugggcucguc

SEQ ID NO: 21593 - RNA, 20 nt, Artificial Sequence
  MKO10021593_A_Gm525
  gRNA
auucccggacgagcccaugc

SEQ ID NO: 21594 - RNA, 20 nt, Artificial Sequence
  MKO10021594_A_Gm525
  gRNA
acugcaagccgcacugugac

SEQ ID NO: 21595 - RNA, 20 nt, Artificial Sequence
  MKO10021595_A_Gm527
  gRNA
aaacuugauacgacuggcug

SEQ ID NO: 21596 - RNA, 20 nt, Artificial Sequence
  MKO10021596_A_Gm527
  gRNA
gcacugcccuacccgagugc

SEQ ID NO: 21597 - RNA, 20 nt, Artificial Sequence
  MKO10021597_A_Gm527
  gRNA
ggcauauguacccuauuacu

SEQ ID NO: 21598 - RNA, 20 nt, Artificial Sequence
  MKO10021598_A_Gm5294
  gRNA
gcgggccgcguaacccuauc

SEQ ID NO: 21599 - RNA, 20 nt, Artificial Sequence
  MKO10021599_A_Gm5294
  gRNA
cgcugguuggcgcgguaaua

SEQ ID NO: 21600 - RNA, 20 nt, Artificial Sequence
  MKO10021600_A_Gm5294
  gRNA
acccgcgcgcuguugguucg

SEQ ID NO: 21601 - RNA, 20 nt, Artificial Sequence
  MKO10021601_A_Gm5346
  gRNA
uacugauucguuaucauauc

SEQ ID NO: 21602 - RNA, 20 nt, Artificial Sequence
  MKO10021602_A_Gm5346
  gRNA
cccuagaugcauucuguagu

SEQ ID NO: 21603 - RNA, 20 nt, Artificial Sequence
  MKO10021603_A_Gm5346
  gRNA
ucggugccagaaucagauuc

SEQ ID NO: 21604 - RNA, 20 nt, Artificial Sequence
  MKO10021604_A_Gm5347
  gRNA
aaccugaugccgaccaagug

SEQ ID NO: 21605 - RNA, 20 nt, Artificial Sequence
  MKO10021605_A_Gm5347
  gRNA
uccaauuacagaaugcaccu

SEQ ID NO: 21606 - RNA, 20 nt, Artificial Sequence
  MKO10021606_A_Gm5347
  gRNA
uugccuagcaagaggaaauc

SEQ ID NO: 21607 - RNA, 20 nt, Artificial Sequence
  MKO10021607_A_Gm5382
  gRNA
agcuacgcacuuccugccag

SEQ ID NO: 21608 - RNA, 20 nt, Artificial Sequence
  MKO10021608_A_Gm5382
  gRNA
caggaagugcguagcuccag

SEQ ID NO: 21609 - RNA, 20 nt, Artificial Sequence
  MKO10021609_A_Gm5382
  gRNA
auggaagugcggaagaacuc

SEQ ID NO: 21610 - RNA, 20 nt, Artificial Sequence
  MKO10021610_A_Gm5409
  gRNA
agagcacaacauuaaugucc

SEQ ID NO: 21611 - RNA, 20 nt, Artificial Sequence
  MKO10021611_A_Gm5409
  gRNA
cugagugccagcaagugcac

SEQ ID NO: 21612 - RNA, 20 nt, Artificial Sequence
  MKO10021612_A_Gm5409
  gRNA
gaugaugacaggauuguugg

SEQ ID NO: 21613 - RNA, 20 nt, Artificial Sequence
  MKO10021613_A_Gm5414
  gRNA
ugaagcccagccgucuugaa

SEQ ID NO: 21614 - RNA, 20 nt, Artificial Sequence
  MKO10021614_A_Gm5414
  gRNA
uagaugagaucaacuucuug

SEQ ID NO: 21615 - RNA, 20 nt, Artificial Sequence
  MKO10021615_A_Gm5414
  gRNA
caacaaccacagcuuggaca

SEQ ID NO: 21616 - RNA, 20 nt, Artificial Sequence
  MKO10021616_A_Gm5415
  gRNA
gccuggugguaaucgauuua

SEQ ID NO: 21617 - RNA, 20 nt, Artificial Sequence
  MKO10021617_A_Gm5415
  gRNA
ugcuauagaacaguuuagua

SEQ ID NO: 21618 - RNA, 20 nt, Artificial Sequence
  MKO10021618_A_Gm5415
  gRNA
guggguguuguuacaguaac

SEQ ID NO: 21619 - RNA, 20 nt, Artificial Sequence
  MKO10021619_A_Gm5416
  gRNA
aaagucuaccgugcacauuc

SEQ ID NO: 21620 - RNA, 20 nt, Artificial Sequence
  MKO10021620_A_Gm5416
  gRNA
cucaucaagaugauucucgg

SEQ ID NO: 21621 - RNA, 20 nt, Artificial Sequence
  MKO10021621_A_Gm5416
  gRNA
guaggucaacucaucagucu

SEQ ID NO: 21622 - RNA, 20 nt, Artificial Sequence
  MKO10021622_A_Gm5431
  gRNA
uuacugagacugccauugac

SEQ ID NO: 21623 - RNA, 20 nt, Artificial Sequence
  MKO10021623_A_Gm5431
  gRNA
guauggaccaccauuccacu

SEQ ID NO: 21624 - RNA, 20 nt, Artificial Sequence
  MKO10021624_A_Gm5431
  gRNA
auaugcugaaacaaaagauc

SEQ ID NO: 21625 - RNA, 20 nt, Artificial Sequence
  MKO10021625_A_Gm5458
  gRNA
caugugugucucaagugcca

SEQ ID NO: 21626 - RNA, 20 nt, Artificial Sequence
  MKO10021626_A_Gm5458
  gRNA
ugagacacacauguucuugc

SEQ ID NO: 21627 - RNA, 20 nt, Artificial Sequence
  MKO10021627_A_Gm5458
  gRNA
uaaaguuagagaauugaaau

SEQ ID NO: 21628 - RNA, 20 nt, Artificial Sequence
  MKO10021628_A_Gm5460
  gRNA
gaaugacucaccguugguug

SEQ ID NO: 21629 - RNA, 20 nt, Artificial Sequence
  MKO10021629_A_Gm5460
  gRNA
ggcgcccagugaccggugcu

SEQ ID NO: 21630 - RNA, 20 nt, Artificial Sequence
  MKO10021630_A_Gm5460
  gRNA
ugucugagagguccgcugca

SEQ ID NO: 21631 - RNA, 20 nt, Artificial Sequence
  MKO10021631_A_Gm5464
  gRNA
guaccgaagccccuccgucg

SEQ ID NO: 21632 - RNA, 20 nt, Artificial Sequence
  MKO10021632_A_Gm5464
  gRNA
ucgcgcgcucgccgucagcg

SEQ ID NO: 21633 - RNA, 20 nt, Artificial Sequence
  MKO10021633_A_Gm5464
  gRNA
ggaggccgcgcuugaugagc

SEQ ID NO: 21634 - RNA, 20 nt, Artificial Sequence
  MKO10021634_A_Gm5483
  gRNA
guaggacagcucgucuuucc

SEQ ID NO: 21635 - RNA, 20 nt, Artificial Sequence
  MKO10021635_A_Gm5483
  gRNA
ucccuuugaagaccuuuaug

SEQ ID NO: 21636 - RNA, 20 nt, Artificial Sequence
  MKO10021636_A_Gm5483
  gRNA
ucaccuuaucagcaaucucc

SEQ ID NO: 21637 - RNA, 20 nt, Artificial Sequence
  MKO10021637_A_Gm5506
  gRNA
gccagaccuguagaauucag

SEQ ID NO: 21638 - RNA, 20 nt, Artificial Sequence
  MKO10021638_A_Gm5506
  gRNA
gguccaugcuuuauuuggcc

SEQ ID NO: 21639 - RNA, 20 nt, Artificial Sequence
  MKO10021639_A_Gm5506
  gRNA
aauucgccaugucuauucuc

SEQ ID NO: 21640 - RNA, 20 nt, Artificial Sequence
  MKO10021640_A_Gm5531
  gRNA
uucauccuccucgcccucga

SEQ ID NO: 21641 - RNA, 20 nt, Artificial Sequence
  MKO10021641_A_Gm5531
  gRNA
ugacgucugcacaaccaucg

SEQ ID NO: 21642 - RNA, 20 nt, Artificial Sequence
  MKO10021642_A_Gm5531
  gRNA
ucauaagcaagaacgugcua

SEQ ID NO: 21643 - RNA, 20 nt, Artificial Sequence
  MKO10021643_A_Gm5535
  gRNA
aagacuccgucgcccuuucc

SEQ ID NO: 21644 - RNA, 20 nt, Artificial Sequence
  MKO10021644_A_Gm5535
  gRNA
ugaucuguaucucgggagcc

SEQ ID NO: 21645 - RNA, 20 nt, Artificial Sequence
  MKO10021645_A_Gm5535
  gRNA
uagcuuacaaucagccaugc

SEQ ID NO: 21646 - RNA, 20 nt, Artificial Sequence
  MKO10021646_A_Gm5538
  gRNA
agacaguugcggagguacac

SEQ ID NO: 21647 - RNA, 20 nt, Artificial Sequence
  MKO10021647_A_Gm5538
  gRNA
agccugcuauccaaaagugc

SEQ ID NO: 21648 - RNA, 20 nt, Artificial Sequence
  MKO10021648_A_Gm5538
  gRNA
cauguaucccgucuucuaug

SEQ ID NO: 21649 - RNA, 20 nt, Artificial Sequence
  MKO10021649_A_Gm5544
  gRNA
aaggggucuccgaaaaccua

SEQ ID NO: 21650 - RNA, 20 nt, Artificial Sequence
  MKO10021650_A_Gm5544
  gRNA
aaacucgauaguuaagcuuc

SEQ ID NO: 21651 - RNA, 20 nt, Artificial Sequence
  MKO10021651_A_Gm5544
  gRNA
gagaagcgucauaugucaag

SEQ ID NO: 21652 - RNA, 20 nt, Artificial Sequence
  MKO10021652_A_Gm5549
  gRNA
ccccucgacgcaugaagcca

SEQ ID NO: 21653 - RNA, 20 nt, Artificial Sequence
  MKO10021653_A_Gm5549
  gRNA
gagcacgagauguguaaaac

SEQ ID NO: 21654 - RNA, 20 nt, Artificial Sequence
  MKO10021654_A_Gm5549
  gRNA
ugaagaggaauauuugcgug

SEQ ID NO: 21655 - RNA, 20 nt, Artificial Sequence
  MKO10021655_A_Gm5591
  gRNA
ucagacgguccaggcaauug

SEQ ID NO: 21656 - RNA, 20 nt, Artificial Sequence
  MKO10021656_A_Gm5591
  gRNA
cuacuacaaccacaauugcc

SEQ ID NO: 21657 - RNA, 20 nt, Artificial Sequence
  MKO10021657_A_Gm5591
  gRNA
cuguugagcacaacucuuca

SEQ ID NO: 21658 - RNA, 20 nt, Artificial Sequence
  MKO10021658_A_Gm5592
  gRNA
caggccucgaggugaccaaa

SEQ ID NO: 21659 - RNA, 20 nt, Artificial Sequence
  MKO10021659_A_Gm5592
  gRNA
uaaagacaucacuagacuug

SEQ ID NO: 21660 - RNA, 20 nt, Artificial Sequence
  MKO10021660_A_Gm5592
  gRNA
caauaugaaacucauugacc

SEQ ID NO: 21661 - RNA, 20 nt, Artificial Sequence
  MKO10021661_A_Gm5595
  gRNA
uucaugcauucgaagauugu

SEQ ID NO: 21662 - RNA, 20 nt, Artificial Sequence
  MKO10021662_A_Gm5595
  gRNA
aggcacgaaagaaguccugc

SEQ ID NO: 21663 - RNA, 20 nt, Artificial Sequence
  MKO10021663_A_Gm5595
  gRNA
augugcauguacacuucacu

SEQ ID NO: 21664 - RNA, 20 nt, Artificial Sequence
  MKO10021664_A_Gm5615
  gRNA
gugcacuuuguucaacucua

SEQ ID NO: 21665 - RNA, 20 nt, Artificial Sequence
  MKO10021665_A_Gm5615
  gRNA
acccuccgcaaagcagauaa

SEQ ID NO: 21666 - RNA, 20 nt, Artificial Sequence
  MKO10021666_A_Gm5615
  gRNA
cuagguggcagguucaugua

SEQ ID NO: 21667 - RNA, 20 nt, Artificial Sequence
  MKO10021667_A_Gm5617
  gRNA
acgucugucggcccgaacgc

SEQ ID NO: 21668 - RNA, 20 nt, Artificial Sequence
  MKO10021668_A_Gm5617
  gRNA
cggacagcgacaccgaguuc

SEQ ID NO: 21669 - RNA, 20 nt, Artificial Sequence
  MKO10021669_A_Gm5617
  gRNA
ccgccggcgaucaagccaac

SEQ ID NO: 21670 - RNA, 20 nt, Artificial Sequence
  MKO10021670_A_Gm561
  gRNA
cguagacaagggacauucgc

SEQ ID NO: 21671 - RNA, 20 nt, Artificial Sequence
  MKO10021671_A_Gm561
  gRNA
augucccuugucuacgcacu

SEQ ID NO: 21672 - RNA, 20 nt, Artificial Sequence
  MKO10021672_A_Gm561
  gRNA
aaacggucgagcuuggugga

SEQ ID NO: 21673 - RNA, 20 nt, Artificial Sequence
  MKO10021673_A_Gm5622
  gRNA
augccaaauuccuucugccu

SEQ ID NO: 21674 - RNA, 20 nt, Artificial Sequence
  MKO10021674_A_Gm5622
  gRNA
agguuauuucacagggagaa

SEQ ID NO: 21675 - RNA, 20 nt, Artificial Sequence
  MKO10021675_A_Gm5622
  gRNA
gauuagugauguugcaacuu

SEQ ID NO: 21676 - RNA, 20 nt, Artificial Sequence
  MKO10021676_A_Gm5634
  gRNA
ccgaagcgcccucucgagug

SEQ ID NO: 21677 - RNA, 20 nt, Artificial Sequence
  MKO10021677_A_Gm5634
  gRNA
acaggcugagcuugucaaag

SEQ ID NO: 21678 - RNA, 20 nt, Artificial Sequence
  MKO10021678_A_Gm5634
  gRNA
gcaaaacugccuagaucagc

SEQ ID NO: 21679 - RNA, 20 nt, Artificial Sequence
  MKO10021679_A_Gm5635
  gRNA
cgagaccagaacgcaacaac

SEQ ID NO: 21680 - RNA, 20 nt, Artificial Sequence
  MKO10021680_A_Gm5635
  gRNA
ccgugccaguuguugcguuc

SEQ ID NO: 21681 - RNA, 20 nt, Artificial Sequence
  MKO10021681_A_Gm5635
  gRNA
ugccaucgacauguacucau

SEQ ID NO: 21682 - RNA, 20 nt, Artificial Sequence
  MKO10021682_A_Gm5640
  gRNA
uuuagaucggguacccuucc

SEQ ID NO: 21683 - RNA, 20 nt, Artificial Sequence
  MKO10021683_A_Gm5640
  gRNA
cucccgcgcucugaagugga

SEQ ID NO: 21684 - RNA, 20 nt, Artificial Sequence
  MKO10021684_A_Gm5640
  gRNA
cugauugaagagaagcccca

SEQ ID NO: 21685 - RNA, 20 nt, Artificial Sequence
  MKO10021685_A_Gm5662
  gRNA
uccaucaugccaaagaauaa

SEQ ID NO: 21686 - RNA, 20 nt, Artificial Sequence
  MKO10021686_A_Gm5662
  gRNA
uguguccauuucauugauuu

SEQ ID NO: 21687 - RNA, 20 nt, Artificial Sequence
  MKO10021687_A_Gm5662
  gRNA
acaugccaaaaucaaugaaa

SEQ ID NO: 21688 - RNA, 20 nt, Artificial Sequence
  MKO10021688_A_Gm5725
  gRNA
gcccucuccaugucugcuca

SEQ ID NO: 21689 - RNA, 20 nt, Artificial Sequence
  MKO10021689_A_Gm5725
  gRNA
caguugaagagcacagaaca

SEQ ID NO: 21690 - RNA, 20 nt, Artificial Sequence
  MKO10021690_A_Gm5725
  gRNA
cagagcaagugucacaaaca

SEQ ID NO: 21691 - RNA, 20 nt, Artificial Sequence
  MKO10021691_A_Gm5726
  gRNA
gcccucuccaugucugcuca

SEQ ID NO: 21692 - RNA, 20 nt, Artificial Sequence
  MKO10021692_A_Gm5726
  gRNA
uaguuuaagagcacagaaca

SEQ ID NO: 21693 - RNA, 20 nt, Artificial Sequence
  MKO10021693_A_Gm5726
  gRNA
cagagcaagugucacaaaca

SEQ ID NO: 21694 - RNA, 20 nt, Artificial Sequence
  MKO10021694_A_Gm5728
  gRNA
uaaaucccugaaaagcacug

SEQ ID NO: 21695 - RNA, 20 nt, Artificial Sequence
  MKO10021695_A_Gm5728
  gRNA
caguugaaaagcacagaaca

SEQ ID NO: 21696 - RNA, 20 nt, Artificial Sequence
  MKO10021696_A_Gm5728
  gRNA
aacuuguucuguuccacuuc

SEQ ID NO: 21697 - RNA, 20 nt, Artificial Sequence
  MKO10021697_A_Gm572
  gRNA
gaucccgaguagucacgugc

SEQ ID NO: 21698 - RNA, 20 nt, Artificial Sequence
  MKO10021698_A_Gm572
  gRNA
aaacccugcacgugacuacu

SEQ ID NO: 21699 - RNA, 20 nt, Artificial Sequence
  MKO10021699_A_Gm572
  gRNA
uucugucguaggcucuaaga

SEQ ID NO: 21700 - RNA, 20 nt, Artificial Sequence
  MKO10021700_A_Gm5741
  gRNA
agcaggcaucaaccgcauaa

SEQ ID NO: 21701 - RNA, 20 nt, Artificial Sequence
  MKO10021701_A_Gm5741
  gRNA
cacuggcagugacaucggac

SEQ ID NO: 21702 - RNA, 20 nt, Artificial Sequence
  MKO10021702_A_Gm5741
  gRNA
gcugcaguucugcacugaac

SEQ ID NO: 21703 - RNA, 20 nt, Artificial Sequence
  MKO10021703_A_Gm5771
  gRNA
ucaacaugaugucguuauug

SEQ ID NO: 21704 - RNA, 20 nt, Artificial Sequence
  MKO10021704_A_Gm5771
  gRNA
acgaucuuaucaucauccac

SEQ ID NO: 21705 - RNA, 20 nt, Artificial Sequence
  MKO10021705_A_Gm5771
  gRNA
cccagcuccugugcgccagc

SEQ ID NO: 21706 - RNA, 20 nt, Artificial Sequence
  MKO10021706_A_Gm5795
  gRNA
ucaaauccucauacauguaa

SEQ ID NO: 21707 - RNA, 20 nt, Artificial Sequence
  MKO10021707_A_Gm5795
  gRNA
aagaacugaaauuagauaug

SEQ ID NO: 21708 - RNA, 20 nt, Artificial Sequence
  MKO10021708_A_Gm5795
  gRNA
acaacaugagaagacaaugu

SEQ ID NO: 21709 - RNA, 20 nt, Artificial Sequence
  MKO10021709_A_Gm5796
  gRNA
gucuggccauaaguguccug

SEQ ID NO: 21710 - RNA, 20 nt, Artificial Sequence
  MKO10021710_A_Gm5796
  gRNA
ucaaauccucauacauguaa

SEQ ID NO: 21711 - RNA, 20 nt, Artificial Sequence
  MKO10021711_A_Gm5796
  gRNA
ugaacuagaagaacugaaau

SEQ ID NO: 21712 - RNA, 20 nt, Artificial Sequence
  MKO10021712_A_Gm5797
  gRNA
gagaacugaaauugcauaug

SEQ ID NO: 21713 - RNA, 20 nt, Artificial Sequence
  MKO10021713_A_Gm5797
  gRNA
ccucauacauguaaacguuc

SEQ ID NO: 21714 - RNA, 20 nt, Artificial Sequence
  MKO10021714_A_Gm5797
  gRNA
acaacaugagaagauaaugu

SEQ ID NO: 21715 - RNA, 20 nt, Artificial Sequence
  MKO10021715_A_Gm5800
  gRNA
guaacaagaauuugaaugac

SEQ ID NO: 21716 - RNA, 20 nt, Artificial Sequence
  MKO10021716_A_Gm5800
  gRNA
acauucagucaggaggugac

SEQ ID NO: 21717 - RNA, 20 nt, Artificial Sequence
  MKO10021717_A_Gm5800
  gRNA
caaauucuuguuacaauaau

SEQ ID NO: 21718 - RNA, 20 nt, Artificial Sequence
  MKO10021718_A_Gm5803
  gRNA
aagagcuuccgcaguuguuc

SEQ ID NO: 21719 - RNA, 20 nt, Artificial Sequence
  MKO10021719_A_Gm5803
  gRNA
cugagaaucuugucuugaga

SEQ ID NO: 21720 - RNA, 20 nt, Artificial Sequence
  MKO10021720_A_Gm5803
  gRNA
cagaaauaccauaaugugaa

SEQ ID NO: 21721 - RNA, 20 nt, Artificial Sequence
  MKO10021721_A_Gm5820
  gRNA
ucuguacaguagugccacgu

SEQ ID NO: 21722 - RNA, 20 nt, Artificial Sequence
  MKO10021722_A_Gm5820
  gRNA
uggguuacuuauggaucccu

SEQ ID NO: 21723 - RNA, 20 nt, Artificial Sequence
  MKO10021723_A_Gm5820
  gRNA
guucaacuuuacagcgaacc

SEQ ID NO: 21724 - RNA, 20 nt, Artificial Sequence
  MKO10021724_A_Gm5862
  gRNA
aagcaaaaagcaguuugaga

SEQ ID NO: 21725 - RNA, 20 nt, Artificial Sequence
  MKO10021725_A_Gm5862
  gRNA
caauguauaccucuuguuca

SEQ ID NO: 21726 - RNA, 20 nt, Artificial Sequence
  MKO10021726_A_Gm5862
  gRNA
cuggggccaggcccuaccac

SEQ ID NO: 21727 - RNA, 20 nt, Artificial Sequence
  MKO10021727_A_Gm5868
  gRNA
aacuucccgccucgcuuuau

SEQ ID NO: 21728 - RNA, 20 nt, Artificial Sequence
  MKO10021728_A_Gm5868
  gRNA
ugcagcacucucaucccuau

SEQ ID NO: 21729 - RNA, 20 nt, Artificial Sequence
  MKO10021729_A_Gm5868
  gRNA
uugagaugccccucugccuc

SEQ ID NO: 21730 - RNA, 20 nt, Artificial Sequence
  MKO10021730_A_Gm5878
  gRNA
aauggagagggucgcaaugc

SEQ ID NO: 21731 - RNA, 20 nt, Artificial Sequence
  MKO10021731_A_Gm5878
  gRNA
gaagcgauuccgaagcagcc

SEQ ID NO: 21732 - RNA, 20 nt, Artificial Sequence
  MKO10021732_A_Gm5878
  gRNA
cgagauccuccucuuccucc

SEQ ID NO: 21733 - RNA, 20 nt, Artificial Sequence
  MKO10021733_A_Gm5885
  gRNA
acucguggucggaaaaauuu

SEQ ID NO: 21734 - RNA, 20 nt, Artificial Sequence
  MKO10021734_A_Gm5885
  gRNA
caagagcauugugacuccuc

SEQ ID NO: 21735 - RNA, 20 nt, Artificial Sequence
  MKO10021735_A_Gm5885
  gRNA
uugaacaaugauaauacauc

SEQ ID NO: 21736 - RNA, 20 nt, Artificial Sequence
  MKO10021736_A_Gm5886
  gRNA
aagccauacuucuucgucuc

SEQ ID NO: 21737 - RNA, 20 nt, Artificial Sequence
  MKO10021737_A_Gm5886
  gRNA
acuuucauauguacuacucc

SEQ ID NO: 21738 - RNA, 20 nt, Artificial Sequence
  MKO10021738_A_Gm5886
  gRNA
ucguugaucuaaucauuuga

SEQ ID NO: 21739 - RNA, 20 nt, Artificial Sequence
  MKO10021739_A_Gm5891
  gRNA
agagggucugaugauggagc

SEQ ID NO: 21740 - RNA, 20 nt, Artificial Sequence
  MKO10021740_A_Gm5891
  gRNA
cuucuaugugaugacuguca

SEQ ID NO: 21741 - RNA, 20 nt, Artificial Sequence
  MKO10021741_A_Gm5891
  gRNA
acuagaucgcaucaucaacg

SEQ ID NO: 21742 - RNA, 20 nt, Artificial Sequence
  MKO10021742_A_Gm5901
  gRNA
cugcaggauucgccuacaua

SEQ ID NO: 21743 - RNA, 20 nt, Artificial Sequence
  MKO10021743_A_Gm5901
  gRNA
uagguagugaccgcuguaac

SEQ ID NO: 21744 - RNA, 20 nt, Artificial Sequence
  MKO10021744_A_Gm5901
  gRNA
cagggacauggagugccggu

SEQ ID NO: 21745 - RNA, 20 nt, Artificial Sequence
  MKO10021745_A_Gm590
  gRNA
cccgcauccgcaaccgaccg

SEQ ID NO: 21746 - RNA, 20 nt, Artificial Sequence
  MKO10021746_A_Gm590
  gRNA
agugaccucugcgccucggu

SEQ ID NO: 21747 - RNA, 20 nt, Artificial Sequence
  MKO10021747_A_Gm590
  gRNA
gaguccgaggagcaccgccu

SEQ ID NO: 21748 - RNA, 20 nt, Artificial Sequence
  MKO10021748_A_Gm5916
  gRNA
uacuuccuauucucacaaac

SEQ ID NO: 21749 - RNA, 20 nt, Artificial Sequence
  MKO10021749_A_Gm5916
  gRNA
aggcauguauggcugaaucu

SEQ ID NO: 21750 - RNA, 20 nt, Artificial Sequence
  MKO10021750_A_Gm5916
  gRNA
cuucaaggcuccaagauaca

SEQ ID NO: 21751 - RNA, 20 nt, Artificial Sequence
  MKO10021751_A_Gm5934
  gRNA
gacacuauguugaauaaauc

SEQ ID NO: 21752 - RNA, 20 nt, Artificial Sequence
  MKO10021752_A_Gm5934
  gRNA
auaucuccaacuacuucuuc

SEQ ID NO: 21753 - RNA, 20 nt, Artificial Sequence
  MKO10021753_A_Gm5934
  gRNA
auaguaaagaggccagcauu

SEQ ID NO: 21754 - RNA, 20 nt, Artificial Sequence
  MKO10021754_A_Gm5935
  gRNA
agaugaacaugacaguaugu

SEQ ID NO: 21755 - RNA, 20 nt, Artificial Sequence
  MKO10021755_A_Gm5935
  gRNA
auaguaaagaggccagcauu

SEQ ID NO: 21756 - RNA, 20 nt, Artificial Sequence
  MKO10021756_A_Gm5935
  gRNA
ucuucaucugcuucuacgug

SEQ ID NO: 21757 - RNA, 20 nt, Artificial Sequence
  MKO10021757_A_Gm5936
  gRNA
uuuaaaucggguacccuuuc

SEQ ID NO: 21758 - RNA, 20 nt, Artificial Sequence
  MKO10021758_A_Gm5936
  gRNA
ugucagcaaaaucgauaaga

SEQ ID NO: 21759 - RNA, 20 nt, Artificial Sequence
  MKO10021759_A_Gm5936
  gRNA
ccgauuuaaaaccgagcagc

SEQ ID NO: 21760 - RNA, 20 nt, Artificial Sequence
  MKO10021760_A_Gm5938
  gRNA
uaaucauuaugaacuuguga

SEQ ID NO: 21761 - RNA, 20 nt, Artificial Sequence
  MKO10021761_A_Gm5938
  gRNA
caauaaaccuuuaacuucug

SEQ ID NO: 21762 - RNA, 20 nt, Artificial Sequence
  MKO10021762_A_Gm5938
  gRNA
ugaaaacauuagacaugucc

SEQ ID NO: 21763 - RNA, 20 nt, Artificial Sequence
  MKO10021763_A_Gm5941
  gRNA
cacgaagagcaagaaaacgc

SEQ ID NO: 21764 - RNA, 20 nt, Artificial Sequence
  MKO10021764_A_Gm5941
  gRNA
uggugaaagcgacuaagaag

SEQ ID NO: 21765 - RNA, 20 nt, Artificial Sequence
  MKO10021765_A_Gm5941
  gRNA
agaaaaauacagcaccuaaa

SEQ ID NO: 21766 - RNA, 20 nt, Artificial Sequence
  MKO10021766_A_Gm595
  gRNA
uuaaucaagcguucguguug

SEQ ID NO: 21767 - RNA, 20 nt, Artificial Sequence
  MKO10021767_A_Gm595
  gRNA
acgaacgcuugauuaaacuc

SEQ ID NO: 21768 - RNA, 20 nt, Artificial Sequence
  MKO10021768_A_Gm595
  gRNA
agauuagcugguccaaucuu

SEQ ID NO: 21769 - RNA, 20 nt, Artificial Sequence
  MKO10021769_A_Gm597
  gRNA
guaggucuaccuccggucau

SEQ ID NO: 21770 - RNA, 20 nt, Artificial Sequence
  MKO10021770_A_Gm597
  gRNA
auggugggguccgaacucac

SEQ ID NO: 21771 - RNA, 20 nt, Artificial Sequence
  MKO10021771_A_Gm597
  gRNA
gagcaaaacaaacauccgaa

SEQ ID NO: 21772 - RNA, 20 nt, Artificial Sequence
  MKO10021772_A_Gm6026
  gRNA
aggcaucaucaguugucuuc

SEQ ID NO: 21773 - RNA, 20 nt, Artificial Sequence
  MKO10021773_A_Gm6026
  gRNA
ucauggccaggaaaagccaa

SEQ ID NO: 21774 - RNA, 20 nt, Artificial Sequence
  MKO10021774_A_Gm6026
  gRNA
aaauugaagcucagcucucu

SEQ ID NO: 21775 - RNA, 20 nt, Artificial Sequence
  MKO10021775_A_Gm6034
  gRNA
aaugauuaccauguuagagu

SEQ ID NO: 21776 - RNA, 20 nt, Artificial Sequence
  MKO10021776_A_Gm6034
  gRNA
agugaauucuaccaaaaagc

SEQ ID NO: 21777 - RNA, 20 nt, Artificial Sequence
  MKO10021777_A_Gm6034
  gRNA
uccauccaccgacucuaaca

SEQ ID NO: 21778 - RNA, 20 nt, Artificial Sequence
  MKO10021778_A_Gm6040
  gRNA
gguauuuaccgugcaguacc

SEQ ID NO: 21779 - RNA, 20 nt, Artificial Sequence
  MKO10021779_A_Gm6040
  gRNA
gaaagaccuugcuaccuccg

SEQ ID NO: 21780 - RNA, 20 nt, Artificial Sequence
  MKO10021780_A_Gm6040
  gRNA
ggcucucuuugccgucuucc

SEQ ID NO: 21781 - RNA, 20 nt, Artificial Sequence
  MKO10021781_A_Gm6086
  gRNA
cuauguucgcaaaugccuug

SEQ ID NO: 21782 - RNA, 20 nt, Artificial Sequence
  MKO10021782_A_Gm6086
  gRNA
aaucugcgcccuuaccagag

SEQ ID NO: 21783 - RNA, 20 nt, Artificial Sequence
  MKO10021783_A_Gm6086
  gRNA
gguccuggccguguuccugc

SEQ ID NO: 21784 - RNA, 20 nt, Artificial Sequence
  MKO10021784_A_Gm608
  gRNA
gcaacagacgauaggccaac

SEQ ID NO: 21785 - RNA, 20 nt, Artificial Sequence
  MKO10021785_A_Gm608
  gRNA
ucgaccuugaauaucccccg

SEQ ID NO: 21786 - RNA, 20 nt, Artificial Sequence
  MKO10021786_A_Gm608
  gRNA
cgcugcucccuccguugagc

SEQ ID NO: 21787 - RNA, 20 nt, Artificial Sequence
  MKO10021787_A_Gm609
  gRNA
guccgauugccagucaauca

SEQ ID NO: 21788 - RNA, 20 nt, Artificial Sequence
  MKO10021788_A_Gm609
  gRNA
gccuaacccacuaucaacac

SEQ ID NO: 21789 - RNA, 20 nt, Artificial Sequence
  MKO10021789_A_Gm609
  gRNA
ucauugacacaaccaagucc

SEQ ID NO: 21790 - RNA, 20 nt, Artificial Sequence
  MKO10021790_A_Gm6121
  gRNA
auaguaaagaggccagcauu

SEQ ID NO: 21791 - RNA, 20 nt, Artificial Sequence
  MKO10021791_A_Gm6121
  gRNA
ucuucaucugcuucuacuug

SEQ ID NO: 21792 - RNA, 20 nt, Artificial Sequence
  MKO10021792_A_Gm6121
  gRNA
agaugaacaagacaguaugu

SEQ ID NO: 21793 - RNA, 20 nt, Artificial Sequence
  MKO10021793_A_Gm614
  gRNA
ucgagcuguaaggaauuugc

SEQ ID NO: 21794 - RNA, 20 nt, Artificial Sequence
  MKO10021794_A_Gm614
  gRNA
ugcuugugcuaguagucugc

SEQ ID NO: 21795 - RNA, 20 nt, Artificial Sequence
  MKO10021795_A_Gm614
  gRNA
cgauucaucacacaaaucaa

SEQ ID NO: 21796 - RNA, 20 nt, Artificial Sequence
  MKO10021796_A_Gm6164
  gRNA
gcccucucgaugucugcuca

SEQ ID NO: 21797 - RNA, 20 nt, Artificial Sequence
  MKO10021797_A_Gm6164
  gRNA
caguugaagagcacagaaca

SEQ ID NO: 21798 - RNA, 20 nt, Artificial Sequence
  MKO10021798_A_Gm6164
  gRNA
cagagcaagugucacaaaca

SEQ ID NO: 21799 - RNA, 20 nt, Artificial Sequence
  MKO10021799_A_Gm6251
  gRNA
uugucauauuacuugcucuu

SEQ ID NO: 21800 - RNA, 20 nt, Artificial Sequence
  MKO10021800_A_Gm6251
  gRNA
aaaaugaccagcuucuuccu

SEQ ID NO: 21801 - RNA, 20 nt, Artificial Sequence
  MKO10021801_A_Gm6251
  gRNA
cugugcugagauugcucaca

SEQ ID NO: 21802 - RNA, 20 nt, Artificial Sequence
  MKO10021802_A_Gm6289
  gRNA
aacaauaauugaacgcauga

SEQ ID NO: 21803 - RNA, 20 nt, Artificial Sequence
  MKO10021803_A_Gm6289
  gRNA
gggcucaucucugcccauga

SEQ ID NO: 21804 - RNA, 20 nt, Artificial Sequence
  MKO10021804_A_Gm6289
  gRNA
ugcuuguaacucucccguuu

SEQ ID NO: 21805 - RNA, 20 nt, Artificial Sequence
  MKO10021805_A_Gm6370
  gRNA
guaagacacaaauaauugcc

SEQ ID NO: 21806 - RNA, 20 nt, Artificial Sequence
  MKO10021806_A_Gm6370
  gRNA
ccacucacguucucaucagc

SEQ ID NO: 21807 - RNA, 20 nt, Artificial Sequence
  MKO10021807_A_Gm6370
  gRNA
ggucuguucucaaaaugaac

SEQ ID NO: 21808 - RNA, 20 nt, Artificial Sequence
  MKO10021808_A_Gm6377
  gRNA
acuuucaguggauauaccau

SEQ ID NO: 21809 - RNA, 20 nt, Artificial Sequence
  MKO10021809_A_Gm6377
  gRNA
ucaguaugcuagaagucaug

SEQ ID NO: 21810 - RNA, 20 nt, Artificial Sequence
  MKO10021810_A_Gm6377
  gRNA
aacuggauuuauaucgaucu

SEQ ID NO: 21811 - RNA, 20 nt, Artificial Sequence
  MKO10021811_A_Gm6406
  gRNA
gcagggcgcggggucgacgc

SEQ ID NO: 21812 - RNA, 20 nt, Artificial Sequence
  MKO10021812_A_Gm6406
  gRNA
guagcuguccaguucccaga

SEQ ID NO: 21813 - RNA, 20 nt, Artificial Sequence
  MKO10021813_A_Gm6406
  gRNA
gcccgcgugcccagaacccc

SEQ ID NO: 21814 - RNA, 20 nt, Artificial Sequence
  MKO10021814_A_Gm6408
  gRNA
cuuccugccugaccguauaa

SEQ ID NO: 21815 - RNA, 20 nt, Artificial Sequence
  MKO10021815_A_Gm6408
  gRNA
ggccauugggcuaaacccug

SEQ ID NO: 21816 - RNA, 20 nt, Artificial Sequence
  MKO10021816_A_Gm6408
  gRNA
uaaaaauaugagauaagauu

SEQ ID NO: 21817 - RNA, 20 nt, Artificial Sequence
  MKO10021817_A_Gm6432
  gRNA
gcuaucauacguauacuuuc

SEQ ID NO: 21818 - RNA, 20 nt, Artificial Sequence
  MKO10021818_A_Gm6432
  gRNA
gucauccaagugcaauaccc

SEQ ID NO: 21819 - RNA, 20 nt, Artificial Sequence
  MKO10021819_A_Gm6432
  gRNA
auuacaccauacauccauag

SEQ ID NO: 21820 - RNA, 20 nt, Artificial Sequence
  MKO10021820_A_Gm6460
  gRNA
cagugcauaccuauuguaau

SEQ ID NO: 21821 - RNA, 20 nt, Artificial Sequence
  MKO10021821_A_Gm6460
  gRNA
ugcaccugaccuaaguaaga

SEQ ID NO: 21822 - RNA, 20 nt, Artificial Sequence
  MKO10021822_A_Gm6460
  gRNA
cuauccacuuauugagcucc

SEQ ID NO: 21823 - RNA, 20 nt, Artificial Sequence
  MKO10021823_A_Gm6484
  gRNA
ugaagccacagcccgaucac

SEQ ID NO: 21824 - RNA, 20 nt, Artificial Sequence
  MKO10021824_A_Gm6484
  gRNA
agcagugcgacccgcuccag

SEQ ID NO: 21825 - RNA, 20 nt, Artificial Sequence
  MKO10021825_A_Gm6484
  gRNA
ugcucaccugaaucuccgac

SEQ ID NO: 21826 - RNA, 20 nt, Artificial Sequence
  MKO10021826_A_Gm648
  gRNA
acuuacgucguccaaagcgu

SEQ ID NO: 21827 - RNA, 20 nt, Artificial Sequence
  MKO10021827_A_Gm648
  gRNA
augacagaaauccgacgcuu

SEQ ID NO: 21828 - RNA, 20 nt, Artificial Sequence
  MKO10021828_A_Gm648
  gRNA
acgccauuuaauccaguauc

SEQ ID NO: 21829 - RNA, 20 nt, Artificial Sequence
  MKO10021829_A_Gm6531
  gRNA
acaugauugccccgcgccuc

SEQ ID NO: 21830 - RNA, 20 nt, Artificial Sequence
  MKO10021830_A_Gm6531
  gRNA
aucaaaugccggcgugcugc

SEQ ID NO: 21831 - RNA, 20 nt, Artificial Sequence
  MKO10021831_A_Gm6531
  gRNA
gacaacucccagcagcacgc

SEQ ID NO: 21832 - RNA, 20 nt, Artificial Sequence
  MKO10021832_A_Gm6537
  gRNA
acagauuucggccuccgccc

SEQ ID NO: 21833 - RNA, 20 nt, Artificial Sequence
  MKO10021833_A_Gm6537
  gRNA
ucucccccaggaacacgaug

SEQ ID NO: 21834 - RNA, 20 nt, Artificial Sequence
  MKO10021834_A_Gm6537
  gRNA
ccuucucagccacccgcuuc

SEQ ID NO: 21835 - RNA, 20 nt, Artificial Sequence
  MKO10021835_A_Gm6583
  gRNA
ccucgcgguccaguaaggag

SEQ ID NO: 21836 - RNA, 20 nt, Artificial Sequence
  MKO10021836_A_Gm6583
  gRNA
aaggaggaacuccccguacu

SEQ ID NO: 21837 - RNA, 20 nt, Artificial Sequence
  MKO10021837_A_Gm6583
  gRNA
ggguaccucgccuacuuccu

SEQ ID NO: 21838 - RNA, 20 nt, Artificial Sequence
  MKO10021838_A_Gm6588
  gRNA
aaagggccuuguaugacguc

SEQ ID NO: 21839 - RNA, 20 nt, Artificial Sequence
  MKO10021839_A_Gm6588
  gRNA
cugggauaccgcggccaaac

SEQ ID NO: 21840 - RNA, 20 nt, Artificial Sequence
  MKO10021840_A_Gm6588
  gRNA
ucagaacgaaaagucuuacg

SEQ ID NO: 21841 - RNA, 20 nt, Artificial Sequence
  MKO10021841_A_Gm6592
  gRNA
cuuaucuuggccggucauuc

SEQ ID NO: 21842 - RNA, 20 nt, Artificial Sequence
  MKO10021842_A_Gm6592
  gRNA
aacuucaaugccuuucacca

SEQ ID NO: 21843 - RNA, 20 nt, Artificial Sequence
  MKO10021843_A_Gm6592
  gRNA
uccuugccacucaugaagac

SEQ ID NO: 21844 - RNA, 20 nt, Artificial Sequence
  MKO10021844_A_Gm6614
  gRNA
cccaacaaaaguccaauuac

SEQ ID NO: 21845 - RNA, 20 nt, Artificial Sequence
  MKO10021845_A_Gm6614
  gRNA
uggaugugcaacuaugggcc

SEQ ID NO: 21846 - RNA, 20 nt, Artificial Sequence
  MKO10021846_A_Gm6614
  gRNA
cauccaacaccaaugaugau

SEQ ID NO: 21847 - RNA, 20 nt, Artificial Sequence
  MKO10021847_A_Gm6696
  gRNA
aaaaaaagagaacgccugaa

SEQ ID NO: 21848 - RNA, 20 nt, Artificial Sequence
  MKO10021848_A_Gm6696
  gRNA
ucuugaagagaagagccuuc

SEQ ID NO: 21849 - RNA, 20 nt, Artificial Sequence
  MKO10021849_A_Gm6696
  gRNA
ccucucugcccuugcccugc

SEQ ID NO: 21850 - RNA, 20 nt, Artificial Sequence
  MKO10021850_A_Gm6710
  gRNA
uauagcugugagauuccuau

SEQ ID NO: 21851 - RNA, 20 nt, Artificial Sequence
  MKO10021851_A_Gm6710
  gRNA
agucaccuaugaugacgugc

SEQ ID NO: 21852 - RNA, 20 nt, Artificial Sequence
  MKO10021852_A_Gm6710
  gRNA
gacuucuagaaguuugaaaa

SEQ ID NO: 21853 - RNA, 20 nt, Artificial Sequence
  MKO10021853_A_Gm6760
  gRNA
uggugaucguuauuugcuau

SEQ ID NO: 21854 - RNA, 20 nt, Artificial Sequence
  MKO10021854_A_Gm6760
  gRNA
ccucgcucagagcccgaaca

SEQ ID NO: 21855 - RNA, 20 nt, Artificial Sequence
  MKO10021855_A_Gm6760
  gRNA
cgcuuguucugacgcugaac

SEQ ID NO: 21856 - RNA, 20 nt, Artificial Sequence
  MKO10021856_A_Gm6763
  gRNA
aaucagguaccuuggauaca

SEQ ID NO: 21857 - RNA, 20 nt, Artificial Sequence
  MKO10021857_A_Gm6763
  gRNA
cagcuacucuuugcugaauu

SEQ ID NO: 21858 - RNA, 20 nt, Artificial Sequence
  MKO10021858_A_Gm6763
  gRNA
uguucagucgaagcugugaa

SEQ ID NO: 21859 - RNA, 20 nt, Artificial Sequence
  MKO10021859_A_Gm6772
  gRNA
gcacgagaacuacuaccugc

SEQ ID NO: 21860 - RNA, 20 nt, Artificial Sequence
  MKO10021860_A_Gm6772
  gRNA
gaacgugucugacaauaacc

SEQ ID NO: 21861 - RNA, 20 nt, Artificial Sequence
  MKO10021861_A_Gm6772
  gRNA
ugcgugaaucucaaccacca

SEQ ID NO: 21862 - RNA, 20 nt, Artificial Sequence
  MKO10021862_A_Gm6812
  gRNA
gaaguucaaauauaaaguca

SEQ ID NO: 21863 - RNA, 20 nt, Artificial Sequence
  MKO10021863_A_Gm6812
  gRNA
aaaguuacaagaauuucaca

SEQ ID NO: 21864 - RNA, 20 nt, Artificial Sequence
  MKO10021864_A_Gm6812
  gRNA
cccaagagcucagacucccu

SEQ ID NO: 21865 - RNA, 20 nt, Artificial Sequence
  MKO10021865_A_Gm684
  gRNA
aggacucgaagaucuggucg

SEQ ID NO: 21866 - RNA, 20 nt, Artificial Sequence
  MKO10021866_A_Gm684
  gRNA
cuagauuccagggucgccuu

SEQ ID NO: 21867 - RNA, 20 nt, Artificial Sequence
  MKO10021867_A_Gm684
  gRNA
ccacuggcgauuucuauaag

SEQ ID NO: 21868 - RNA, 20 nt, Artificial Sequence
  MKO10021868_A_Gm6878
  gRNA
uacacgaacuugccacaccc

SEQ ID NO: 21869 - RNA, 20 nt, Artificial Sequence
  MKO10021869_A_Gm6878
  gRNA
acuccagcauguugacugac

SEQ ID NO: 21870 - RNA, 20 nt, Artificial Sequence
  MKO10021870_A_Gm6878
  gRNA
gaaaaguucuugaucagaga

SEQ ID NO: 21871 - RNA, 20 nt, Artificial Sequence
  MKO10021871_A_Gm6880
  gRNA
aguugaugcagcaucaccgc

SEQ ID NO: 21872 - RNA, 20 nt, Artificial Sequence
  MKO10021872_A_Gm6880
  gRNA
agucaugcagaacccuguug

SEQ ID NO: 21873 - RNA, 20 nt, Artificial Sequence
  MKO10021873_A_Gm6880
  gRNA
ugcccauccccagcaaguga

SEQ ID NO: 21874 - RNA, 20 nt, Artificial Sequence
  MKO10021874_A_Gm6890
  gRNA
gcaguaucaccguugcgccc

SEQ ID NO: 21875 - RNA, 20 nt, Artificial Sequence
  MKO10021875_A_Gm6890
  gRNA
aucaacuagaaaucgacacc

SEQ ID NO: 21876 - RNA, 20 nt, Artificial Sequence
  MKO10021876_A_Gm6890
  gRNA
gccuccauugcaguccugaa

SEQ ID NO: 21877 - RNA, 20 nt, Artificial Sequence
  MKO10021877_A_Gm6902
  gRNA
agagggccugaugacggagc

SEQ ID NO: 21878 - RNA, 20 nt, Artificial Sequence
  MKO10021878_A_Gm6902
  gRNA
ucaugguccugacaaugcug

SEQ ID NO: 21879 - RNA, 20 nt, Artificial Sequence
  MKO10021879_A_Gm6902
  gRNA
uagaggagagcgagacucga

SEQ ID NO: 21880 - RNA, 20 nt, Artificial Sequence
  MKO10021880_A_Gm6904
  gRNA
ugcgcagcuauauucaguga

SEQ ID NO: 21881 - RNA, 20 nt, Artificial Sequence
  MKO10021881_A_Gm6904
  gRNA
aguauauaugauuccacuca

SEQ ID NO: 21882 - RNA, 20 nt, Artificial Sequence
  MKO10021882_A_Gm6904
  gRNA
uagaauugcguugucuucca

SEQ ID NO: 21883 - RNA, 20 nt, Artificial Sequence
  MKO10021883_A_Gm6927
  gRNA
ugucaucguagguguaucca

SEQ ID NO: 21884 - RNA, 20 nt, Artificial Sequence
  MKO10021884_A_Gm6927
  gRNA
uccaaucaauccgagcaugc

SEQ ID NO: 21885 - RNA, 20 nt, Artificial Sequence
  MKO10021885_A_Gm6927
  gRNA
aaguaccagacucgccacug

SEQ ID NO: 21886 - RNA, 20 nt, Artificial Sequence
  MKO10021886_A_Gm694
  gRNA
gcagccguccugcgcaccca

SEQ ID NO: 21887 - RNA, 20 nt, Artificial Sequence
  MKO10021887_A_Gm694
  gRNA
uggggcgacacaucccugau

SEQ ID NO: 21888 - RNA, 20 nt, Artificial Sequence
  MKO10021888_A_Gm694
  gRNA
ucuaguguggagaugagcuc

SEQ ID NO: 21889 - RNA, 20 nt, Artificial Sequence
  MKO10021889_A_Gm7030
  gRNA
cgcccuggccccgacccgag

SEQ ID NO: 21890 - RNA, 20 nt, Artificial Sequence
  MKO10021890_A_Gm7030
  gRNA
gccagguccccacacuaucc

SEQ ID NO: 21891 - RNA, 20 nt, Artificial Sequence
  MKO10021891_A_Gm7030
  gRNA
aaccggggcuccccuaagcc

SEQ ID NO: 21892 - RNA, 20 nt, Artificial Sequence
  MKO10021892_A_Gm7073
  gRNA
cguggcuugcuuaucugaac

SEQ ID NO: 21893 - RNA, 20 nt, Artificial Sequence
  MKO10021893_A_Gm7073
  gRNA
ucaaccugauaugauaguug

SEQ ID NO: 21894 - RNA, 20 nt, Artificial Sequence
  MKO10021894_A_Gm7073
  gRNA
ccucaaccauacaauuguaa

SEQ ID NO: 21895 - RNA, 20 nt, Artificial Sequence
  MKO10021895_A_Gm7092
  gRNA
ucaguccaugguucggacua

SEQ ID NO: 21896 - RNA, 20 nt, Artificial Sequence
  MKO10021896_A_Gm7092
  gRNA
agcaggacgaagaacguucc

SEQ ID NO: 21897 - RNA, 20 nt, Artificial Sequence
  MKO10021897_A_Gm7092
  gRNA
acaggggaaccugcgacgag

SEQ ID NO: 21898 - RNA, 20 nt, Artificial Sequence
  MKO10021898_A_Gm7102
  gRNA
ggcucccguauggccuagca

SEQ ID NO: 21899 - RNA, 20 nt, Artificial Sequence
  MKO10021899_A_Gm7102
  gRNA
ccucccugugggacuguuac

SEQ ID NO: 21900 - RNA, 20 nt, Artificial Sequence
  MKO10021900_A_Gm7102
  gRNA
acuccuguaacagucccaca

SEQ ID NO: 21901 - RNA, 20 nt, Artificial Sequence
  MKO10021901_A_Gm711
  gRNA
acucgauggcauccaauacc

SEQ ID NO: 21902 - RNA, 20 nt, Artificial Sequence
  MKO10021902_A_Gm711
  gRNA
gaacgauguucaacuuaugu

SEQ ID NO: 21903 - RNA, 20 nt, Artificial Sequence
  MKO10021903_A_Gm711
  gRNA
gggaguaauaauccaucacc

SEQ ID NO: 21904 - RNA, 20 nt, Artificial Sequence
  MKO10021904_A_Gm7120
  gRNA
gaugucuuaccuguaaagau

SEQ ID NO: 21905 - RNA, 20 nt, Artificial Sequence
  MKO10021905_A_Gm7120
  gRNA
ggaugcaggggaugagaaca

SEQ ID NO: 21906 - RNA, 20 nt, Artificial Sequence
  MKO10021906_A_Gm7120
  gRNA
aucaaugcgcauuccguauu

SEQ ID NO: 21907 - RNA, 20 nt, Artificial Sequence
  MKO10021907_A_Gm7157
  gRNA
gcauaccacacucgccacug

SEQ ID NO: 21908 - RNA, 20 nt, Artificial Sequence
  MKO10021908_A_Gm7157
  gRNA
uauugcugacguugucauag

SEQ ID NO: 21909 - RNA, 20 nt, Artificial Sequence
  MKO10021909_A_Gm7157
  gRNA
ucugaucucuuauccuagua

SEQ ID NO: 21910 - RNA, 20 nt, Artificial Sequence
  MKO10021910_A_Gm715
  gRNA
gcgucgugugagagacgugc

SEQ ID NO: 21911 - RNA, 20 nt, Artificial Sequence
  MKO10021911_A_Gm715
  gRNA
ggcuguaggucgacgcccac

SEQ ID NO: 21912 - RNA, 20 nt, Artificial Sequence
  MKO10021912_A_Gm715
  gRNA
gaucuugagccccgccgcau

SEQ ID NO: 21913 - RNA, 20 nt, Artificial Sequence
  MKO10021913_A_Gm7168
  gRNA
uaugcacuauaccaaguccg

SEQ ID NO: 21914 - RNA, 20 nt, Artificial Sequence
  MKO10021914_A_Gm7168
  gRNA
auaggcuggcucuugaucaa

SEQ ID NO: 21915 - RNA, 20 nt, Artificial Sequence
  MKO10021915_A_Gm7168
  gRNA
gauuuguuggacgagcacug

SEQ ID NO: 21916 - RNA, 20 nt, Artificial Sequence
  MKO10021916_A_Gm7173
  gRNA
gagauuacuauuauuaaccg

SEQ ID NO: 21917 - RNA, 20 nt, Artificial Sequence
  MKO10021917_A_Gm7173
  gRNA
cuugaacaucaaagugcgug

SEQ ID NO: 21918 - RNA, 20 nt, Artificial Sequence
  MKO10021918_A_Gm7173
  gRNA
caaauuguuguugaccaguc

SEQ ID NO: 21919 - RNA, 20 nt, Artificial Sequence
  MKO10021919_A_Gm7244
  gRNA
uugugugaugcccgaagcua

SEQ ID NO: 21920 - RNA, 20 nt, Artificial Sequence
  MKO10021920_A_Gm7244
  gRNA
cugcaaagaaucaucgauaa

SEQ ID NO: 21921 - RNA, 20 nt, Artificial Sequence
  MKO10021921_A_Gm7244
  gRNA
agagagcaugccuaccgagc

SEQ ID NO: 21922 - RNA, 20 nt, Artificial Sequence
  MKO10021922_A_Gm7257
  gRNA
uugcuggugauguccucgca

SEQ ID NO: 21923 - RNA, 20 nt, Artificial Sequence
  MKO10021923_A_Gm7257
  gRNA
accuuuaaggguuaugagcg

SEQ ID NO: 21924 - RNA, 20 nt, Artificial Sequence
  MKO10021924_A_Gm7257
  gRNA
ugacauguaucacgugugau

SEQ ID NO: 21925 - RNA, 20 nt, Artificial Sequence
  MKO10021925_A_Gm7325
  gRNA
agcagcgaucgaagcaccau

SEQ ID NO: 21926 - RNA, 20 nt, Artificial Sequence
  MKO10021926_A_Gm7325
  gRNA
agcucagucggcgggccagc

SEQ ID NO: 21927 - RNA, 20 nt, Artificial Sequence
  MKO10021927_A_Gm7325
  gRNA
aaacuaauccaguugaaaac

SEQ ID NO: 21928 - RNA, 20 nt, Artificial Sequence
  MKO10021928_A_Gm732
  gRNA
ccaucgcuuuacgacgaacc

SEQ ID NO: 21929 - RNA, 20 nt, Artificial Sequence
  MKO10021929_A_Gm732
  gRNA
cccccuuaccaaucccauaa

SEQ ID NO: 21930 - RNA, 20 nt, Artificial Sequence
  MKO10021930_A_Gm732
  gRNA
augauaagagugaagaacaa

SEQ ID NO: 21931 - RNA, 20 nt, Artificial Sequence
  MKO10021931_A_Gm7361
  gRNA
ggccaucauucaccaacuuu

SEQ ID NO: 21932 - RNA, 20 nt, Artificial Sequence
  MKO10021932_A_Gm7361
  gRNA
auuucuaaacgacuuagaga

SEQ ID NO: 21933 - RNA, 20 nt, Artificial Sequence
  MKO10021933_A_Gm7361
  gRNA
agaagacagcaucuugcaga

SEQ ID NO: 21934 - RNA, 20 nt, Artificial Sequence
  MKO10021934_A_Gm7534
  gRNA
acgaccgucucuccgcuacu

SEQ ID NO: 21935 - RNA, 20 nt, Artificial Sequence
  MKO10021935_A_Gm7534
  gRNA
uaccaacgacuccaacgcag

SEQ ID NO: 21936 - RNA, 20 nt, Artificial Sequence
  MKO10021936_A_Gm7534
  gRNA
acccgacuuaccgguuggca

SEQ ID NO: 21937 - RNA, 20 nt, Artificial Sequence
  MKO10021937_A_Gm757
  gRNA
uggccacaguagagacgucg

SEQ ID NO: 21938 - RNA, 20 nt, Artificial Sequence
  MKO10021938_A_Gm757
  gRNA
uuugcauuguguacgaucca

SEQ ID NO: 21939 - RNA, 20 nt, Artificial Sequence
  MKO10021939_A_Gm757
  gRNA
guucgcauuacuaucuacac

SEQ ID NO: 21940 - RNA, 20 nt, Artificial Sequence
  MKO10021940_A_Gm7609
  gRNA
ugcacaguguuucaaccauu

SEQ ID NO: 21941 - RNA, 20 nt, Artificial Sequence
  MKO10021941_A_Gm7609
  gRNA
uggggcagacuggaaaacag

SEQ ID NO: 21942 - RNA, 20 nt, Artificial Sequence
  MKO10021942_A_Gm7609
  gRNA
uuccaucuuccacagcugcc

SEQ ID NO: 21943 - RNA, 20 nt, Artificial Sequence
  MKO10021943_A_Gm7616
  gRNA
uccccauggggcguuaccuc

SEQ ID NO: 21944 - RNA, 20 nt, Artificial Sequence
  MKO10021944_A_Gm7616
  gRNA
caagccuuccauccucuccg

SEQ ID NO: 21945 - RNA, 20 nt, Artificial Sequence
  MKO10021945_A_Gm7616
  gRNA
cgacacagaagcugccacua

SEQ ID NO: 21946 - RNA, 20 nt, Artificial Sequence
  MKO10021946_A_Gm765
  gRNA
cugcaacuugaccugcgaug

SEQ ID NO: 21947 - RNA, 20 nt, Artificial Sequence
  MKO10021947_A_Gm765
  gRNA
gagacuacaguccacaucgc

SEQ ID NO: 21948 - RNA, 20 nt, Artificial Sequence
  MKO10021948_A_Gm765
  gRNA
gugaagugcucgauccugac

SEQ ID NO: 21949 - RNA, 20 nt, Artificial Sequence
  MKO10021949_A_Gm766
  gRNA
ugucauucacgucgaugccg

SEQ ID NO: 21950 - RNA, 20 nt, Artificial Sequence
  MKO10021950_A_Gm766
  gRNA
auugagcgcauucccgacgc

SEQ ID NO: 21951 - RNA, 20 nt, Artificial Sequence
  MKO10021951_A_Gm766
  gRNA
cgacgugaaugacagcgaga

SEQ ID NO: 21952 - RNA, 20 nt, Artificial Sequence
  MKO10021952_A_Gm7694
  gRNA
gggcccgagggguucgcuuc

SEQ ID NO: 21953 - RNA, 20 nt, Artificial Sequence
  MKO10021953_A_Gm7694
  gRNA
gcgaugaaaucagcaugucc

SEQ ID NO: 21954 - RNA, 20 nt, Artificial Sequence
  MKO10021954_A_Gm7694
  gRNA
caaugaccuccugcggagaa

SEQ ID NO: 21955 - RNA, 20 nt, Artificial Sequence
  MKO10021955_A_Gm7714
  gRNA
ggcugagugugacgacuaug

SEQ ID NO: 21956 - RNA, 20 nt, Artificial Sequence
  MKO10021956_A_Gm7714
  gRNA
agcuauucagcuauugucuc

SEQ ID NO: 21957 - RNA, 20 nt, Artificial Sequence
  MKO10021957_A_Gm7714
  gRNA
aagccacuguauguagucuu

SEQ ID NO: 21958 - RNA, 20 nt, Artificial Sequence
  MKO10021958_A_Gm773
  gRNA
uugguuccuacaagaauggg

SEQ ID NO: 21959 - RNA, 20 nt, Artificial Sequence
  MKO10021959_A_Gm773
  gRNA
uuucaacaacagcacugcua

SEQ ID NO: 21960 - RNA, 20 nt, Artificial Sequence
  MKO10021960_A_Gm773
  gRNA
ucuguaccacccauucuugu

SEQ ID NO: 21961 - RNA, 20 nt, Artificial Sequence
  MKO10021961_A_Gm7849
  gRNA
ccucucugcccuugcccugc

SEQ ID NO: 21962 - RNA, 20 nt, Artificial Sequence
  MKO10021962_A_Gm7849
  gRNA
agagccuucugugccuccaa

SEQ ID NO: 21963 - RNA, 20 nt, Artificial Sequence
  MKO10021963_A_Gm7849
  gRNA
cagcccaaagaagauuuccg

SEQ ID NO: 21964 - RNA, 20 nt, Artificial Sequence
  MKO10021964_A_Gm7861
  gRNA
ccucucugcccuugcccugc

SEQ ID NO: 21965 - RNA, 20 nt, Artificial Sequence
  MKO10021965_A_Gm7861
  gRNA
agagccuucugugccuccaa

SEQ ID NO: 21966 - RNA, 20 nt, Artificial Sequence
  MKO10021966_A_Gm7861
  gRNA
cagcccaaagaagauuuccg

SEQ ID NO: 21967 - RNA, 20 nt, Artificial Sequence
  MKO10021967_A_Gm7903
  gRNA
cuuaccuaguagcugaguuc

SEQ ID NO: 21968 - RNA, 20 nt, Artificial Sequence
  MKO10021968_A_Gm7903
  gRNA
guucauuaugauggacacca

SEQ ID NO: 21969 - RNA, 20 nt, Artificial Sequence
  MKO10021969_A_Gm7903
  gRNA
caguuucaagaugaucugug

SEQ ID NO: 21970 - RNA, 20 nt, Artificial Sequence
  MKO10021970_A_Gm7978
  gRNA
ucuccagaaucugacauuga

SEQ ID NO: 21971 - RNA, 20 nt, Artificial Sequence
  MKO10021971_A_Gm7978
  gRNA
uccaucuagcacagccugca

SEQ ID NO: 21972 - RNA, 20 nt, Artificial Sequence
  MKO10021972_A_Gm7978
  gRNA
ucccgacaggggaaaacuuc

SEQ ID NO: 21973 - RNA, 20 nt, Artificial Sequence
  MKO10021973_A_Gm806
  gRNA
gcuggacagucgaagcaauu

SEQ ID NO: 21974 - RNA, 20 nt, Artificial Sequence
  MKO10021974_A_Gm806
  gRNA
ccagcaccccucgugacugc

SEQ ID NO: 21975 - RNA, 20 nt, Artificial Sequence
  MKO10021975_A_Gm806
  gRNA
aaguuguugcaaccauacca

SEQ ID NO: 21976 - RNA, 20 nt, Artificial Sequence
  MKO10021976_A_Gm813
  gRNA
cgacaucuugcaggucgugc

SEQ ID NO: 21977 - RNA, 20 nt, Artificial Sequence
  MKO10021977_A_Gm813
  gRNA
cuggcauacaucaccgaaag

SEQ ID NO: 21978 - RNA, 20 nt, Artificial Sequence
  MKO10021978_A_Gm813
  gRNA
auauaagcuaaagccucuuc

SEQ ID NO: 21979 - RNA, 20 nt, Artificial Sequence
  MKO10021979_A_Gm815
  gRNA
ggccuccggggucaauaugc

SEQ ID NO: 21980 - RNA, 20 nt, Artificial Sequence
  MKO10021980_A_Gm815
  gRNA
uguggcuaugucgucucuag

SEQ ID NO: 21981 - RNA, 20 nt, Artificial Sequence
  MKO10021981_A_Gm815
  gRNA
gcacagaagcaucguuccua

SEQ ID NO: 21982 - RNA, 20 nt, Artificial Sequence
  MKO10021982_A_Gm8267
  gRNA
aguauuugcuucgcacaugc

SEQ ID NO: 21983 - RNA, 20 nt, Artificial Sequence
  MKO10021983_A_Gm8267
  gRNA
gauuagagauguugcaacuu

SEQ ID NO: 21984 - RNA, 20 nt, Artificial Sequence
  MKO10021984_A_Gm8267
  gRNA
ugugaaauagucugagcagc

SEQ ID NO: 21985 - RNA, 20 nt, Artificial Sequence
  MKO10021985_A_Gm826
  gRNA
cguuaucugcuuaugccaca

SEQ ID NO: 21986 - RNA, 20 nt, Artificial Sequence
  MKO10021986_A_Gm826
  gRNA
cagcaugauuugccuccaug

SEQ ID NO: 21987 - RNA, 20 nt, Artificial Sequence
  MKO10021987_A_Gm826
  gRNA
ugacagcuacagagaagcau

SEQ ID NO: 21988 - RNA, 20 nt, Artificial Sequence
  MKO10021988_A_Gm8298
  gRNA
cuuaugauucuguaaaccga

SEQ ID NO: 21989 - RNA, 20 nt, Artificial Sequence
  MKO10021989_A_Gm8298
  gRNA
gcccuacuauccacaagucc

SEQ ID NO: 21990 - RNA, 20 nt, Artificial Sequence
  MKO10021990_A_Gm8298
  gRNA
cuugcuauauccugcacuac

SEQ ID NO: 21991 - RNA, 20 nt, Artificial Sequence
  MKO10021991_A_Gm829
  gRNA
uuucuguucauacacgaccg

SEQ ID NO: 21992 - RNA, 20 nt, Artificial Sequence
  MKO10021992_A_Gm829
  gRNA
cgguccacaguagcuaccgg

SEQ ID NO: 21993 - RNA, 20 nt, Artificial Sequence
  MKO10021993_A_Gm829
  gRNA
uuaccugcaaaugauccgau

SEQ ID NO: 21994 - RNA, 20 nt, Artificial Sequence
  MKO10021994_A_Gm8300
  gRNA
auaugggcaagaguaugccc

SEQ ID NO: 21995 - RNA, 20 nt, Artificial Sequence
  MKO10021995_A_Gm8300
  gRNA
acgauuucaucaucaucccc

SEQ ID NO: 21996 - RNA, 20 nt, Artificial Sequence
  MKO10021996_A_Gm8300
  gRNA
uccaucaugccaaagaauaa

SEQ ID NO: 21997 - RNA, 20 nt, Artificial Sequence
  MKO10021997_A_Gm8369
  gRNA
uagcaaugguugaagugucg

SEQ ID NO: 21998 - RNA, 20 nt, Artificial Sequence
  MKO10021998_A_Gm8369
  gRNA
aguaagaucacugaaaagac

SEQ ID NO: 21999 - RNA, 20 nt, Artificial Sequence
  MKO10021999_A_Gm8369
  gRNA
aaauguauacaagaaccacc

SEQ ID NO: 22000 - RNA, 20 nt, Artificial Sequence
  MKO10022000_A_Gm8439
  gRNA
aaggcgauugcuacucaaga

SEQ ID NO: 22001 - RNA, 20 nt, Artificial Sequence
  MKO10022001_A_Gm8439
  gRNA
aucuugaguagcaaucgccu

SEQ ID NO: 22002 - RNA, 20 nt, Artificial Sequence
  MKO10022002_A_Gm8439
  gRNA
cugccauccaacaagaagcu

SEQ ID NO: 22003 - RNA, 20 nt, Artificial Sequence
  MKO10022003_A_Gm8453
  gRNA
uaaauccgugaaaaccacug

SEQ ID NO: 22004 - RNA, 20 nt, Artificial Sequence
  MKO10022004_A_Gm8453
  gRNA
cauuugaagagcagagaaca

SEQ ID NO: 22005 - RNA, 20 nt, Artificial Sequence
  MKO10022005_A_Gm8453
  gRNA
guuauucuuguuacaguugu

SEQ ID NO: 22006 - RNA, 20 nt, Artificial Sequence
  MKO10022006_A_Gm853
  gRNA
auccaguucgcagcccgcug

SEQ ID NO: 22007 - RNA, 20 nt, Artificial Sequence
  MKO10022007_A_Gm853
  gRNA
caguuccuccucauugucga

SEQ ID NO: 22008 - RNA, 20 nt, Artificial Sequence
  MKO10022008_A_Gm853
  gRNA
uguggcagucggaacccacg

SEQ ID NO: 22009 - RNA, 20 nt, Artificial Sequence
  MKO10022009_A_Gm8653
  gRNA
gcccucucgaugucugcuca

SEQ ID NO: 22010 - RNA, 20 nt, Artificial Sequence
  MKO10022010_A_Gm8653
  gRNA
caguugaagagcacagaaca

SEQ ID NO: 22011 - RNA, 20 nt, Artificial Sequence
  MKO10022011_A_Gm8653
  gRNA
cagagcaagugucacaaaca

SEQ ID NO: 22012 - RNA, 20 nt, Artificial Sequence
  MKO10022012_A_Gm8660
  gRNA
uaaaucccugaaaagcacug

SEQ ID NO: 22013 - RNA, 20 nt, Artificial Sequence
  MKO10022013_A_Gm8660
  gRNA
caguugaaaagcacagaaca

SEQ ID NO: 22014 - RNA, 20 nt, Artificial Sequence
  MKO10022014_A_Gm8660
  gRNA
aacuuguucuguuccacuuc

SEQ ID NO: 22015 - RNA, 20 nt, Artificial Sequence
  MKO10022015_A_Gm8677
  gRNA
gcccucuccaugucugcuca

SEQ ID NO: 22016 - RNA, 20 nt, Artificial Sequence
  MKO10022016_A_Gm8677
  gRNA
uaguuuaagagcacagaaca

SEQ ID NO: 22017 - RNA, 20 nt, Artificial Sequence
  MKO10022017_A_Gm8677
  gRNA
cagagcaagugucacaaaca

SEQ ID NO: 22018 - RNA, 20 nt, Artificial Sequence
  MKO10022018_A_Gm867
  gRNA
ccccucccuuagcggguugc

SEQ ID NO: 22019 - RNA, 20 nt, Artificial Sequence
  MKO10022019_A_Gm867
  gRNA
uacucacuaugagucacucc

SEQ ID NO: 22020 - RNA, 20 nt, Artificial Sequence
  MKO10022020_A_Gm867
  gRNA
uaauacucaccugcuaacuc

SEQ ID NO: 22021 - RNA, 20 nt, Artificial Sequence
  MKO10022021_A_Gm8693
  gRNA
accuacaaugaauccagaag

SEQ ID NO: 22022 - RNA, 20 nt, Artificial Sequence
  MKO10022022_A_Gm8693
  gRNA
uaaauccgugaaaaccacug

SEQ ID NO: 22023 - RNA, 20 nt, Artificial Sequence
  MKO10022023_A_Gm8693
  gRNA
cauuugaagagcacagaaca

SEQ ID NO: 22024 - RNA, 20 nt, Artificial Sequence
  MKO10022024_A_Gm8720
  gRNA
gcccucuccaugucugcuca

SEQ ID NO: 22025 - RNA, 20 nt, Artificial Sequence
  MKO10022025_A_Gm8720
  gRNA
caguugaagagcacagaaca

SEQ ID NO: 22026 - RNA, 20 nt, Artificial Sequence
  MKO10022026_A_Gm8720
  gRNA
cagagcaagugucacaaaca

SEQ ID NO: 22027 - RNA, 20 nt, Artificial Sequence
  MKO10022027_A_Gm8764
  gRNA
aaucagguaccuuggauaca

SEQ ID NO: 22028 - RNA, 20 nt, Artificial Sequence
  MKO10022028_A_Gm8764
  gRNA
cagcuacucuuugcugaauu

SEQ ID NO: 22029 - RNA, 20 nt, Artificial Sequence
  MKO10022029_A_Gm8764
  gRNA
uguucagucgaagcugugaa

SEQ ID NO: 22030 - RNA, 20 nt, Artificial Sequence
  MKO10022030_A_Gm8765
  gRNA
gucccugcgcaaguugucag

SEQ ID NO: 22031 - RNA, 20 nt, Artificial Sequence
  MKO10022031_A_Gm8765
  gRNA
ugaccagcuccauaugccca

SEQ ID NO: 22032 - RNA, 20 nt, Artificial Sequence
  MKO10022032_A_Gm8765
  gRNA
cuccauucauucucagaugc

SEQ ID NO: 22033 - RNA, 20 nt, Artificial Sequence
  MKO10022033_A_Gm8787
  gRNA
ccaaggggagcaaaucguag

SEQ ID NO: 22034 - RNA, 20 nt, Artificial Sequence
  MKO10022034_A_Gm8787
  gRNA
ccucuacgauuugcuccccu

SEQ ID NO: 22035 - RNA, 20 nt, Artificial Sequence
  MKO10022035_A_Gm8787
  gRNA
uuugacauucaaaccgauuu

SEQ ID NO: 22036 - RNA, 20 nt, Artificial Sequence
  MKO10022036_A_Gm8817
  gRNA
auccuuguccguauaccuga

SEQ ID NO: 22037 - RNA, 20 nt, Artificial Sequence
  MKO10022037_A_Gm8817
  gRNA
ugauguuccuguccgccuuc

SEQ ID NO: 22038 - RNA, 20 nt, Artificial Sequence
  MKO10022038_A_Gm8817
  gRNA
cuagauucaccucaagacuu

SEQ ID NO: 22039 - RNA, 20 nt, Artificial Sequence
  MKO10022039_A_Gm884
  gRNA
cgaaggccugcuaucccucc

SEQ ID NO: 22040 - RNA, 20 nt, Artificial Sequence
  MKO10022040_A_Gm884
  gRNA
aaaauacgcuauauugaaag

SEQ ID NO: 22041 - RNA, 20 nt, Artificial Sequence
  MKO10022041_A_Gm884
  gRNA
ccuugggugcaauuuacuca

SEQ ID NO: 22042 - RNA, 20 nt, Artificial Sequence
  MKO10022042_A_Gm8882
  gRNA
gcugguaauccugcucacag

SEQ ID NO: 22043 - RNA, 20 nt, Artificial Sequence
  MKO10022043_A_Gm8882
  gRNA
gagacgcacagggucccccu

SEQ ID NO: 22044 - RNA, 20 nt, Artificial Sequence
  MKO10022044_A_Gm8882
  gRNA
ggacccugugcgucucccug

SEQ ID NO: 22045 - RNA, 20 nt, Artificial Sequence
  MKO10022045_A_Gm8898
  gRNA
uguguuaugcgugacucuac

SEQ ID NO: 22046 - RNA, 20 nt, Artificial Sequence
  MKO10022046_A_Gm8898
  gRNA
caagcucagaacuccaaaca

SEQ ID NO: 22047 - RNA, 20 nt, Artificial Sequence
  MKO10022047_A_Gm8898
  gRNA
cgugcaugugaacuucacuc

SEQ ID NO: 22048 - RNA, 20 nt, Artificial Sequence
  MKO10022048_A_Gm8909
  gRNA
cggcgcagaucacucgacgc

SEQ ID NO: 22049 - RNA, 20 nt, Artificial Sequence
  MKO10022049_A_Gm8909
  gRNA
gugguguugcagagacgcuc

SEQ ID NO: 22050 - RNA, 20 nt, Artificial Sequence
  MKO10022050_A_Gm8909
  gRNA
gaucgccaagggccaugagc

SEQ ID NO: 22051 - RNA, 20 nt, Artificial Sequence
  MKO10022051_A_Gm8994
  gRNA
ggaucauggcgaccacgacc

SEQ ID NO: 22052 - RNA, 20 nt, Artificial Sequence
  MKO10022052_A_Gm8994
  gRNA
ggucgcguccaccuccucgc

SEQ ID NO: 22053 - RNA, 20 nt, Artificial Sequence
  MKO10022053_A_Gm8994
  gRNA
cgagccagacgucgccaucc

SEQ ID NO: 22054 - RNA, 20 nt, Artificial Sequence
  MKO10022054_A_Gm9047
  gRNA
acuccuggacccucgagauc

SEQ ID NO: 22055 - RNA, 20 nt, Artificial Sequence
  MKO10022055_A_Gm9047
  gRNA
agaugauguugcgcuacgaa

SEQ ID NO: 22056 - RNA, 20 nt, Artificial Sequence
  MKO10022056_A_Gm9047
  gRNA
gcuuugguguuaggcgcaac

SEQ ID NO: 22057 - RNA, 20 nt, Artificial Sequence
  MKO10022057_A_Gm904
  gRNA
ucccauucauucucagaugc

SEQ ID NO: 22058 - RNA, 20 nt, Artificial Sequence
  MKO10022058_A_Gm904
  gRNA
ugaauagcauuauugaucca

SEQ ID NO: 22059 - RNA, 20 nt, Artificial Sequence
  MKO10022059_A_Gm904
  gRNA
cuaacuggcaggaugugaag

SEQ ID NO: 22060 - RNA, 20 nt, Artificial Sequence
  MKO10022060_A_Gm906
  gRNA
ugaauagcauuaucgauuca

SEQ ID NO: 22061 - RNA, 20 nt, Artificial Sequence
  MKO10022061_A_Gm906
  gRNA
cagagcuuccagugaaacaa

SEQ ID NO: 22062 - RNA, 20 nt, Artificial Sequence
  MKO10022062_A_Gm906
  gRNA
uaaaaagugcaucaguugcg

SEQ ID NO: 22063 - RNA, 20 nt, Artificial Sequence
  MKO10022063_A_Gm9112
  gRNA
aggggacgcuguacgaccag

SEQ ID NO: 22064 - RNA, 20 nt, Artificial Sequence
  MKO10022064_A_Gm9112
  gRNA
guccccuacuuuccgccuuc

SEQ ID NO: 22065 - RNA, 20 nt, Artificial Sequence
  MKO10022065_A_Gm9112
  gRNA
aagagacuuaccugcccaga

SEQ ID NO: 22066 - RNA, 20 nt, Artificial Sequence
  MKO10022066_A_Gm9125
  gRNA
agcagaaaugucagaggaua

SEQ ID NO: 22067 - RNA, 20 nt, Artificial Sequence
  MKO10022067_A_Gm9125
  gRNA
uuagauccugagaucacuuu

SEQ ID NO: 22068 - RNA, 20 nt, Artificial Sequence
  MKO10022068_A_Gm9125
  gRNA
ucagcucaccaucugcugca

SEQ ID NO: 22069 - RNA, 20 nt, Artificial Sequence
  MKO10022069_A_Gm9268
  gRNA
cucaaauccaagaguugugu

SEQ ID NO: 22070 - RNA, 20 nt, Artificial Sequence
  MKO10022070_A_Gm9268
  gRNA
uaugaacuaccaguuacuuc

SEQ ID NO: 22071 - RNA, 20 nt, Artificial Sequence
  MKO10022071_A_Gm9268
  gRNA
cacauccuacugcucaccug

SEQ ID NO: 22072 - RNA, 20 nt, Artificial Sequence
  MKO10022072_A_Gm933
  gRNA
ccacucucggugacuaugaa

SEQ ID NO: 22073 - RNA, 20 nt, Artificial Sequence
  MKO10022073_A_Gm933
  gRNA
cccuucauagucaccgagag

SEQ ID NO: 22074 - RNA, 20 nt, Artificial Sequence
  MKO10022074_A_Gm933
  gRNA
cuugcagccauaauccucuc

SEQ ID NO: 22075 - RNA, 20 nt, Artificial Sequence
  MKO10022075_A_Gm9376
  gRNA
cuauguguacauaauuuacc

SEQ ID NO: 22076 - RNA, 20 nt, Artificial Sequence
  MKO10022076_A_Gm9376
  gRNA
gucacgaugaagccugagac

SEQ ID NO: 22077 - RNA, 20 nt, Artificial Sequence
  MKO10022077_A_Gm9376
  gRNA
cuacaacaagaagauucgac

SEQ ID NO: 22078 - RNA, 20 nt, Artificial Sequence
  MKO10022078_A_Gm94
  gRNA
gcuuaccugcccggcauguc

SEQ ID NO: 22079 - RNA, 20 nt, Artificial Sequence
  MKO10022079_A_Gm94
  gRNA
ugucucaguucuucgccuga

SEQ ID NO: 22080 - RNA, 20 nt, Artificial Sequence
  MKO10022080_A_Gm94
  gRNA
ccccaaauucuuaagcaucc

SEQ ID NO: 22081 - RNA, 20 nt, Artificial Sequence
  MKO10022081_A_Gm9513
  gRNA
accuuuaaggguuaugaacg

SEQ ID NO: 22082 - RNA, 20 nt, Artificial Sequence
  MKO10022082_A_Gm9513
  gRNA
gaauucucggagaauuugug

SEQ ID NO: 22083 - RNA, 20 nt, Artificial Sequence
  MKO10022083_A_Gm9513
  gRNA
ugugcugaccuuugcuucac

SEQ ID NO: 22084 - RNA, 20 nt, Artificial Sequence
  MKO10022084_A_Gm9573
  gRNA
ucccaugaccacgauaacag

SEQ ID NO: 22085 - RNA, 20 nt, Artificial Sequence
  MKO10022085_A_Gm9573
  gRNA
ugucaucucuacgacauuga

SEQ ID NO: 22086 - RNA, 20 nt, Artificial Sequence
  MKO10022086_A_Gm9573
  gRNA
acaucuaccccgaccaccuc

SEQ ID NO: 22087 - RNA, 20 nt, Artificial Sequence
  MKO10022087_A_Gm960
  gRNA
ggccguucucaagacgcauc

SEQ ID NO: 22088 - RNA, 20 nt, Artificial Sequence
  MKO10022088_A_Gm960
  gRNA
cuuagaacguaacgcuucua

SEQ ID NO: 22089 - RNA, 20 nt, Artificial Sequence
  MKO10022089_A_Gm960
  gRNA
aaauacagccugcgcuaccc

SEQ ID NO: 22090 - RNA, 20 nt, Artificial Sequence
  MKO10022090_A_Gm9733
  gRNA
aacccugaccaugcaucacc

SEQ ID NO: 22091 - RNA, 20 nt, Artificial Sequence
  MKO10022091_A_Gm9733
  gRNA
ggcacucaguuguaugucug

SEQ ID NO: 22092 - RNA, 20 nt, Artificial Sequence
  MKO10022092_A_Gm9733
  gRNA
caugcucaccuguaaguccc

SEQ ID NO: 22093 - RNA, 20 nt, Artificial Sequence
  MKO10022093_A_Gm973
  gRNA
ucggccaaaagauaccuccg

SEQ ID NO: 22094 - RNA, 20 nt, Artificial Sequence
  MKO10022094_A_Gm973
  gRNA
cucuguugaauccgaaauga

SEQ ID NO: 22095 - RNA, 20 nt, Artificial Sequence
  MKO10022095_A_Gm973
  gRNA
acacgcaccugaugucaguc

SEQ ID NO: 22096 - RNA, 20 nt, Artificial Sequence
  MKO10022096_A_Gm9758
  gRNA
gaagucgaugacauuacagc

SEQ ID NO: 22097 - RNA, 20 nt, Artificial Sequence
  MKO10022097_A_Gm9758
  gRNA
aucccucagucacguagguc

SEQ ID NO: 22098 - RNA, 20 nt, Artificial Sequence
  MKO10022098_A_Gm9758
  gRNA
ucgccugaccuacgugacug

SEQ ID NO: 22099 - RNA, 20 nt, Artificial Sequence
  MKO10022099_A_Gm9839
  gRNA
cccuuacuagacuguucuau

SEQ ID NO: 22100 - RNA, 20 nt, Artificial Sequence
  MKO10022100_A_Gm9839
  gRNA
uccuauagaacagucuagua

SEQ ID NO: 22101 - RNA, 20 nt, Artificial Sequence
  MKO10022101_A_Gm9839
  gRNA
gcaguacagugugacaauag

SEQ ID NO: 22102 - RNA, 20 nt, Artificial Sequence
  MKO10022102_A_Gm996
  gRNA
guaccgagaacgcgauguac

SEQ ID NO: 22103 - RNA, 20 nt, Artificial Sequence
  MKO10022103_A_Gm996
  gRNA
gacgcgagguucgggauacg

SEQ ID NO: 22104 - RNA, 20 nt, Artificial Sequence
  MKO10022104_A_Gm996
  gRNA
ucgggcgauccacugagcgc

SEQ ID NO: 22105 - RNA, 20 nt, Artificial Sequence
  MKO10022105_A_Gm9992
  gRNA
gccugggugcagccccucug

SEQ ID NO: 22106 - RNA, 20 nt, Artificial Sequence
  MKO10022106_A_Gm9992
  gRNA
ugcacccaggcccagcaaga

SEQ ID NO: 22107 - RNA, 20 nt, Artificial Sequence
  MKO10022107_A_Gm9992
  gRNA
gagcagccucuacagugagc

SEQ ID NO: 22108 - RNA, 20 nt, Artificial Sequence
  MKO10022108_A_Gm9994
  gRNA
gaauguggggaucccaacac

SEQ ID NO: 22109 - RNA, 20 nt, Artificial Sequence
  MKO10022109_A_Gm9994
  gRNA
guagucugaaguccacaugc

SEQ ID NO: 22110 - RNA, 20 nt, Artificial Sequence
  MKO10022110_A_Gm9994
  gRNA
ugcccacagguccuuccagg

SEQ ID NO: 22111 - RNA, 20 nt, Artificial Sequence
  MKO10022111_A_Gm9
  gRNA
gccaccuaugaucaauguug

SEQ ID NO: 22112 - RNA, 20 nt, Artificial Sequence
  MKO10022112_A_Gm9
  gRNA
gaacccgaagcugaauccgu

SEQ ID NO: 22113 - RNA, 20 nt, Artificial Sequence
  MKO10022113_A_Gm9
  gRNA
uccccgcaaguuugaacacc

SEQ ID NO: 22114 - RNA, 20 nt, Artificial Sequence
  MKO10022114_A_Gmcl1l
  gRNA
guguuguaaaagcuguuucg

SEQ ID NO: 22115 - RNA, 20 nt, Artificial Sequence
  MKO10022115_A_Gmcl1l
  gRNA
caaccacuguuguuuguaaa

SEQ ID NO: 22116 - RNA, 20 nt, Artificial Sequence
  MKO10022116_A_Gmcl1l
  gRNA
acuuggagagaaucacacca

SEQ ID NO: 22117 - RNA, 20 nt, Artificial Sequence
  MKO10022117_A_Gmcl1
  gRNA
ucagcacugcaggucgcauu

SEQ ID NO: 22118 - RNA, 20 nt, Artificial Sequence
  MKO10022118_A_Gmcl1
  gRNA
gaccagaacauugauauaga

SEQ ID NO: 22119 - RNA, 20 nt, Artificial Sequence
  MKO10022119_A_Gmcl1
  gRNA
agcagcuugcaugcugcaau

SEQ ID NO: 22120 - RNA, 20 nt, Artificial Sequence
  MKO10022120_A_Gmds
  gRNA
uagaucgccguacuauucca

SEQ ID NO: 22121 - RNA, 20 nt, Artificial Sequence
  MKO10022121_A_Gmds
  gRNA
cuuccaggaugguucguacu

SEQ ID NO: 22122 - RNA, 20 nt, Artificial Sequence
  MKO10022122_A_Gmds
  gRNA
cucagguccauggaauagua

SEQ ID NO: 22123 - RNA, 20 nt, Artificial Sequence
  MKO10022123_A_Gmeb1
  gRNA
cuacccccuaccaucggccg

SEQ ID NO: 22124 - RNA, 20 nt, Artificial Sequence
  MKO10022124_A_Gmeb1
  gRNA
aagagagccauccgucuagg

SEQ ID NO: 22125 - RNA, 20 nt, Artificial Sequence
  MKO10022125_A_Gmeb1
  gRNA
aucgcuuacccuauaaccug

SEQ ID NO: 22126 - RNA, 20 nt, Artificial Sequence
  MKO10022126_A_Gmeb2
  gRNA
agcacgaagauugaccuuuc

SEQ ID NO: 22127 - RNA, 20 nt, Artificial Sequence
  MKO10022127_A_Gmeb2
  gRNA
acagcagagcuaaccucauu

SEQ ID NO: 22128 - RNA, 20 nt, Artificial Sequence
  MKO10022128_A_Gmeb2
  gRNA
auuguguaccccaucacuug

SEQ ID NO: 22129 - RNA, 20 nt, Artificial Sequence
  MKO10022129_A_Gmfb
  gRNA
uuaaagacgaacuacccgag

SEQ ID NO: 22130 - RNA, 20 nt, Artificial Sequence
  MKO10022130_A_Gmfb
  gRNA
gauuaacuuaccgacaggac

SEQ ID NO: 22131 - RNA, 20 nt, Artificial Sequence
  MKO10022131_A_Gmfb
  gRNA
aggauaucgaggcugccgcu

SEQ ID NO: 22132 - RNA, 20 nt, Artificial Sequence
  MKO10022132_A_Gmfg
  gRNA
acuguccucacccacggggc

SEQ ID NO: 22133 - RNA, 20 nt, Artificial Sequence
  MKO10022133_A_Gmfg
  gRNA
aggucacugacuuaugaugg

SEQ ID NO: 22134 - RNA, 20 nt, Artificial Sequence
  MKO10022134_A_Gmfg
  gRNA
cagugaaaguggacaaagac

SEQ ID NO: 22135 - RNA, 20 nt, Artificial Sequence
  MKO10022135_A_Gmip
  gRNA
cguuccccaaugauaucucg

SEQ ID NO: 22136 - RNA, 20 nt, Artificial Sequence
  MKO10022136_A_Gmip
  gRNA
uuugcgacucauucggacca

SEQ ID NO: 22137 - RNA, 20 nt, Artificial Sequence
  MKO10022137_A_Gmip
  gRNA
ggagagaucccgccaacuac

SEQ ID NO: 22138 - RNA, 20 nt, Artificial Sequence
  MKO10022138_A_Gml
  gRNA
aauagaagguguuaugcucc

SEQ ID NO: 22139 - RNA, 20 nt, Artificial Sequence
  MKO10022139_A_Gml
  gRNA
uguagacauagagcagccga

SEQ ID NO: 22140 - RNA, 20 nt, Artificial Sequence
  MKO10022140_A_Gml
  gRNA
agugucguuugcaaugaggg

SEQ ID NO: 22141 - RNA, 20 nt, Artificial Sequence
  MKO10022141_A_Gmnc
  gRNA
agccuuugugcgucgagaug

SEQ ID NO: 22142 - RNA, 20 nt, Artificial Sequence
  MKO10022142_A_Gmnc
  gRNA
accagauucugacguuguag

SEQ ID NO: 22143 - RNA, 20 nt, Artificial Sequence
  MKO10022143_A_Gmnc
  gRNA
uuccucaucucgacgcacaa

SEQ ID NO: 22144 - RNA, 20 nt, Artificial Sequence
  MKO10022144_A_Gmnn
  gRNA
ugagauugcccgccugagaa

SEQ ID NO: 22145 - RNA, 20 nt, Artificial Sequence
  MKO10022145_A_Gmnn
  gRNA
gccuuugaucuuauaaguaa

SEQ ID NO: 22146 - RNA, 20 nt, Artificial Sequence
  MKO10022146_A_Gmnn
  gRNA
ugccaaaaggcuuguucaaa

SEQ ID NO: 22147 - RNA, 20 nt, Artificial Sequence
  MKO10022147_A_Gmppa
  gRNA
caacgaugcagccguaguug

SEQ ID NO: 22148 - RNA, 20 nt, Artificial Sequence
  MKO10022148_A_Gmppa
  gRNA
aacugggugagggccucauc

SEQ ID NO: 22149 - RNA, 20 nt, Artificial Sequence
  MKO10022149_A_Gmppa
  gRNA
cuuccccuugagcgccaugu

SEQ ID NO: 22150 - RNA, 20 nt, Artificial Sequence
  MKO10022150_A_Gmppb
  gRNA
guguccaauaagaucaacgc

SEQ ID NO: 22151 - RNA, 20 nt, Artificial Sequence
  MKO10022151_A_Gmppb
  gRNA
uuauacugaccuguccccaa

SEQ ID NO: 22152 - RNA, 20 nt, Artificial Sequence
  MKO10022152_A_Gmppb
  gRNA
caugccugcguugaucuuau

SEQ ID NO: 22153 - RNA, 20 nt, Artificial Sequence
  MKO10022153_A_Gmpr2
  gRNA
aguagccguuagccacaucc

SEQ ID NO: 22154 - RNA, 20 nt, Artificial Sequence
  MKO10022154_A_Gmpr2
  gRNA
aggguuaccucaagacaguc

SEQ ID NO: 22155 - RNA, 20 nt, Artificial Sequence
  MKO10022155_A_Gmpr2
  gRNA
aacuuaccaugauggugugu

SEQ ID NO: 22156 - RNA, 20 nt, Artificial Sequence
  MKO10022156_A_Gmpr
  gRNA
aacucgaagcaaaccuacuc

SEQ ID NO: 22157 - RNA, 20 nt, Artificial Sequence
  MKO10022157_A_Gmpr
  gRNA
aacccaccccgaaugccugc

SEQ ID NO: 22158 - RNA, 20 nt, Artificial Sequence
  MKO10022158_A_Gmpr
  gRNA
cguucacaagcacuacuccc

SEQ ID NO: 22159 - RNA, 20 nt, Artificial Sequence
  MKO10022159_A_Gmps
  gRNA
cgaaggcugguguuuccaau

SEQ ID NO: 22160 - RNA, 20 nt, Artificial Sequence
  MKO10022160_A_Gmps
  gRNA
aagucauugaccgaagagug

SEQ ID NO: 22161 - RNA, 20 nt, Artificial Sequence
  MKO10022161_A_Gmps
  gRNA
uucaagguuguagcacguuc

SEQ ID NO: 22162 - RNA, 20 nt, Artificial Sequence
  MKO10022162_A_Gna11
  gRNA
cgucuccauggcgcgcacca

SEQ ID NO: 22163 - RNA, 20 nt, Artificial Sequence
  MKO10022163_A_Gna11
  gRNA
uccaggaguguuacgaucgc

SEQ ID NO: 22164 - RNA, 20 nt, Artificial Sequence
  MKO10022164_A_Gna11
  gRNA
cggguacgcgugcccaccac

SEQ ID NO: 22165 - RNA, 20 nt, Artificial Sequence
  MKO10022165_A_Gna12
  gRNA
ccgcgacaucgacgcgcugc

SEQ ID NO: 22166 - RNA, 20 nt, Artificial Sequence
  MKO10022166_A_Gna12
  gRNA
ugcgggucgcccuugaaauc

SEQ ID NO: 22167 - RNA, 20 nt, Artificial Sequence
  MKO10022167_A_Gna12
  gRNA
ccagcagcgcgucgaugucg

SEQ ID NO: 22168 - RNA, 20 nt, Artificial Sequence
  MKO10022168_A_Gna13
  gRNA
cuucgaccagcgcgcgcgcg

SEQ ID NO: 22169 - RNA, 20 nt, Artificial Sequence
  MKO10022169_A_Gna13
  gRNA
acggacagcacggagcgcga

SEQ ID NO: 22170 - RNA, 20 nt, Artificial Sequence
  MKO10022170_A_Gna13
  gRNA
agaacauccgccucguguuc

SEQ ID NO: 22171 - RNA, 20 nt, Artificial Sequence
  MKO10022171_A_Gna14
  gRNA
cgauacgcucaauguccguc

SEQ ID NO: 22172 - RNA, 20 nt, Artificial Sequence
  MKO10022172_A_Gna14
  gRNA
agcgaucugaacgacggaaa

SEQ ID NO: 22173 - RNA, 20 nt, Artificial Sequence
  MKO10022173_A_Gna14
  gRNA
auuuccgucguucagaucgc

SEQ ID NO: 22174 - RNA, 20 nt, Artificial Sequence
  MKO10022174_A_Gna15
  gRNA
gcgcagcacgucuugcgcag

SEQ ID NO: 22175 - RNA, 20 nt, Artificial Sequence
  MKO10022175_A_Gna15
  gRNA
gccuucgcucguagcaugca

SEQ ID NO: 22176 - RNA, 20 nt, Artificial Sequence
  MKO10022176_A_Gna15
  gRNA
uccgugcaugcuacgagcga

SEQ ID NO: 22177 - RNA, 20 nt, Artificial Sequence
  MKO10022177_A_Gnai1
  gRNA
acgcugccgaaucguucagc

SEQ ID NO: 22178 - RNA, 20 nt, Artificial Sequence
  MKO10022178_A_Gnai1
  gRNA
gguaggauuauccacgaagc

SEQ ID NO: 22179 - RNA, 20 nt, Artificial Sequence
  MKO10022179_A_Gnai1
  gRNA
cucccgggaucuguugaagc

SEQ ID NO: 22180 - RNA, 20 nt, Artificial Sequence
  MKO10022180_A_Gnai2
  gRNA
gugccggcaguaccgugccg

SEQ ID NO: 22181 - RNA, 20 nt, Artificial Sequence
  MKO10022181_A_Gnai2
  gRNA
agggcacgcaccgcacgcug

SEQ ID NO: 22182 - RNA, 20 nt, Artificial Sequence
  MKO10022182_A_Gnai2
  gRNA
uucucgugagcggccaaagc

SEQ ID NO: 22183 - RNA, 20 nt, Artificial Sequence
  MKO10022183_A_Gnai3
  gRNA
cauugcaaucauacgagcca

SEQ ID NO: 22184 - RNA, 20 nt, Artificial Sequence
  MKO10022184_A_Gnai3
  gRNA
aucaaucuucaaccguccca

SEQ ID NO: 22185 - RNA, 20 nt, Artificial Sequence
  MKO10022185_A_Gnai3
  gRNA
auuaaacguuuauggcgaga

SEQ ID NO: 22186 - RNA, 20 nt, Artificial Sequence
  MKO10022186_A_Gnal
  gRNA
aaaugucaaagaugcgaucg

SEQ ID NO: 22187 - RNA, 20 nt, Artificial Sequence
  MKO10022187_A_Gnal
  gRNA
auugugcacagucgaucagc

SEQ ID NO: 22188 - RNA, 20 nt, Artificial Sequence
  MKO10022188_A_Gnal
  gRNA
gguugaagccauugacgugc

SEQ ID NO: 22189 - RNA, 20 nt, Artificial Sequence
  MKO10022189_A_Gnao1
  gRNA
aggagugcuucaaccgaucu

SEQ ID NO: 22190 - RNA, 20 nt, Artificial Sequence
  MKO10022190_A_Gnao1
  gRNA
gugugacguggugagucgua

SEQ ID NO: 22191 - RNA, 20 nt, Artificial Sequence
  MKO10022191_A_Gnao1
  gRNA
caccggcuccaauccgaucc

SEQ ID NO: 22192 - RNA, 20 nt, Artificial Sequence
  MKO10022192_A_Gnaq
  gRNA
aggagugcuacgacagacga

SEQ ID NO: 22193 - RNA, 20 nt, Artificial Sequence
  MKO10022193_A_Gnaq
  gRNA
gucgucugucguagcacucc

SEQ ID NO: 22194 - RNA, 20 nt, Artificial Sequence
  MKO10022194_A_Gnaq
  gRNA
cgucagaguagcccgacccg

SEQ ID NO: 22195 - RNA, 20 nt, Artificial Sequence
  MKO10022195_A_Gnas
  gRNA
cggcgaguucccgacagucg

SEQ ID NO: 22196 - RNA, 20 nt, Artificial Sequence
  MKO10022196_A_Gnas
  gRNA
cgcaugcgacagccccccga

SEQ ID NO: 22197 - RNA, 20 nt, Artificial Sequence
  MKO10022197_A_Gnas
  gRNA
ucgauuguucgugaccgcgg

SEQ ID NO: 22198 - RNA, 20 nt, Artificial Sequence
  MKO10022198_A_Gnau1
  gRNA
uccauacugaauguugagcg

SEQ ID NO: 22199 - RNA, 20 nt, Artificial Sequence
  MKO10022199_A_Gnau1
  gRNA
ccuccagcgaauacccgucc

SEQ ID NO: 22200 - RNA, 20 nt, Artificial Sequence
  MKO10022200_A_Gnau1
  gRNA
uaccagcucaaugacuccgc

SEQ ID NO: 22201 - RNA, 20 nt, Artificial Sequence
  MKO10022201_A_Gnau2
  gRNA
cgaagcacguccugcucguu

SEQ ID NO: 22202 - RNA, 20 nt, Artificial Sequence
  MKO10022202_A_Gnau2
  gRNA
cuuucaggugcgggcgaguc

SEQ ID NO: 22203 - RNA, 20 nt, Artificial Sequence
  MKO10022203_A_Gnau2
  gRNA
uaacuaccucccuaacgagc

SEQ ID NO: 22204 - RNA, 20 nt, Artificial Sequence
  MKO10022204_A_Gnau3
  gRNA
ggcauacuuacucggcuccu

SEQ ID NO: 22205 - RNA, 20 nt, Artificial Sequence
  MKO10022205_A_Gnau3
  gRNA
ggauugauuaugucaauccu

SEQ ID NO: 22206 - RNA, 20 nt, Artificial Sequence
  MKO10022206_A_Gnau3
  gRNA
uggugauaugacuccacagc

SEQ ID NO: 22207 - RNA, 20 nt, Artificial Sequence
  MKO10022207_A_Gnaz
  gRNA
cgggcgcugcgaugcgcucc

SEQ ID NO: 22208 - RNA, 20 nt, Artificial Sequence
  MKO10022208_A_Gnaz
  gRNA
agacgcugagcgggauacgc

SEQ ID NO: 22209 - RNA, 20 nt, Artificial Sequence
  MKO10022209_A_Gnaz
  gRNA
ccgcucuagcgaguaccacc

SEQ ID NO: 22210 - RNA, 20 nt, Artificial Sequence
  MKO10022210_A_Gnb1l
  gRNA
ccuucugagagucgaagucg

SEQ ID NO: 22211 - RNA, 20 nt, Artificial Sequence
  MKO10022211_A_Gnb1l
  gRNA
acagccgcaggucucgaccc

SEQ ID NO: 22212 - RNA, 20 nt, Artificial Sequence
  MKO10022212_A_Gnb1l
  gRNA
augggggccaggguguaauc

SEQ ID NO: 22213 - RNA, 20 nt, Artificial Sequence
  MKO10022213_A_Gnb1
  gRNA
accugcgcauacgcuccuuc

SEQ ID NO: 22214 - RNA, 20 nt, Artificial Sequence
  MKO10022214_A_Gnb1
  gRNA
gaagaauccaaaugcggacc

SEQ ID NO: 22215 - RNA, 20 nt, Artificial Sequence
  MKO10022215_A_Gnb1
  gRNA
ugccgaugcgacucuuucuc

SEQ ID NO: 22216 - RNA, 20 nt, Artificial Sequence
  MKO10022216_A_Gnb2l1
  gRNA
guggccgacaaaucgccuug

SEQ ID NO: 22217 - RNA, 20 nt, Artificial Sequence
  MKO10022217_A_Gnb2l1
  gRNA
ggccacgcucaacacauccu

SEQ ID NO: 22218 - RNA, 20 nt, Artificial Sequence
  MKO10022218_A_Gnb2l1
  gRNA
aguuugcccucucgggcucc

SEQ ID NO: 22219 - RNA, 20 nt, Artificial Sequence
  MKO10022219_A_Gnb2
  gRNA
aaaguucccugagggggcgu

SEQ ID NO: 22220 - RNA, 20 nt, Artificial Sequence
  MKO10022220_A_Gnb2
  gRNA
cucaucugaauucgccccac

SEQ ID NO: 22221 - RNA, 20 nt, Artificial Sequence
  MKO10022221_A_Gnb2
  gRNA
aaaugaugagcuuuccgucc

SEQ ID NO: 22222 - RNA, 20 nt, Artificial Sequence
  MKO10022222_A_Gnb3
  gRNA
cuacaaccucaaaucccgcg

SEQ ID NO: 22223 - RNA, 20 nt, Artificial Sequence
  MKO10022223_A_Gnb3
  gRNA
gaucagcuucccauccugcg

SEQ ID NO: 22224 - RNA, 20 nt, Artificial Sequence
  MKO10022224_A_Gnb3
  gRNA
gcugcucguaagugccucgc

SEQ ID NO: 22225 - RNA, 20 nt, Artificial Sequence
  MKO10022225_A_Gnb4
  gRNA
guaguucccggacggggcgu

SEQ ID NO: 22226 - RNA, 20 nt, Artificial Sequence
  MKO10022226_A_Gnb4
  gRNA
cgggugagccgagaauugcc

SEQ ID NO: 22227 - RNA, 20 nt, Artificial Sequence
  MKO10022227_A_Gnb4
  gRNA
acucuuuaccugaaccagcg

SEQ ID NO: 22228 - RNA, 20 nt, Artificial Sequence
  MKO10022228_A_Gnb5
  gRNA
ggcgugugcuuacgcgccau

SEQ ID NO: 22229 - RNA, 20 nt, Artificial Sequence
  MKO10022229_A_Gnb5
  gRNA
gcugcacgagaacgagacgc

SEQ ID NO: 22230 - RNA, 20 nt, Artificial Sequence
  MKO10022230_A_Gnb5
  gRNA
cggacgaagauggcaaccga

SEQ ID NO: 22231 - RNA, 20 nt, Artificial Sequence
  MKO10022231_A_Gne
  gRNA
ucccaccugauugacgacua

SEQ ID NO: 22232 - RNA, 20 nt, Artificial Sequence
  MKO10022232_A_Gne
  gRNA
cugccaacaggaugcggucg

SEQ ID NO: 22233 - RNA, 20 nt, Artificial Sequence
  MKO10022233_A_Gne
  gRNA
ccuagcgcucgugaagcuac

SEQ ID NO: 22234 - RNA, 20 nt, Artificial Sequence
  MKO10022234_A_Gng10
  gRNA
cgcccugcugcucgguguuc

SEQ ID NO: 22235 - RNA, 20 nt, Artificial Sequence
  MKO10022235_A_Gng10
  gRNA
cgugagcgcccugcagcgcc

SEQ ID NO: 22236 - RNA, 20 nt, Artificial Sequence
  MKO10022236_A_Gng10
  gRNA
cagggcgcucacgcuggccc

SEQ ID NO: 22237 - RNA, 20 nt, Artificial Sequence
  MKO10022237_A_Gng11
  gRNA
gaugccugcccuucacaucg

SEQ ID NO: 22238 - RNA, 20 nt, Artificial Sequence
  MKO10022238_A_Gng11
  gRNA
agauccucgaugugaagggc

SEQ ID NO: 22239 - RNA, 20 nt, Artificial Sequence
  MKO10022239_A_Gng11
  gRNA
aacuacauugaagaacguuc

SEQ ID NO: 22240 - RNA, 20 nt, Artificial Sequence
  MKO10022240_A_Gng12
  gRNA
guuggugcuugccgucuugc

SEQ ID NO: 22241 - RNA, 20 nt, Artificial Sequence
  MKO10022241_A_Gng12
  gRNA
gaccucagaaaacccguuca

SEQ ID NO: 22242 - RNA, 20 nt, Artificial Sequence
  MKO10022242_A_Gng12
  gRNA
gcuccucacaguaugacauc

SEQ ID NO: 22243 - RNA, 20 nt, Artificial Sequence
  MKO10022243_A_Gng13
  gRNA
ggcucauaggauggugcacu

SEQ ID NO: 22244 - RNA, 20 nt, Artificial Sequence
  MKO10022244_A_Gng13
  gRNA
cccccgacgccauggaggag

SEQ ID NO: 22245 - RNA, 20 nt, Artificial Sequence
  MKO10022245_A_Gng13
  gRNA
ccacucacaggcuucucaag

SEQ ID NO: 22246 - RNA, 20 nt, Artificial Sequence
  MKO10022246_A_Gng2
  gRNA
cuuggcaugugccucacagu

SEQ ID NO: 22247 - RNA, 20 nt, Artificial Sequence
  MKO10022247_A_Gng2
  gRNA
uaugcuggcgguguuguugc

SEQ ID NO: 22248 - RNA, 20 nt, Artificial Sequence
  MKO10022248_A_Gng2
  gRNA
gaagaacuucuucucccgaa

SEQ ID NO: 22249 - RNA, 20 nt, Artificial Sequence
  MKO10022249_A_Gng3
  gRNA
caccuuuauccggcacaagc

SEQ ID NO: 22250 - RNA, 20 nt, Artificial Sequence
  MKO10022250_A_Gng3
  gRNA
ugaggggguccucacaagcg

SEQ ID NO: 22251 - RNA, 20 nt, Artificial Sequence
  MKO10022251_A_Gng3
  gRNA
ccacuuccgagaaccccuuc

SEQ ID NO: 22252 - RNA, 20 nt, Artificial Sequence
  MKO10022252_A_Gng4
  gRNA
ugaggggguccucccgcacg

SEQ ID NO: 22253 - RNA, 20 nt, Artificial Sequence
  MKO10022253_A_Gng4
  gRNA
uaccuucacccuguccaugc

SEQ ID NO: 22254 - RNA, 20 nt, Artificial Sequence
  MKO10022254_A_Gng4
  gRNA
agccugcauggacaggguga

SEQ ID NO: 22255 - RNA, 20 nt, Artificial Sequence
  MKO10022255_A_Gng5
  gRNA
caccuucacgcgguugagcc

SEQ ID NO: 22256 - RNA, 20 nt, Artificial Sequence
  MKO10022256_A_Gng5
  gRNA
uagcgucgccgccaugaaga

SEQ ID NO: 22257 - RNA, 20 nt, Artificial Sequence
  MKO10022257_A_Gng5
  gRNA
acaaaaaggagcagacuuuc

SEQ ID NO: 22258 - RNA, 20 nt, Artificial Sequence
  MKO10022258_A_Gng7
  gRNA
agguacuaacaacgucgccc

SEQ ID NO: 22259 - RNA, 20 nt, Artificial Sequence
  MKO10022259_A_Gng7
  gRNA
ugcccgcaacgaucccuugc

SEQ ID NO: 22260 - RNA, 20 nt, Artificial Sequence
  MKO10022260_A_Gng7
  gRNA
caaccagcaagggaucguug

SEQ ID NO: 22261 - RNA, 20 nt, Artificial Sequence
  MKO10022261_A_Gng8
  gRNA
uuucugcgaaacgcacgcua

SEQ ID NO: 22262 - RNA, 20 nt, Artificial Sequence
  MKO10022262_A_Gng8
  gRNA
ugcaaaagagucgcuugucg

SEQ ID NO: 22263 - RNA, 20 nt, Artificial Sequence
  MKO10022263_A_Gng8
  gRNA
agugaacaucgaucgcauga

SEQ ID NO: 22264 - RNA, 20 nt, Artificial Sequence
  MKO10022264_A_Gngu1
  gRNA
gugucacuuccuucuuaagc

SEQ ID NO: 22265 - RNA, 20 nt, Artificial Sequence
  MKO10022265_A_Gngu1
  gRNA
ggagguagaccagcuuaaga

SEQ ID NO: 22266 - RNA, 20 nt, Artificial Sequence
  MKO10022266_A_Gngu1
  gRNA
uggagaagacccucuaguga

SEQ ID NO: 22267 - RNA, 20 nt, Artificial Sequence
  MKO10022267_A_Gngu2
  gRNA
agugaagaacccacgugauc

SEQ ID NO: 22268 - RNA, 20 nt, Artificial Sequence
  MKO10022268_A_Gngu2
  gRNA
ugcaggcucaccagaucacg

SEQ ID NO: 22269 - RNA, 20 nt, Artificial Sequence
  MKO10022269_A_Gngu2
  gRNA
gggacagacccucuucucaa

SEQ ID NO: 22270 - RNA, 20 nt, Artificial Sequence
  MKO10022270_A_Gnl1
  gRNA
ccgguuggggucguagccuc

SEQ ID NO: 22271 - RNA, 20 nt, Artificial Sequence
  MKO10022271_A_Gnl1
  gRNA
auccgggaaguguaucagcc

SEQ ID NO: 22272 - RNA, 20 nt, Artificial Sequence
  MKO10022272_A_Gnl1
  gRNA
ccgugacccaucauauccgc

SEQ ID NO: 22273 - RNA, 20 nt, Artificial Sequence
  MKO10022273_A_Gnl2
  gRNA
uucauuucuagaucgaguac

SEQ ID NO: 22274 - RNA, 20 nt, Artificial Sequence
  MKO10022274_A_Gnl2
  gRNA
uucggcgccugaauauguac

SEQ ID NO: 22275 - RNA, 20 nt, Artificial Sequence
  MKO10022275_A_Gnl2
  gRNA
uucuggcacaguggcccgag

SEQ ID NO: 22276 - RNA, 20 nt, Artificial Sequence
  MKO10022276_A_Gnl3l
  gRNA
ggauguccugaaacgucagc

SEQ ID NO: 22277 - RNA, 20 nt, Artificial Sequence
  MKO10022277_A_Gnl3l
  gRNA
caaugaccaugccagucgcg

SEQ ID NO: 22278 - RNA, 20 nt, Artificial Sequence
  MKO10022278_A_Gnl3l
  gRNA
caaauuccugcugacguuuc

SEQ ID NO: 22279 - RNA, 20 nt, Artificial Sequence
  MKO10022279_A_Gnl3
  gRNA
gagcacuauuuggaacaccu

SEQ ID NO: 22280 - RNA, 20 nt, Artificial Sequence
  MKO10022280_A_Gnl3
  gRNA
gagaacaucaucgaaaauua

SEQ ID NO: 22281 - RNA, 20 nt, Artificial Sequence
  MKO10022281_A_Gnl3
  gRNA
acauuagacugcucaucacc

SEQ ID NO: 22282 - RNA, 20 nt, Artificial Sequence
  MKO10022282_A_Gnmt
  gRNA
gggcuucagcgugaugagcg

SEQ ID NO: 22283 - RNA, 20 nt, Artificial Sequence
  MKO10022283_A_Gnmt
  gRNA
ugaggauauagucguaguug

SEQ ID NO: 22284 - RNA, 20 nt, Artificial Sequence
  MKO10022284_A_Gnmt
  gRNA
gaugcugaaauaugcgcuua

SEQ ID NO: 22285 - RNA, 20 nt, Artificial Sequence
  MKO10022285_A_Gnpau
  gRNA
gcuacaccccgcccuuguau

SEQ ID NO: 22286 - RNA, 20 nt, Artificial Sequence
  MKO10022286_A_Gnpau
  gRNA
gggagugaucccccuauaca

SEQ ID NO: 22287 - RNA, 20 nt, Artificial Sequence
  MKO10022287_A_Gnpau
  gRNA
caagcuacaacgcgcugucc

SEQ ID NO: 22288 - RNA, 20 nt, Artificial Sequence
  MKO10022288_A_Gnpda1
  gRNA
cucacagggagcaccccgcu

SEQ ID NO: 22289 - RNA, 20 nt, Artificial Sequence
  MKO10022289_A_Gnpda1
  gRNA
ugcgcaggcauuggccccga

SEQ ID NO: 22290 - RNA, 20 nt, Artificial Sequence
  MKO10022290_A_Gnpda1
  gRNA
cagugccgacccccacuguc

SEQ ID NO: 22291 - RNA, 20 nt, Artificial Sequence
  MKO10022291_A_Gnpda2
  gRNA
cuaaucgaauaccacaagag

SEQ ID NO: 22292 - RNA, 20 nt, Artificial Sequence
  MKO10022292_A_Gnpda2
  gRNA
gaucugcagcguucccaucg

SEQ ID NO: 22293 - RNA, 20 nt, Artificial Sequence
  MKO10022293_A_Gnpda2
  gRNA
ucucguucuugauacuaaac

SEQ ID NO: 22294 - RNA, 20 nt, Artificial Sequence
  MKO10022294_A_Gnpnau1
  gRNA
gucguuagugacgagugcag

SEQ ID NO: 22295 - RNA, 20 nt, Artificial Sequence
  MKO10022295_A_Gnpnau1
  gRNA
uacuuacucaugaacuguuc

SEQ ID NO: 22296 - RNA, 20 nt, Artificial Sequence
  MKO10022296_A_Gnpnau1
  gRNA
uacauaccuuagcacaugaa

SEQ ID NO: 22297 - RNA, 20 nt, Artificial Sequence
  MKO10022297_A_Gnpuab
  gRNA
cagguguaaaccacgucgau

SEQ ID NO: 22298 - RNA, 20 nt, Artificial Sequence
  MKO10022298_A_Gnpuab
  gRNA
cgcaacauugaacaugucgc

SEQ ID NO: 22299 - RNA, 20 nt, Artificial Sequence
  MKO10022299_A_Gnpuab
  gRNA
ucugcccaugccaaucgacg

SEQ ID NO: 22300 - RNA, 20 nt, Artificial Sequence
  MKO10022300_A_Gnpug
  gRNA
uccgcucacccgaauguguu

SEQ ID NO: 22301 - RNA, 20 nt, Artificial Sequence
  MKO10022301_A_Gnpug
  gRNA
aacgccuacagcgggauccu

SEQ ID NO: 22302 - RNA, 20 nt, Artificial Sequence
  MKO10022302_A_Gnpug
  gRNA
agcggaaggucugcucgugc

SEQ ID NO: 22303 - RNA, 20 nt, Artificial Sequence
  MKO10022303_A_Gnrh1
  gRNA
ggacaguacauucgaagugc

SEQ ID NO: 22304 - RNA, 20 nt, Artificial Sequence
  MKO10022304_A_Gnrh1
  gRNA
uccuauggguugcgcccugg

SEQ ID NO: 22305 - RNA, 20 nt, Artificial Sequence
  MKO10022305_A_Gnrh1
  gRNA
acuucgaauguacuguccac

SEQ ID NO: 22306 - RNA, 20 nt, Artificial Sequence
  MKO10022306_A_Gnrhr
  gRNA
cucccgacucuaaccguauc

SEQ ID NO: 22307 - RNA, 20 nt, Artificial Sequence
  MKO10022307_A_Gnrhr
  gRNA
ugcuucgacccacucauaua

SEQ ID NO: 22308 - RNA, 20 nt, Artificial Sequence
  MKO10022308_A_Gnrhr
  gRNA
ucccgcaguuauauaucuuc

SEQ ID NO: 22309 - RNA, 20 nt, Artificial Sequence
  MKO10022309_A_Gns
  gRNA
gauagccgcacaccgacuug

SEQ ID NO: 22310 - RNA, 20 nt, Artificial Sequence
  MKO10022310_A_Gns
  gRNA
gcacggcgagaacuacagcg

SEQ ID NO: 22311 - RNA, 20 nt, Artificial Sequence
  MKO10022311_A_Gns
  gRNA
ugcuccaguccgccugcguc

SEQ ID NO: 22312 - RNA, 20 nt, Artificial Sequence
  MKO10022312_A_Golga1
  gRNA
cuguucuugaaauuuccgca

SEQ ID NO: 22313 - RNA, 20 nt, Artificial Sequence
  MKO10022313_A_Golga1
  gRNA
cacccaagacuaugcugaac

SEQ ID NO: 22314 - RNA, 20 nt, Artificial Sequence
  MKO10022314_A_Golga1
  gRNA
gacuggcuuuggcuuuagcc

SEQ ID NO: 22315 - RNA, 20 nt, Artificial Sequence
  MKO10022315_A_Golga2
  gRNA
uuucuuccgacaucccgggg

SEQ ID NO: 22316 - RNA, 20 nt, Artificial Sequence
  MKO10022316_A_Golga2
  gRNA
uuggcggugcaggagcaaua

SEQ ID NO: 22317 - RNA, 20 nt, Artificial Sequence
  MKO10022317_A_Golga2
  gRNA
cgcagccaauuugcucugcc

SEQ ID NO: 22318 - RNA, 20 nt, Artificial Sequence
  MKO10022318_A_Golga3
  gRNA
aguaccgaguuaagcgccau

SEQ ID NO: 22319 - RNA, 20 nt, Artificial Sequence
  MKO10022319_A_Golga3
  gRNA
cucgaggaacacugguacgc

SEQ ID NO: 22320 - RNA, 20 nt, Artificial Sequence
  MKO10022320_A_Golga3
  gRNA
uucaauuaaagacguacuac

SEQ ID NO: 22321 - RNA, 20 nt, Artificial Sequence
  MKO10022321_A_Golga4
  gRNA
gcgaggcugaagacgcacca

SEQ ID NO: 22322 - RNA, 20 nt, Artificial Sequence
  MKO10022322_A_Golga4
  gRNA
ucuguuucgaagucccauaa

SEQ ID NO: 22323 - RNA, 20 nt, Artificial Sequence
  MKO10022323_A_Golga4
  gRNA
gcugcacuaaccucucuguu

SEQ ID NO: 22324 - RNA, 20 nt, Artificial Sequence
  MKO10022324_A_Golga5
  gRNA
ggagcuguccaaucuccgac

SEQ ID NO: 22325 - RNA, 20 nt, Artificial Sequence
  MKO10022325_A_Golga5
  gRNA
uguccucaaagugcgacugc

SEQ ID NO: 22326 - RNA, 20 nt, Artificial Sequence
  MKO10022326_A_Golga5
  gRNA
gaccugcugcuaccgucacu

SEQ ID NO: 22327 - RNA, 20 nt, Artificial Sequence
  MKO10022327_A_Golga7b
  gRNA
gcucaggcgaagcgcuucgc

SEQ ID NO: 22328 - RNA, 20 nt, Artificial Sequence
  MKO10022328_A_Golga7b
  gRNA
gaucgggggcagcuccuauc

SEQ ID NO: 22329 - RNA, 20 nt, Artificial Sequence
  MKO10022329_A_Golga7b
  gRNA
gcuccugcucacggauccgg

SEQ ID NO: 22330 - RNA, 20 nt, Artificial Sequence
  MKO10022330_A_Golga7
  gRNA
ucgcugaaugaacaccuucc

SEQ ID NO: 22331 - RNA, 20 nt, Artificial Sequence
  MKO10022331_A_Golga7
  gRNA
uacccuguucuccagcuccg

SEQ ID NO: 22332 - RNA, 20 nt, Artificial Sequence
  MKO10022332_A_Golga7
  gRNA
uaugcagaagcagagaaacu

SEQ ID NO: 22333 - RNA, 20 nt, Artificial Sequence
  MKO10022333_A_Golgb1
  gRNA
gugcagagcauccucuugcg

SEQ ID NO: 22334 - RNA, 20 nt, Artificial Sequence
  MKO10022334_A_Golgb1
  gRNA
ccaaucagaacaagccucgc

SEQ ID NO: 22335 - RNA, 20 nt, Artificial Sequence
  MKO10022335_A_Golgb1
  gRNA
uaaauauuaggacucauccc

SEQ ID NO: 22336 - RNA, 20 nt, Artificial Sequence
  MKO10022336_A_Golim4
  gRNA
caaugcacuauaucugcuau

SEQ ID NO: 22337 - RNA, 20 nt, Artificial Sequence
  MKO10022337_A_Golim4
  gRNA
caucuugcagagucagcaug

SEQ ID NO: 22338 - RNA, 20 nt, Artificial Sequence
  MKO10022338_A_Golim4
  gRNA
gugcuucuaacuuauaaaca

SEQ ID NO: 22339 - RNA, 20 nt, Artificial Sequence
  MKO10022339_A_Golm1
  gRNA
ucgaaugagcuucucgccug

SEQ ID NO: 22340 - RNA, 20 nt, Artificial Sequence
  MKO10022340_A_Golm1
  gRNA
guguaucagccagaugaccg

SEQ ID NO: 22341 - RNA, 20 nt, Artificial Sequence
  MKO10022341_A_Golm1
  gRNA
aagcucauucgagaccugca

SEQ ID NO: 22342 - RNA, 20 nt, Artificial Sequence
  MKO10022342_A_Golph3l
  gRNA
cagauagauucgaccccgca

SEQ ID NO: 22343 - RNA, 20 nt, Artificial Sequence
  MKO10022343_A_Golph3l
  gRNA
ugcaguucgcgcucucguuu

SEQ ID NO: 22344 - RNA, 20 nt, Artificial Sequence
  MKO10022344_A_Golph3l
  gRNA
agucgcuucuuacgcauggu

SEQ ID NO: 22345 - RNA, 20 nt, Artificial Sequence
  MKO10022345_A_Golph3
  gRNA
gaugugucgucaugucaaac

SEQ ID NO: 22346 - RNA, 20 nt, Artificial Sequence
  MKO10022346_A_Golph3
  gRNA
cgagcuccgcugggucagcg

SEQ ID NO: 22347 - RNA, 20 nt, Artificial Sequence
  MKO10022347_A_Golph3
  gRNA
gcagagccgccgcgacgagc

SEQ ID NO: 22348 - RNA, 20 nt, Artificial Sequence
  MKO10022348_A_Golt1a
  gRNA
uucccuugagcuugugccgu

SEQ ID NO: 22349 - RNA, 20 nt, Artificial Sequence
  MKO10022349_A_Golt1a
  gRNA
gcacaauggcgacacccccc

SEQ ID NO: 22350 - RNA, 20 nt, Artificial Sequence
  MKO10022350_A_Golt1a
  gRNA
ggcacuucagaccauugagc

SEQ ID NO: 22351 - RNA, 20 nt, Artificial Sequence
  MKO10022351_A_Golt1b
  gRNA
ggaccacgaacacaccgccc

SEQ ID NO: 22352 - RNA, 20 nt, Artificial Sequence
  MKO10022352_A_Golt1b
  gRNA
uuuaggagggauccgaggac

SEQ ID NO: 22353 - RNA, 20 nt, Artificial Sequence
  MKO10022353_A_Golt1b
  gRNA
cugauaaagccaacgaccac

SEQ ID NO: 22354 - RNA, 20 nt, Artificial Sequence
  MKO10022354_A_Gon4l
  gRNA
ugacaugcuggaccgcaccu

SEQ ID NO: 22355 - RNA, 20 nt, Artificial Sequence
  MKO10022355_A_Gon4l
  gRNA
gaugguguaugacccgaaac

SEQ ID NO: 22356 - RNA, 20 nt, Artificial Sequence
  MKO10022356_A_Gon4l
  gRNA
gaugacccgcucuaaacuga

SEQ ID NO: 22357 - RNA, 20 nt, Artificial Sequence
  MKO10022357_A_Gopc
  gRNA
gaccugcucacgauaagcuc

SEQ ID NO: 22358 - RNA, 20 nt, Artificial Sequence
  MKO10022358_A_Gopc
  gRNA
uucuaauuggaccgacuccc

SEQ ID NO: 22359 - RNA, 20 nt, Artificial Sequence
  MKO10022359_A_Gopc
  gRNA
ggugcaacagauacaauuac

SEQ ID NO: 22360 - RNA, 20 nt, Artificial Sequence
  MKO10022360_A_Gorab
  gRNA
accgugcguaggaauacucc

SEQ ID NO: 22361 - RNA, 20 nt, Artificial Sequence
  MKO10022361_A_Gorab
  gRNA
ccuuucggagcucguucugc

SEQ ID NO: 22362 - RNA, 20 nt, Artificial Sequence
  MKO10022362_A_Gorab
  gRNA
uaaacguaagaaagcccuuu

SEQ ID NO: 22363 - RNA, 20 nt, Artificial Sequence
  MKO10022363_A_Gorasp1
  gRNA
caccagccucgagugcccga

SEQ ID NO: 22364 - RNA, 20 nt, Artificial Sequence
  MKO10022364_A_Gorasp1
  gRNA
cacaugccacacguguucgc

SEQ ID NO: 22365 - RNA, 20 nt, Artificial Sequence
  MKO10022365_A_Gorasp1
  gRNA
cuggccgccccacauguugc

SEQ ID NO: 22366 - RNA, 20 nt, Artificial Sequence
  MKO10022366_A_Gorasp2
  gRNA
cggucacaccgagcaacuug

SEQ ID NO: 22367 - RNA, 20 nt, Artificial Sequence
  MKO10022367_A_Gorasp2
  gRNA
caaguugcucggugugaccg

SEQ ID NO: 22368 - RNA, 20 nt, Artificial Sequence
  MKO10022368_A_Gorasp2
  gRNA
agcugauaccgucaugaaug

SEQ ID NO: 22369 - RNA, 20 nt, Artificial Sequence
  MKO10022369_A_Gosr1
  gRNA
cacgggauggaggacgcgau

SEQ ID NO: 22370 - RNA, 20 nt, Artificial Sequence
  MKO10022370_A_Gosr1
  gRNA
gcucguacagaguuuacuga

SEQ ID NO: 22371 - RNA, 20 nt, Artificial Sequence
  MKO10022371_A_Gosr1
  gRNA
uauugccguaaaguuugcuu

SEQ ID NO: 22372 - RNA, 20 nt, Artificial Sequence
  MKO10022372_A_Gosr2
  gRNA
uucagcaccggcgccaaguc

(The sequence listing continues in the following parts.)

---

What is claimed is:

1. A vector comprising a 5' long terminal repeat (LTR) sequence, a U6 promoter sequence, a BsmB1 restriction site, an EFS sequence, an sgRNA expression cassette, a Thy1.1 cassette, a 3' LTR sequence and an ampicillin a resistance gene sequence (AmpR) wherein the vector comprises a nucleic acid sequence selected from the group consisting of SEQ ID NO: 129,213, SEQ ID NO: 129,214, and SEQ ID NO: 129,215.

2. A vector comprising a 5' long terminal repeat (LTR) sequence, a U6 promoter sequence, a BsmB1 restriction site, an EFS sequence, an sgRNA expression cassette, a Thy1.1 cassette, a 3' LTR sequence and an ampicillin resistance gene sequence (AmpR), wherein the sgRNA expression cassette expresses an sgRNA comprising a nucleotide sequence selected from the group consisting of SEQ ID NOs: 1-129,209.

3. The vector of claim 2, wherein the sgRNA expression cassette expresses an sgRNA consisting of a nucleotide sequence selected from the group consisting of SEQ ID NOs: 1-129,209.

* * * * *